United States Patent 8,216,786 (GENETIC POLYMORPHISMS ASSOCIATED WITH CARDIOVASCULAR DISEASES, METHODS OF DETECTION AND USES THEREOF) - sequence listing, part 11

SEQ ID NO: 1271 - DNA, 593746 bp, Homo sapiens
gcctgggcaacagaatgagactccatctcaaaaagtttaaaaaaacaactcattcctttaagaattacagcccaagggcccataatctgggattgattagctaggtttttaaaaattatttccaagagtctgtgagcctcaaaagttgtaattgtatgcaaaattatacgttttttaaaacttttttgaaggctttcatcaaattctcagacctctgccgttcagaaaaactttagaatcataaattcacagatattctagaataatgaattcaacagctctcaccagacatctgaaatatcacagatattttagaatgaaaggattaaatatccattaccatttgaatattgctgttaaaagtagaatgatatgcaaaactctatacattaaggtttactttgtttagttgtatctagtagcccttaataaaatatacatctatgactgcatagcctggtacactatgagacatagttgctttcatctgcttttaaacttcacaaatagtcacctgaacgagatcatctgcaaaacttaaagtttctcttctgggttatctcaagctttattcatataatccatttttttttacaagtttacattacttttttttttgtatctgctaaatttcagctaaatattaacaattatggaagctaatgtttcagagaattaatcagctattatttcaaattgcaggctaaatcacaaatggaacccaagctaaatcttgttatacataaatattagtagtagttaacatttactgagtacttattatgtgtcagcactaagataagacctttacataaactattttagctaccccaaaagtcctgtgataaggatattattatcctcactttaaacatgaaagaaacaaagacttagtgagatttggtaatcagccaggaatcaggatcccacaattcataagtttctttatgactccaaatccttagcatattttaaaatatatttaaatatgtattagtatttattgctccactttcgatttttcgatttttgtcatcaaaactaatattgggtttgtggccccctgcttctttctttttttttttttttttttttttttgagacggagtcttgctctgttgcccaggctggagtgcagtggcctgatctcgactcactgcaagctctgcctcctgggttcacgccattctctggcctcaggctcccaagtagctgggactacaggtgcctgccacctcacccagctaatttttttgtatttttagtagagacagggtttcaccatgttagccaggatggtctcgatctcctgacctcgtgatctgcccgcctcagcctcccaaagtgctgggattacaggtgtgagccaccgcaccctgccttctttctcatttttaatcttcctattcacaacagaatatatcttcttccttaaaacaatttcaactttgtgtctctctcttttaaaaaaaaaaaaaaacaaaaaaacttcagtcttagatacaaaataacatgcaaaaaggaaaccagaaacttgaaaacatgccaggtaatactccctttatgtcacagtccctgtattatgtatcaacaaaattttacaccagagtggtaaaattcaacttgattgcaatctcacattccctttcttttttaggacatttgcctcttgctccaattaactctttttactttcatgattcctatacaaggcccacactttgtactgtttaaatcctaatgctttttataatccagagaatccagtcactgctgcagacccaggatagccaaaaactcaggcccaccacctctggctaccactggcctcctccttttgtcttagtggaccatgagccttgtcattttgtaactgagccatgactcaaaaagaggcaggaagtattcttttttttttttttttttttttttttctgagacggagtctcgctctgtctcctgggctggactgcagtggcaggatcttggctcactgcaagctccgcctcccaggttcatgccattctccttcctcagctaggactacaggcgcccgccactgagcccggctaattttttgtgtttttagtagagatggggtttcaccgtgttagccaggatggtctcgatctcctgacctggtcatctgcccgccttggcctcccaaagtgctgggattacaggcatgagccaccgcgcctggcctgaaagtattctaaatactccaacaaacaggaccattctgtagttcagttgtttttcaaaaacaactttaatagcgtttctgttaatataattttatgcagaaagctaatatgtatatataagaaaaaagcaaatatcttattgaaactccagaaacttgatgaccccactcttgccaatccctgacctgtctgagggactcttggtatctcctgtagctttcagtagcactgttgaaaactgtgttgaatacttagcaggtattgactttctttttctgatctggtcagttcctcagccttgattacaaataaaatcaaacaaaaatgtagtttatctagcatgcattttccttcttggtaaaactaaacacgaaaaatgcatacttattaaatagaattttttgaaatgttagaaataaaatataatggcttttattaaaatgttattaaagtactcaataaaatcaataaaagatgtccaagttgttgcaggccgcacaattgacagtgaaatagtgtctgtcaaaattgcagcttagttgtcgaaacacctgtgcaggctcagcctcgggacctgtgagagtggctgtaacagccactcaagtctcaagtgaatcaacattattttgtatagtgccttcttcaaacctaaatcttctgcttgcttctcccactttaaaataattatctccattcccttatcttcaaattgtttctctgctcactctgatttgatttctatttctacaattctgcaaggaaataaaaataaaaacaacttcttcaaatgacctctttgttgctaaatccaaaatccttaccttattcgctttcaggcatttccctaatgaagttcctttttctctattgtagcagtggtcctcagtggttactcaggtttctttatttcagtctctttccctacttgctccttctctcttatcctgaatggtcatgcttaccagggttgggttctcaggcctcttcctttttaaacaaatctgcatgcttccccaggtaatttgattccgacttattgatttcacccattataaatataggttgatgattctcaaatttcaatttctagctccccctgagctgtaagtccatatatccaagcatcaactggatatctccactgagctgtctcaacaggtatgtcaaactcaatgcaaaattgaacacctttcccttcttcagactgccttctctttgacctttactgattgagtaaatgataccatcatttactcagatatttgtacctgaaattggaagttaggtttaacatctgtccatggattggtagcttcacaaacctatagcataaacactgtatcgttatcatctttgagtctccacttggaacagtgtgtgccacttgtaggtgtataatccatattaagccttttctgaaagtagaagtagtaacatgtagtgtttctggcttcacgttcttcagtggctctccccactcacatcaggataaaattcaaagttcttgccaagactttgtcatacagcccttgtcttacttctgctgcctcctgcttattgctacacctccaaaagccactgggcttcagtagaatccaactacttattattctcaaagtatggtcagctctcaaaatttcacatcttctccagctgggcgcggtggctcacgtctgtaactccaacgctttgggaggccaaggtgggcagatcatttgaggtgaggagttcaacaccagactggccaacatagtgaaaccctgttttcaataaaagtacaaaaattagctgggcgtggtggcgtatgcctgtagtcccagctactcggggggctgaagcaggagaatcacttgaacctgggaggtggaggttgcagtgagctgagattgtgcctgcactccagcctgggcgacagagcaagactccgtcacatcttctcaaatgttttctctttgagttatccctcatgtcttcaccaaagtctagttattcctcaagacttagctcagctattacattctttaggaacctctgtagcttctataacattctgtgcaaacctgtgtgaactcatcaccatgttataattacttgctcatttatccatctaccctactagtctatgaacataataagaatcaggactgtctttcatcattgcaccactccaggtagctgacacctgatagttgaagattacttgttgaagagagtaataagttttgagaacttcgtaaaagaagctttcttaatttccttttaaaaaacaatggtaaaatgtcagtaccactagggggcacagactagtaacagaattttccggtacactagcttaaaagagatgtttgccttctgtggcaacctcttcacatagtttctaaatatatggatcttaaaaagttcaactaactctattattcccagagagatatgtttaaatagttggctaacagatagagagcagtgctgacatattaacatgtcagaaaaaatgaaatcaggtatggccaaatacgattaacagggttttataaataaagctgagaatagcattaagaaaaagatcaaaatgtaaatacaatttcaagaaattgatactatgagacttgggactatttttaaaatttcagcacagaagagtgtctatgcagggaaactcctacttccacaggaaaagtgaagagaaatattgaagctatttctgtgtttagaataaaacctcaaatcctcctccaagataaccaatagaaactttccagtacttttcatttgtaacaaaacccattaagattattaatacaaaataataggctaagtattttttattcaaaagctgatatagattagtagttaaaaatctagttttggttctgtttttgccctgcctcagctaatttttagtttaaaaaaaaattaacttgtctacacctcagtttctgcccctataaattggatatgattgtagtgcctacttatgaaactattgtcacaattaagtgaaatttattttgttttattttattttattttgagacacagtctcaccctctgttgcccaggctagagtgcagtggcaccatcttggctcactacaacctccacttcccaggttcaagcgattctcatgcctcagcctcctgagtagctgggattacaggcacctgccaccatgcccagctaatttttctattttttagtagagacggggtttcactgtgttggccaggatggtcttgaactcctgatctcaagtgatccacccactttggcctcccaaagtgctgggattacaggcatgagctaccacatccggcctgaaataattactgtaaaccacagtgcctaacacatacaaaacacatgataagtatttgctattattttgcttcaacaattgtgatcagcacaatatttcagtaattcctagaaacagtaattttgttagctgctggaataaaaatggtgagaacttgttgagccctttccgcactatttctctaccagcctctccttacagccacactcattcacacccacctcctttctgcatccctggggcagaggttgttctgaagaacactgtcccatttgccatgtgaggtaggcctgggactcctactgtgttatgactctcatgcagtctggtgaggctcatatgatctctgacgttgtcctgggttctctgattaatttctgcttgttgaagaaagagcgtgagaagtttgtatcataactcttagagataagaattgttgatgactgatcaaaacaaatggtatattatgctgatacatttaaaataatagcaggagataaatatgtttactgaaccaatggttatgatatctatgaaatgcaatatagctgttatgcttattggtttggttatggcctgattggaaggaaataaaagctaaggagaagggtggtagcttaaagggactcctattcaggagtctggagacttcagttctacccctaagcttacaaggcaaattgctgagccctgtgcacatcattaaacagcagccaatcatgaatttccatttctccattagtgcattttctttttgttgattattttctactttttaagttttatatttgccccttcattattttcccaagcagactcatgtcacatgcatttcctttttattatagggtttaagaattctatttatcattccctgtctgattagcccaggaatttcacaatggatcaatatgcacccatatcactaaagagtggctactaaagagcgtatcttgtagtaggagataggcgcaaatgagaaaatgggtaggcatgaagaagaaggaaagtgggagagtgagtcattgatgctttgtgaaactcgtccagatccagttattctgcccctcttatgagcattgaaagtcttttttttgtgcatctctagctcatgtatagaatttcaaatattattatttcagagtacctttcagaagaataatacaatgggatagaaaacacactgaggccaggagcagtggctcacgcctgtaatcccagcactttgagaggctgaggtggaagaattgcttgagttcaggagttggagaccagcctgggcaaaacagcaagaccccatctccaaaaaagaaaaagaaacacactaaaataaaatatctctagaaactatgttcagttgaaaccatatccatgtagacttcagaaaatgtttccaaggtcataaatttcaggcaagcatcttaagagaatgaatgagtaaaagcaaacacatctcaaaagatggggagggccaatcaactcacatactttacactagcagttaacatttgcctttacctcttcataatgctctaatgtaattataatgcatagaatatacactgttttactcactgctcagtatgcctatcctcttttctaaatttgaattttaatatttcagcaaaacgaactaataaaaggcagtttcctagcaacgtctgtattcaaaggaacaacaacaaagcttaatcgcaaacaccttattttctccaaagttaattcccgtcttttgagggaagttagcaggtagcaaataaagcaaggtgcaaacagaggctcttgtaggagaggttggcacagactcacttggctttttctttctgggcattgaaaggtaggaaggttagaacttcagctaagccagtctttcccaatggttgcagtcagagattgatacaaaaccccagaactgtttgctattttatccattctctgctggagatgcagattgattggtggaaggaacagtgaactaggaagccaggttgttggattcctagtaactctcacactacccgcgaaaacttgagcaggccctctttttctgggctgtgtatccaaatggcggttactctagaagacataagtgaaaggtccttctcagcagctcaaaacggctaccagtaaccgggtcttttttattttttaattaagcttaaatggcatttgcttaatcaataatacagtttcactagaactaatgctgcatccccagaaaagcatcacttagaaattaaacagctggctgtcttccagggaaacgtgtccctgtgtcctgccttcctgagacttcttgcctgcacgcggggcccagccgcgccagagagatggaagtgactttacctacccagcgaaagtagcagtctgcaacaaggaaaacagctaagttaagaggaagtggttttcattttactgcttgcagaaaggccaagattttgacgtttaaagcgggcacacgagtcattttaagtctctagatctttcaccctgaaagtccctgcacagaaactccatagggagtctaaatatagcaacagcaccccctcccgccccctccgccttcagtcagggtcccgcgcagctctaggattggagagcttactccagggcgctctctgcatctgcctcgaatagcaccgcacggagcaacctctctcgcacctccacagtgcgtgggtgtgaagtgtattaggggaaagctagagagtgactctgggtgatggtgctcggctcacagtcacatggcgtcgccgccagctgcacagagctcccagctagcttctgctgcccagaggcttggggggaaggagggagggaagcaggctcctgctggtgaccaggagcaggcgagagggcttcacacaaataatagtgataataaagagtaaaagcaaagcatttaaatcgagctattgcagaagacagaaatcagctgccgcgggcgtgggtgtgtgtacagggtgggggagaattgggaaagtatttatctcggaggggcggagacagctgcaagaagacttttgtcttagcattgttttagccttaggaaaggaaaaggcccgaaggaatccaccttgcaactatctgctatgtctttgtggtggaagcttagttttgccttcaatttaatttgatgattttctttcatatttggggaagagccactctgttggaagaagtccccgagcctggcacccttcagttttccctatgctgaatgtgagatttaaactgccttttctttgtaatacactgtttctgaaggccagaggctgcggccagtggcaccgtggcctctctctccgccaagggcgcataggctttgggccacccgggtgccaggggtggtggaagacccagtcagttgttccttgcaacaggtctctaagcttgtatgttacaacataaggtgggtggggtcggaaccccgaaaagccggcgtcctggacaccccatcctccaggtgttctttcccagacactgggtcctcgccgccgctgctgaacttctcaatcatatgactttctcggacttaaatggaaatttcttgacggagggaactgggtttgttctcccaggcttcgcgctgcagtcaggcagagccccggggcagctcgctcaccgcggaggagccactttggagttttacgccctttccacaccccacccatggactggaaaggatgttcagttactcgcgagcttgtctgatactgggatggaaagtcacagtccgcaggctggagtgaggcgcgggaagatgcctggtccttgcctcgcggacttggcagccgcgtcctgcgggtctgtccactgaactgctgaggactcgcccgtgtgcggggacccgagtgccacttcccggagcgttaccttgcgctccagcctccaggctagataatacctggaaggcagggcagggctgttcccgctctcaccccttgcggaaggatggcaggatccggcgcagcgacgtagcagcgggagggcacagcgacctgcatctccagtttctcctcaggacacaaggctgacttcaccttccggacagctgcaaagcccctgccagaaccaaaccgaactcgcgcctcggagaggggcttctggggccgtttcgctgcagggcgtggggagtggagagagggaaggggaagcctggggctgggtgtgcgcgcgtgggagcgcgcctcggagcgccccgcactcccccactctatccccgggggcagtttgggaaggagggagtggtagtcgcgggaatgagggagcaagagaaaccctctcaaagtgacgccccaaacaggtccggatttagaattcgaagctaaaggctgttagaaattgggactcctcggcctcctctgcagcccctcctttcccgccccgaagcccgggcggtttgctggctgcctgcttccccgcccccggctcagaggtctctggctggcgggcgccccgtcggccgccggcttcctccttgaaacccgccggcgcacatgaggccgctgcccccgccgcaggcgctggcggccccctcgcggtgcccgtggtgatgccatgccccgccaccacgcgggaggagaggagggcggcgccgccgggctctgggtgaagagcggcgcagcggcggcggcggcgggcggggggcgcttgggcagcggcatgaaggatgtggagtccggccggggcagggtgctgctgaactcggcagccgccaggggcgacggcctgctactgctgggcacccgcgcggccacgctcggtggcggcggcggtggcctgagggagagccgccggggcaagcagggggcccggatgagcctgctggggaagccgctctcttacacgagtagccagagctgccggcgcaacgtcaagtaccggcgggtgcagaactacctgtacaacgtgctggagagaccccgcggctgggcgttcatctaccacgctttcgtgtgagtacccgcgccccctgctatgcccgctgcaggggaccactgtccctggccccctggggcgtgctccgcgctcgcgcccttgggcccccgcgcgcgtgcacacgtggtggcttttatttcttcgcacgtgttcgtggtcttccttctggagcctctcccctcccccagccccacttctctcatctctacagcttgaaccttttccccgaggacacccaatgaactgcccggtagcttcaggctcccggggcgagagccaggcagacgcgggacttaggctgcgcggataattgggagcaattaggtcccaagatacgtaaacttcaaccgaacggggcgcccgggagctagggaatgcaaagggaggacaggcgcccgtgtgaggcttgagagtatactggagaggttaggaggtgatggcggggtaggacggggagaagtgagggggcatcgagggctaggtcctcagtcctaggggcggagtaggggaagctgctacttggagagagctgctaggttttaagcgcgcccggaaacacgcctcgccaccacccagccaccaccaacggaaaatctgtcagtgcatgtagcccttcctgccacggagaaggtggccaaggtctagaggaggccagcaggccaggcgaagcaacgctcccgcgctgcagggggcggggaggcagcggggaacctggggcgcaggaacgcgggcggaggtgcgatagcagaagcgcaaatgggtcgcctctgacagagatcgggcagtgggttaagtccccgtttgtggcgcggagtcaaagagtgtgtgtgtgtgtgtgtgtgtgtgtgtgtgtgtgtagtaagccttctccatctagcagagaatgcttaatgagaaaatgattggaagcaaatgtttatttttcccttaggcatttaaaacctttcagtggctttaaagtttactactgtttttcccacaaagtccattcattcagtctcctattagagttacgtttatctgggcattttaaggttgtttttataatgttacctcgtgtctaattctttttttcttcctcttctccttttgcttcctctttttttagtattattatttctgcttcttttttgttaagatgaaatataaagacatcaaccttagaagaccagtagagaaagttgcagatactcgctgatacattccttgtttcctagtaaaataagttttgagcacacggactaggtttcttttagaaataagttatgtcatccatacatagctctctcctgggatgcagaattagcatcaacaccagaaacgtgttttgaaataacatggaagaagggctggttttgtaactaggtgaacctggaattcaaccacataggagtcaggaaattggtggagtctacaatctgtggggctctggtgtctggaaaattttacagtcccagattgacgtgaacatgtagcattaggcagaatattccagccaactttccgttttacaatgcacacaaggagaacggttgtgttgcatcatcattacatcaaaaagtataacttttatgtaaaattcacatttatttaaatgtggttaggataatgatagagaaatgcaactgacacttttctcgttaatctcctctgacctgatatgtaattaaacatattacttaataagcctggtaaattattttgacctgtcagaatatactaaaataatttagcaattataatgctcaatttggtagcaaatatatatactgtataggttatgattttttctttacaacagtatgctcaaaacatttctagcctttcttttttttatattatgcattgtatattcagagagagttaaagaaagccttggttggtgcacatactttgcatctcctaacttgttcttgaacatgaatgagaacttgcaacacaacattttcttttccatgtgttggtgttaacaggtttgtatgggcttacagaattttaaaacattaataaatgatttttccaaaggttcaaggttggatacttctctgtctaccaggctttatcagtctagcagtatctttagtagtagacaggaaataaattgtgtacttaatagatgtagcaaatgtgaagttttgattatacattttagagtctgaaactgcaatgcctcagcaattagataggggtgctatatccacattagcacaaagagggaatggatagtatcatcttttgggaggattgtgcacaactaagcagaccctgaggaaagaggccatctttggcagttgctgcttgtgattttaaatgagctttagaatagccagactttacacattacattcatttatcgaagttgctttatgctgtaagtttaactagaccccaataaaataatttcgagagaggtgtaactaactaattccctgccagcttgggaatccccaaatcttattttaataacagtatttgtagcatattaaggttcttgccaagaacaagtgcaccgtgattaatgaggtacttcaggggtgaatttacttggtcaaccagtgttttcactgccaagaaacaagaaaagcatgtttaaagttatgcttgaggtaaatataaatttctattatttatgcaaaaataattattataatggtattttagggttataaaatgtcttttcaagagtacatatcctagcctattgataggatggctggacagagcaagggatgacctacttcaaatattttcccttaaactttataaattagtggagattaggagatccttgcccttactattctttaggatttacctgacagccatatttcctatcttcaacttttcttcattttattagtgtgctattcaaacatgaggtggctcatttccctgaatgttgtttgtccctttttaattcctccttgtttaaggaaaattttgaagaataatgagggtagtagggggacacaggatgaggcttcatatataaatttgcgttgatgcagcaaatgtggttctgagaagttacatgggaaacggtgttgcagatacatgtaattgatcactttgcctaatgtatctttgcctgacttaatgctatggatgtgaattatagatattaaacaaggagacaagaagaagtcacccaagctaggagctctgaagtcatcctttttctcatacttactccttctggtcaggcaaaaggtcattaactattgtttgtttactttataggtatttttcaaatacattcccttttcttctttaccacttctattccattctgtttcttacctctccattagatgatttgtaatattctcctgcctgatcatctggtttctgttctcagccttctctctgctctaacatcatagtattgttcgtaaaatgcaaatcttatcatatcatccccttgcctaaaatatttccatgactcttatcatctactccttcatctatgtatccatctacaattattagagtgtgtaatatgtgctaattcccaaattaacaaggcaaaggcctccactctggaggaaggaaaagacgccagcaagggactactacaagcctgtgaacaagtgtgaaacaatgttattggtgtgcttagagagagaggttacaaagtgacatgagaaaagaaaaagaagtgaagcccgggcagaaaagtcagcacaggcttcaaaggggaagtgaggtgtaagctgagtttccacaaatgagtagttaattttcaggtgggcatagcaggagggaatgaacaatcttgacagagaaaacagcttgagtaaagatatggagttgtgaatcagcacagtaattctaggtactgttaagtattttcagggtgaggaaagccacaagaaagggtggtagagcaaaaggcaaatcaccaatctgttggatagattctgatgctgaccatagaatcttgtatttatcctgtaggcagtagtggtcattgaatggtgataatcaggggaatgatataatcagatataaattttggaaagatctgcctttcattagttcagcaaataaattggagtgcaaaatggagtcaatatggcctataaggagatgataccaattgtgagaattttccattcattgttgcattcatttattcataaacttattctgtgaaatgtctgttgactatcgactatatgctgtggatcatactagaaaggtgagagatgattgcctaaggaactaaggcagtaactgtggagatgagaaggaggagtttaaccaaagaaatgttaaggagataaaatttgcagattgttttcaccagtctgacatgtggtatgaggaagatgattctgacttggttgatttgaggaatggaagtgccattcactaatatatgggacaaagagtgaagggcacatattctggtgaatataatgggttcggatttgaacatgttgggctttttgagtcattcaggtggagattttaagtggtgggaacatagcagtgaacaaggcacagtctatttccaaccacgttagatcagcaaccagaactgtttctggcacatagataacactcaataaaatatttttgaatgaatggaatcatttacaaatctggagtttaatctaaatatgtaaccagatatttagctttgaaagcctctgtcagttttgtggtaattaaagcaataagtagaaaaaatgagatagtccaaagaatatatagagtgagtgagggcatagtggaggctagagactggggaacaccaacaccaagcagtggatgaaaaagtaagagccaatggaagaacctgggaaaagctttacagcaacccaaaggccgagggaaagcctgggagatcttattttcatgaaagcaaaggaagatgcatacggaaaaaaggttatggccagcagtttccaatgctgcagaaaggactagaaaagttaggtaagatttcattggatttcttatgaaggaggccactggtggcctttgctgctgcagcttcagtggagtgctaagagtcataaatatgattcaagtggactgaggagtggttaagacttgggaaaatggacccagtagtgtaggttagactccagattccttggaagagttcacacaagaccctcagggcatagactactatatagctactcccctctaatatgcactctaagccccacccttactgcactgctccaccctgtgtctcaccaccatgtgtttgctcatgctgttctcttggcttctccccacatcttgcacccttgctattaaactcctaatgtttcttcaaagtacagttcaaagatcacttcctcttgggcatatttccaaacagttcccttccctctgccaggatgagttaggtgccccttctttcaggttccatggcactctaccaatgtcattataatggtgcttcccccattgtactgtcatcgtgggctacttggtctgtctctcccacatgacagcaagcttccatacagtgaaatttctacttatttctaaatattaagtgcctaacaaggtgccttgtgtctagtagaccctccataaatgcatgcttaactgagtaagtaaataatttttcttataagccttccacagaggagcttcagggtgagccgaagctgaaagaactaccaagtcttttcagttttcttagacgtaagatactgacgattcatttaaaagaaaaaagatatgggactagaagtaggagattagtgctttgcttgtagctttgccactaattaattctgtaagtcatttcacacatctgggtctccaaatcttcatctgtgatatgggcacaatcgtgtctgtgatccgagatggtggaggatactgtagagagtctaaaatgctatcattaaagagaaagagtatttggaataagaagcaatctgatccttttatcatttcctttcctcttctctgagcttgagggttgcctcttaactagttgctttaacttaattcctaaatccccaaggtctctgtgctacatagtagccaaagttatctttctttctttctttttgttagtttgagatggagcctcactccgttgcccaggctggagtgcagtggtgtgatctcagctcactccaacctcagcttcccaagttcaagcgattttgctgcctcagcctcctgagtagctgggattacagacgtgcgccaccatacctggctaattgtttttgtatttttagtagagatggggtttcgctatgttggccaggctggtctcattctcctgacctcaagtggtctgcccacctcagcctcccaaagtgctgggattacaggcatgagccaccacacctggcccaaagtgatcttcctaaagacttaacagaacacatcactcctcctctgcttggaggaggatctgtttattgcttgtctctcccctcaaccccaattctttaaaggcaggggtttctgtcttattattatatcaccagcacccagaacactgcctgtcacataaaagatgctccatgcatacatactgattcatttactgacaccccagatctccaaaatacactattagttcccttgtggcagatggaattttactctgttggccattctatgtgtcagactcaattagacctaatgaattactttactacctacatatatattctattctgaattaagtttatgtctgtagagactgatgtttacatattctttttgctcctgcattcctttaaaaaatcactgatttctcttaagtctacagaggccttgtagaagttatactgctttatactgtgctgatatataaaatgtttcatactcttctaatcagtctttagaaatctaaacaatgctattgtacttgaagaccatattacaattagaaatgttgaaaagtgttacaatattagtactgggaatatgatagcctaaaaggaaagaaatgaaaagggtatttcaaaatgaaacgaaggactgatacaaaaaaacactataaacaagaaagatagccagcagccttctgaaaattgcttgcaaagaagtagcgccagttttaatttttaattgcaaatggctattttggcagatgaaaatgccagcagagcatgttttatcctagcccaatggtgtgaaactacttgaagcccaattgttgaacagtcacagctcatagttatctttaatatgtatgtgttttcattttaatttcctttttcttcagccatttatgagtgcgttatttgaagttttatttggttgcaacctgggagaaagattggccacacatctgcactttttttcataattaaagaaattctttgatggtctcagagtttcaggtgatcttttaatcctttgcaatcagtgtgtctgaagagtgagcttcccaaatgttattaaagtcatcaatttctaaacttaaaaatagcttgaagtttttcatcatatacatttgtgtattgtgcatatatatttcatactcatacaaatacacatgcaacataagcacatacatactgttatcttttagcagagaatttgtgttagtgtaaatatttctatttccctttgttttgatcctctaaaagtaaaaaacacttgaataaaatgcaatttagaaataaaaagaacattaaatttactcttgataatatagagcttatctcttaatttgaaagataattaaatttttacatgatgaagagatatacaccttttacaaactcagtcatagtggtcattgttctcatttattgtacctgtgaggtaattctagaatccctattccttcttcagtcagtggctggataatctaattataatgttataatccatcatttctctttttgaacagtcaatttagtttaacatttgcttaacagccattatgtatgccaggtaatgtgctagatgctggtggttcaaagaaaggaacgatgtggacctgacctcaaagaaatccattggagaatatgacagatttagatttaatgatcaactttacttttcctatacaggtaccagtttcttaatctataaaatatcagtaccagtttcttaatctataaaatagaaataaaatattacttcaaggtgttatatgtatagtatatgtgtacataatgtttaatatatacatattaacagttagcatggtggctctcgctgaaactagagggaaaaatagagacaatgtgctggaaggctgtatttatatgataaaggtctaggattttatcctatatgtgatgggcaatctttgaggaagataggatttaggcaaataataatgtcattggatttccattttagattggtgattctactagctctatcagtgatggcttgagggagacaaaactggaggtagaggataaattttaaaactgttgttccaacttaagcaagagataattaggacttagactggggcagtggtaggaaggatgggggaaaggtgtgacaatagagttgaaatgtattagtgaatgattgaatgtggaagattaagagatacagatttgttatttccagattattggattgggtgcttgggtaaatagtggtgctattaactgaaatcaatagaggtggaacaacaggttggcgaattgcaggggtgataaaatgagtttagctttggaaatgctgagcttttggtgcctgtgggaattccaactataaatgtacagcagctcttggatgatgatttaaaagacataaaatacagacaggagttataatcacgaggaaggcaaataaagataaagggtaggaggtcaaggatggaaatctggagaataccaacatttaattgataagcaaaggaaacaaggaatgaaatggagtagacaggaggctataaggaaacactagacaaaaagatggtcagggttgtggaaacaaagggtattgagagagtttcaaaaaaaaataaaagtaaccaattctgaaatgtagagagtggtttagtaagataaagatccatcagaaattaccattggatctggcaatgtggaattcttcagtgatgttataaactcatcagtgttaaccttcagtgaagcagtgagggcagaggcagattgctgttagctgagaaatgaatcagaagtgaggagaggaaacagcatatttaggccatatgttcacttagtttggcaagaataaaagggagattggacactagctacaaggaaatacaaggctaaaaggaaaatcaagagagaataaagttatagagaagaagtttttttatcacaaataatagtcattttaatgattatgtgctggacattgttctaaattctttatgcacattaattcttttattcctccgaataaccctaataagtaatattagtgttatcatcttcctttcagcaaaccagaataccaaagtagggggaggtttagtaacctgtccaaagtcagcttctgagttaatggcagaacagggctttgaaccaaggcaggttggctgagagccacacatgcttagccactatattttatttcctttactttgcctgttagagttttagattttttctttctttctttctttttttttttttttttgagacggagtctcactctattgcccaggctggagttcggtggcgcgatccccgctcactgcaagctccgcctcctgggttcacaccattctcccgcctcagcctcccaagtagcagggactacaggcgcccgcgaccacccctggctaattttgtttttgtatttttagtagagacggggtttcaccgtgttagccaggatggtctccatctcctgacctcgtgatccgcccgcctcagcctcccaaagtgctgggattacaggcgtgagccaccgcgcctggccagtttttttttctttttttaaaaaatcaacttttattttagagacgggggtacttgtgcaggtttgttacatgggtatattgcatccaggtagtgagcatagtacccaattgttagtttttcaacccatggctcttctcttcctcccgcttctagtagtcccaagtgtatattgttcccatgtttacatctttatgtgcttagtatttatcttcacacttctaagtgagaatatgtggtacttggttttcttttcttacattaattcacttaggattatcgcttccagctacatccatgttgcggcaaaggacatgatttcattcttttttatggctgcatagaattctatggtgtatatgtaccattttttttttttatccaaaccaccattgatgggcacctaggttgattccatgtccttgctattgtgagtagcatggcaatgaacatatgagtgtgtgtgtctttttggtatgatgatctatttcctttgggtatatacccagtaatgggattgctgggtgaaatggtagttctgttttaatttatttgagaaatctccaaattgctttccacagtgactcaactaatttacattcccactaacagtgtataggtggtcccttttctctgcagtctcaccagcatctgttgttttttggctttttaataataatcattctgatggtatgaggtggtatctcattgtggttttgatttgaacttctctgaggattagtgatgatgagcattttttcatatgcttgggggccactcgtatgtcttcttttgagaagtgtctgttcatgttctttgcccactttttaatggggttgttttttgcttgttgatttgtttaagttcatagacttcggatattagagctttgtcagatgcatagattgtgaatattttctcccattttgtaagttgtctgtttataaatcggagacgacacaaataaatggaaaaacattccatgctcatggattggaagaatcaatattgttaacatggccacactgcccaaagcaatttacagattcaatgttattcctgtcaaactacaatgccattcttcacagaattagataaaactattctaacattcatatggaaccaaaaaagaacccgaatagccaaagcaatcctaagcaaaaagaacaaagctggaggcatcactatctgacttcaaactataaggctataccaaacaaaacagtgtggtactcatacaaaaacagacacatagatcaatggaacagaatagaaaattcagaaataaagtggcacacttacgatctgatcttcaataaggccaacaaaaacaagtaatggggagagggctccccagttcaataaatggtgctgggataactggctagccatatgcagaagaattaaactggacccctacctttcaccatatacaaaaattatctcaagatggattaaagatttaaatataagacctcaaactagaaaaatcctagaagagaacctaagaaatagttttctcaacatcagccttggcaaagaatttttgactaagtccccaaaagcaactgaagcaaaaccaagaattgacaagtgggacctaattaaactaaagagcttaggctgctataatcttgattgtggatggtacgtgtgggcccagggctcctcatatcagatgggtagagtaattataaaaactactttggggtctagtatagctctcagcaaaatagtgtatgcacaataaatgtttgttgaataaatgaattatagttaaaatgccttattacctagaatcaaggaattacttttaactttgtactaagcatgtttgtttctctgccttcacattctaaccagcttaagttctaatttttctttaaatatttttctgacgtgctagcttattttcttatcattatgcacctcccatagcctttattatttggattatgtattttattccttaattacattattacattgtattctaatttggtttttatctaattctttgcaaatagtttgtgtatgtaaagaaaccaaagtaccctctttttttgtatcctatatagggcattatgcccaggttttcattcttttggttttgtttgtttgcttttgtttgtttgtttgttttagagacagagagtcactctgttgcccaggctggagtgcagtggtgtgatttcggctcactgcaacctccacctcccaggttcaagcaattctcctgcctcagcctcccgagtagctgggattataggctcccgccaccacgcctggctaatatttttgtatttttagtagagatggggttttgttatgttgaccaggctggtctcgaactcctgacctcaggtgatccacctgcctcagcctcccaaagtgctgggattacaggcgtgagccactgcgcccggccttcattctttatttttaatcaaaattcacctagcttattaccactagtggaactatttgaatgttttaactttatatttccaaacaggaatttccttaaattctactagttcgtattgcgtagcaacttatattgattatctgaataataatttgttcccctcacccttttttttttttttgagacagagtctctgtcacccaggctagagtgcagttgtacaatcacagctcactgcagcctccatcacccacactcaagcaattctcccacctcagcctcttgagtagctgagaccacaggcacagaccaccatgcccagctaattttttttttattatttgtagagacagggtctcactatgttgctcaggctggttttgaactcctgggctcaagcaatcctcccgccttggcctcacaaagtgctgggattataggaatgagctgctgtgcttggccctgaataataatttcttaatgtaatttcctataaacattaaattcccaatttatacagtcatcatggaatacctaagattcactacaaaatagcatcattgctttgtttaagtctcataatggctgaatatagaacatgtttactccaaactgattttttgatttttttcttctctttaaaataataaatactcattttctttacactagtgtgaatacatttcattcagcttccatgcttttctctctccccttccacatttacattttccctggatgtttcttactttccctttccccttggtcttattgtatttttcttccagttaaattgctcctagttttttttttttttttttttttttcctttctctctgtgcttctacctttctggaatggtgtttctccccatttctttgtacaaaatgttgctttcttttcctctgaaagctgtctgttcttaagagatgcattgaatttctaattacatgctctaagagtgtactgcctacgtagactgggtacctaatttacatattgctctatggtaattaatagagacttctagaaaatgtggattttagaaatataaggggagaaccctatttttcttagggttttagttatgctcaaatttcttagaaaataaggagtgaagccttaaaatcgctgaagttttctaatatctatatattatttctgaaatttgggaatagtcagatattcagtgaataattttaaaagtttttaccttctgttttggaagttgactactttgaaagttgactatatactttggaagtatatagttaagaaataaattagaaattagtttttatgccatgtggaattattatataaaaatgcacaataaagaagtccaaatatatttgtaacatagttaaatatcagttaaaaatatttaccccagtggctgttataatcattaggagtttctttactcagtgagccaagaatagatctataatctggcatcacagagctgtactttttctgttttattgagaggttaaagcatggtctcaaaatgcaaatgtatcataggagtacataggagatagaaaaccacctgcatttttttctggttgaaaatgtttccaaagcatagaccttgtgaaagcgattctcataaccttttctagaatgaaaaacaagtttaaggcttctatttctctaaacctgttttctctcacacctgaatgaatctaggaggattgaatggagttgagaatttagattcttctccccgtgttttgagtcattggctacatttctcagctttctggtttgtaaaattaggatataattcttcaatgtttgtttaataacctgacctcttgctaagtgtaagaccctagagtaggaactatagggcttaacataaataagacatagcatattccctcaagaaattttcatctagaaagatattcatttactgtttactgagcctcaaaaaccatctctctgaattgacttaggataaaagcaaagtttggcctttctccagtggcatttagctattgctccttttgaagggatttacaaggtaaactccaggatcaccatgtacagaactgctgattgccagttctcttgaccccttgggaaactttggagctcggcgttcagctgcctgtgcaagtgggcgttctgctcagggcattcccacactgagaccaacacaggagttcccactcatcatagtaatttctaaacagtagtaattaaactagttaaactaaatgttctagttaataaaacattctgagtatgtttaatttgctccaaagtattttaaaaaataagaaagaaaccaatgctgtttcataatactttgtttggagatgttatttttttctccctaaatgggttaagaacaacagtataaaccaaaagttgtgtttttttttaacaaaatgaagtgtctgtttattttcagtatacactttaagcttctaatattgttcacttaattctattacatgaaaggaaaatattatacctagccttccaagaacacaatatgcagtggacactcaaatattgaatgagtgagtgcccactgcatattgtgttattggaacactttggaaacacttcttccatttgttcaactttctccagtcatgtggaaaatggcttttttcttcaactaagagtggtacttcccagtgcagctaaggtcaaaaagtgttagaaatgtgtgttcattgcaatctctaaagtgctttttatccatcttttaaagactacatacttcaaatggatttcagacctagatcagcagtcagattaaagaattgcaaagtgagattaaactagttttaaatttatcatgcctgatgataaaattctatagttctgttttggtatgtcaaatggaaaaggcagagaaattgattggcaatccaaatgacatttgggaactcacttagaaccttcaagataggatcctgaacccaaggagcacctactcttattcatctagtccttgacatagaagaaattacagtttgttttggggaaacagttttaacaagctcgaacattcaaatttgccttcaagtatttttctctagaagaaacccgggtaagttcccttagcttcagatccatcaaggaataaacaaaatgagatgggttaggatcttcccaaacgaagcagctaccctagttatgtaggtcctactttagttgtgcactgagatcgtcctgcaatccttccaaaggtaggacaggaagcataataggaaagaaaactatgtagtcatcatatttgtgccaatcgtgtggactcctatacagtagttcaggctaccagtttggttgggccatgcttcagtagcccattattcctttcactcagtagaatggctccagttattcctctgaaattggaagttagagtttcacagtatctctagcaggaaagattgccttacatggttccagatcttttacatctagtattggacttgatgagctactttacaattacatttcctaaactagttgggtcatgctgctgagagctgttttccagagctagtgggtatggagttttcttccaggcttcagggcaggaagtggataataaaaatacatttatagatggcgctaagtgaggtagcctagacaaccataaataagaataatcaaaccatcacgttgtactggagaagacagaatattcctctaattgaagggtagctatcataatttaaaattgtcatcatgaaggattgtactttttttctccaaaacaggttaaaggcaaatacctattttttttttggtttcttgttgattcaaattccctttccacactgcaatcttagtatagatttctggagcacatgataatatatttaaaagagctattcacaataaatctgttatgtttttgtacttgtttcaagggtgacatgtaaagttagtggttgctctacagtaagcatctggtagtggagcggcagtgcagcatgacaaggacctggactgcagtgtcagccctgggaatgtgcagaaacggagaataggagaaaattcaaagggaggactggagttcttagctctccattggcttctggttggcaaaagagatgaaagaatcaaaatgttcttggttccaagcaagtgtgactgtgaccacgcagaagttactcaattctgttttaggtaaagaacaagcacaagtagacatgtggcctgtttgggctttgggaaagacaggggatcatcagttaccaatgtagagtgatggagaagaaataaggtccttggagaagagtgtatggaaaaagatttagggaatactggcatcttgggaaatgagaagagaaagatttgcaaaagggacaaagaagagaaaaactaggaaaatacaacatccacaggaagactgtctctcaaaggattgcaatgggataaaagtattacaaagaaaagaagtgaaaatgtgtgatgatgtagaaagccaggatagaaggcgaggggccagaacctagaagaaaactttgccatctaggagtggacagcatgtgcagtgccatgtgttaggaggacatccaatttcacaggaaacatgatgtcctggaaaaaaaggccagaacaacccagcaactaggtggtgtgcagacatagcaatcagtttttcaaaagggaccatgcagggtgaggggtgtccctgaaagtatcactgtataactaggatggggactccagaagagagggtgatatttagagagcctcgaatgaaaccagggatatctggttggaaagcaatcttgcagtctctaagagagatgctgataagtgcaaagcagttctaaagagcttgagataatgcaccaaacggtgcttgcaggggagaagggagacagattagggtgcataattgataaataaatgggtaaagagagagggagaatggtagattaggaatcaacaaagtaaagctaaacttttatttctccaagcagctggaggtctgtacaaataaaaaagcctcaggaacccccttccctgagaagtggaaagattaaagtaattgagaataacaagatcctggagttatggtaaataaaagtttaggttggttaaaaaaaaagtttggaatggcaacattgggagctatgataaggcaacattaagagataaataacgcgatgtcttgacaactgcaaaggccctgatagagttcaggcatgatcacgtagaaggctacctggtgtgtgagattgtgagaatttctctaacagtagtgtgcagggtaaattttaaaaagcagatggagccctaacccaaggctggcaactttgtagccaaagtaaagggaatgagaaattttctagaagtcacacacactgaacatgtgtgaccttgaccttgggcaaatcgtaaacccctccaagcaccaaccatctgataaatgtggaaataaggagacaaagtgttaaagctccttatataattgctgggcaaaaaaaaaaaaagtaatttttatactttgtaaccatatatagtctatagcctcttcagaggaggaaatgctgcaataatagacacatgtgaaaaaacatgtgttcaacgaataaataagtgaataagtgaattagcataacacttatttaacaacaacattgtatttggtgccaagattatagagccagatatttcctgttgtgtgtacaagttctgtgagcttgaacaaaaagatttttcttcagaaatcaagccatattttataatctctttatttttgagtgtatagataaaaacacactcttaaagcaggaactactgctttgacacatttaagtaataggattagagagctggaaggacctttggtgaccaactctagtgctatcttttttagatgggaaaacagcctgcaaaaatgttaagtagcttcctcaggatcaagtactattggagccagcattggtggtcaatcctgtatagaaatgacttcagttgtagatctgtgaccttccttacttaccttcctctaccaaaggtactctataattcttaataaatgaatattgacattcattttaaatactattgtttgttcaactgttccatgaagaatattctttaaataagcattgtagtgctaacagggaaaatatttttcccttttataaacttctaatagctggcaaaagatagtaatttccatgacttttctttcttctaaggaagttaaattctgaagacggtgtttttcttggagttaaaccatatattgacttgttctttaaaggatctaataagtgaatagatcaagtaagaaacaaattagtatttagcccattcagttgcagcactgtggtttctttccagatatgaaaatgtgagaaatatttcctgaaatcaagcaagtgggagtgggaaagagtatgtataaatgttacatgaggaatccaaaatcatcatcagcatcacacacacacacaaaaatacatttattatttcacacacaatttcattacacttggtaaattcattagggcaaggcaaatgtattcatccagacattcaaataagcagaaacatctgtgcagtctttaaatctgccatgttaaacaggcctaccactctgtttatatgccccaaagagcctgaaccaagacagacgtaagtaggagcagctggatttgaccctaactcttgaaaatcctgccctgcttgagaggtaaggcatatcttcagctttgcaagcacactattttgtgtgtgtgtgtgtgagagagagaaaatggttaaaattaatgtgaatttggttctccctcctcatatttgtctatattaatatactttttaattgttaatattatcattagaaaggtgatggtttcatgaatgaattatgaaggagaaaagaattttggtatctaaaattgttggccaataattgaccattttctgcctgggtcatgtacgtgcactgagaggttgaagtgtactgtgtgtgcttcttcaggcatttcctatttatctgagacacttttgagacagagaggtgactggagaaaatgaagggttctcctttatttttatgaacaattctctacgcctcattactctcacaatttttgaatatctacaatcttttctctcagttttcttaacctccacgctgatggtcctgattcagagctacttcgtttattacccaaacacagcttggggaagggaagggggatgtaaggcagtagaggcttaattccccttgttattatacatggctattgctatttgtcctagggaagagggttagcttggccctactagataaagagcgtgttaaaaaggcctcccaaatttacaagtgaaaaacaaacattttgcgagtaaaaaacaaacacacatatcctttgcccattaaacattttgttttgttttttaaaatgagcaagggatatgaacagacacttttctttttaaattcttatttatttatttatcaacttttattttaagttctggggtacatgtgcaggatgtgcaggtttgttacataggtaaacgtgtgccacagtggtttgctgcacagatcaaccctatcacccaggcattaagtccagcaaacagatacttttcaaaagaaaatatatatgtggccaacaaacatatgaaaaaaatgctaaatgtcactgatcattagagaaatgcaaatcaaaaccacaatgagataccatctcacaccagtcagaatggctattgttaaaatgtctaaaaataacagatgctggcaatgttgtggagaaaagggaactctcataacctgttggtgggagtgtaaattagtgcaatcattgtggaaagcagtatgatgatttctcaaagaactaaacatagagctgccattcaacccagaaatcccattactggatatgtacccaaaggaatataaatggttctgccataaagacacatgtacacgtatgttcattgtaacactattgacaatagcaaagacatggagtcaaactaaatgcccatcagtggtagactggataaagaaaatgtggtacatgtattctatggactactacacagacataaaaaagaatgagcttatatcctttgcaggaacatggatggacctggaggccatcaaccttagcaaactaacacaataatagaaaaccaaatattgcatgttctcacttataagtgggagctaaatgatgaaaacacgtggatgcaaagaagggaacaacagacactggagtctacttgagggtggaagttgggaggagggagaggaacagaaaaaataactattgggtcctaggcttagtacctgggtaacaaaataaatctgtacaacaaacccctgtgacaagagtttacctaaataacaaacctgcacatgtacccctgaacttaaaagttattttaaaaaaggcctcctttggtcatggagatttgtacacaaacacagagcattttccattgatcctcagttaaaggcaccctgcagttatttaaccctgacttcacataccaaaggaagtctaattatttgatgtgtgctaaacatcctcagtgtggtgctgctgttcagccacattaaattcacaggacaagtctgcaccctatgtagtacagattgagtatccttaatccaaaagtctgaaatccaaaatactccaaaatatgtaactttttgagtgctggcatgattctcaaaggaaatgctcatcggagcatttcagattttggattttggattagggatgctcaaacagtaagtgtctgcaaatatttcaaattttcaaaaaaaacctggagaggccaaaacacttctggtcacaagcatttcagataagggatactcaaacctatcaatctgttaaactttttgatgtctcctaaagacagccacagctgttatgtatttgtcacagaaaccagaattttctttaatttagagatttctttaatttagatagtttgcaaagatgtaagcataagaatgttccctgaaacattgttttctaattttaaaagtctagaaaaaacataaaactatgttattagcatctagttaaatcaatgatggcaaaactgtccaagggaatactgcatcctttgaaaagaatgaggtggatatgtatgacatggtatagcatgatttctaaaatgaaaaaaaaacacacaaggtataaaccagtatgtacagcacataacaggtatacactttgtaaattaaaaaatacacacatagtaggttgttctcattctgttccataaggtcactgcaaatactgaattagcaaataccgactcattgctcctagtggaaatacagggttaggtcctatgagcctttggtcataacattttcatcaatggatcaatacataaccttattttatgtgtgtttctgtttaaagatacattatttaatatatattgttgattcattaacactgaactcacagtttgtaagtcatacctgaatgttgtttatcttacacatattttctccgtaaggcacatcacagccttcctgtgcttaggaatgctagatcacccttcagtctggttcagtgttagctgggaacatatgtgagaggagaggttcaaatttttggctggtctgcacatgtctgcaaatgacctcaaaagtgctgtattaacttagaggttacaaatcaattttgagtagataaattctcaaatatgaaatccacaaataatgaggatcagcaatacatagacagcatgtatgcatgtatataaatggaaagtttctggaaggattaaactactagatgaaagttatctttagcgaatagggctgtggggaaggaatgagacaaggtgcaccttttatcataaccctctttgccctacatgacttttttactgtgtgcatcccgtagtccttcttattctctgtctcctccttttctcccaccatcactatcatcgtcattctctcagcaagccagtgcattttctgaagaactctagggacaaggttttatttgagccaaattgctcatagtgaatattctctgaatcaggctcctggaaaagttggtctacataattttgcaaattaggagtattttacaaatgctaagtatgacacttagaacatgagttctcagggtaatttgtgtcacataatattaccccatatcccagcatgctgggatggcctggactttgggtaccttttgtctgtcaaatactcttacttaggggtcatgcacagtggctcatgcctgtaatcttagcactgtgagaggctgaggtgagtggattgtgttggagcctggattttaagatcaatctgggctatatagtgagaccttgtcaccaaaaaaaaacaaaaaaaaacaaaaaaaacatagtagctgcgtatggtgggtgcatgccctagtcctagctacttgggaggctgtggagggaggatcacctgagctcaggagtttgcagctgcagtgaacaatgatgatgccactgcactccagcctgggtgatacagcaagaccttgtctcaaggaaaaaaaaaaaacacacatacacacaaaacaaatcaataaaaaaccccaccaaatactcttacttacattcttattgcaggttgccagaatggaagtttaataagtaggaaatgaataatattaataatataacaataagtattaagtcagcatatgacatatggtatggaaattctcttcaggttgaattcccgtttttagtctacctgcatctccctcatagaaaggagaggaagggaagaggtagtgagtctctgggtttggtcctcactggctttgcgctgggcccactcagagttcttggatctcaccttcctcaggatgtccagactcaagagcattcagttgtggtttgtccttatcatgcttggcttcttgaatgagtttgaaatcttgctatttttaacttgtaatttagaagattggaaaaggttttaatttttgtttgtttctttctttgcatatgtcatggtgagtcctttaatgaaagaaaagcctgaagagaatgtaactacttacctccctgaaaggcattttttcttaatgaatgtagagatttccacttccccccaggtacttcatgtgatgtactgtgcccctagttaattgcaagctgaagccaagctgactgacagtaaatcaagaaaatgatgtataaggcatgcccaattatagatggaatacattcatattaatggtatcccatggactatcaccctatgtccattgttaatctgtaatctgaaataattcaaatctctgtataattgggtttctgacagcaggatcccatccatcatactacatcttctcaaatattgagaatattgtcttttaaatatgtttgtatacatatacacatatatatatacatatataatgaaactgtgaaaaatacatcttcatttgataaaaaaaagtcaacaggcttataaagaataactttagcagcaaatgatgagtttattttaaaaataaattttgtaaatgtatggacctctaaaaataaaaatactaaaatttcttatatgtttattttccttaccaaatatgacagttatccacaagtggaacagattgtagttattgctgatcttatgtctgaaaaaccacatggatttgggggaaaaaaaagcatatggttatctattggtctacatagtttactgttgcatgggtagacagaagctttcagtaaaactaaagggaccttttctgatcaaaccctgtgtatggctgatatatgttctgccaatccagccttgtttgagtttaagggtgccttctggcctggggtcaatttctctgtgattggtttaatgtcatttgcccataagcatacattgcagggtgctgcccaagggcaagtgcacagcttaggtacatcatctcatttacaaatcaccatccggccatgtctatgagcactgagatatgaatcatcattatttatacactttagtcatatttgaagttcttcttactaaccctataaaactctcaaatgaattagaatcctcaaattcacataactatcctatccatttcctgtaggcagagccatatgcaaaactaacccattattgagaggtgcttggtaaacataggcacagaacagactctaatcacgtcttgtaaatctggggtccattataaataataaataaagttttattgaaacaccattatgcatattcattcatttactgtctgtgactattcttacattacaacaatagagttgagtggtaacaacagtgatctacagctgaaaaagctgaaaatgtttactatctggcctaggccagaaaactatactttctatcatgtgtccttgccgtgtaggcaggtgacttatggagaaatgggatgaaaaaaatggacatggtgagtcaatcatcagtagagttgaattgaaagaatgccattagttggagtcagagtcatggcaagagagagagagtgtaaggtaaagttgtgaggaagaagaaaccatgcattaagaagagaaacctggtcaggagacagaaggctgtacaacaacccagaaaaaacaaaacaaaacaaaacgaaaaaaaaagaaaaaaaaaaagagatgccataagatgagagaaagaaagagagaggcagagacagagactgagagactgatcatctggcatatggccctgaggcagagattagcttgttcctcaacttccctaggtttctgatagctgttcagttcacagacacatgcatgtaatgcccctgacctccaggacccccatctatggacagcaaggagctctttttgcaatcaaaagagagggaccaaaacagatcattatgtattgcgccataatgaggcaaatttatttctcttatttgtaagttcctatgggaatgactcccccattagatcacagtattgacgataagcatgaataagctaatttgggtagaaaagtcacttcatgtagtagaatgtaatgttgactgttaagatatctcatacatcatgaaattaaataagatttcccttttatttcatttgttcagccactcagtaaatattgaagacctattaagtataaagaagtgcaagacagcttgatggattagaacatgtatgtaacaaacccactcccagggaacatgtacaatcttgtatgaaagttgagacagatacactgatgactaccacacagagaaacctatggtaattaagtttgataattatttatagcagtcacattatgtactaaaacataaagaacataaggccattcaccatggctattgagatggatgaggctgagcctttgacgttggaagaacagtagcactgtacacaagaactgaggatcacttcttgccatcaagaccagggaagccatcatggaacatcgtgcagtgggcacaagagatagaatgcccattgcaacatcattggtaatagaaaaaaatgaaaatgtccataaggataataatgagtaaataactggcagtgtcattgtataggaaaataccatacagtaattgaaaggaatgaattagagctacatgaatctatattgatatatctaaagcctaatgttgagccaaaaataaaggtgcaaaaacatttttatagtgtgagacgaactatgcaatattttaaaacatggcaaccaatacttttatattacttagaccagcatacatatgttgtatagatttttttttaatgtttagacttggtagatactaggatagcttttaaatatggagggggaaaaagagaggaaaatgatattaaggaggcatatgcaggagtttctactgtatgtgaatatttaaatttttttaaaacctaagcctgcagaaatatagcaaaatgggagatgaatacatgggccttcattttttttttttttttaattctcagaggtcttctgtttgaaatatctcagaagaaaaaaaaagaaaagcctacgtgtgtttatgtggagacacattccaaagaagggacatgtggctggttatactcaaggtggttatgttcagttaatctaccaaactggatgatacgggtcaggacccagttttagttcagagatcctcagttttattgtgtgcttagtcgtattactcaaatgagtgaaattagcttttgatagagtcagggtaccacttcatgtgaccaaacaaatgcacgaagcctggagatggctgtgtttgagcacaggctttgtcctgctcgcagatgtgcaactgtgcatctatggacagcagtagagggcttctaagaacactggtggcaaatatgtcaggagtccctggccaatactgttgatgcgaagctaaggttctaaacagttttggatcacagcctctttcagaatctctacgtattttaaaaacctgtgaagcatgtccttaaacagacatgcacgtgtatgtgcacatatgcatgattacataaatttccacaagttcataaaccaaggggtttaagaaccttagttaggaaactcgtgtataggcacattaccttagataaatttggtcaaatcctccagtgaagataactaatggtgcagtttctgtgaaaacacacaggactctgaaaatggagctacggacccagtaaagagtttgtacaactcagtgagacttcctaaattcattgatttacatactctactaaccaccatcaatcttggcacacaaatgaccagaatatacagaatctatctttgctttatttgttttgtaatggttcttgaatgcttctttaaagaataaaactactggacatagaaaattcttcagcttgtacaatcatttaggatggtgtaattcagatgaagcattacacgtgaaaaggaaactcagtcagatgacaagcaaattcttggcatccaaccctgaccaccaatgcagaatatgactaaggaataacatttttagtaaaaggtcacagacaacatgaacttaacacattttattcacctggtggcaaatagaaatgaaatcccagaagcttggttccttgaataaatattgcagcaactgacacatccaaatatatttaatacaaacagtctctcattgcaagtgctatgttttttctgaccattacatatttttactcattatttacacagctaatgactgttttataatgttaaactcaaccttccatttttctgaaattatgtttatatagttattggtttgatggaataattaaaatgcacttatgtgagatataaactaagtttccttttcctgtcttgtttcttataatttaatctgtattaggtcattcaactagtaattgttattctaataatttcccctattttcttttctttgaactggctgactagctaaagtgtataaaaacagtgactcatagacatgcattttgaagtaaccaatataaataggtacattctggttatatcacattttagacaactgcttagtcaaatgaaatgcaaaaagaaaaacggaaagaaaactatttcaaataccttgaaatgtgtgcttcaagctgactttcagaataggtgcacatttatatagctatgtaaaaaagaaggggaaaaacacagaaattccaaaatattttcaaactggcttagacatcttgacactttactgttttcctctgccaggagagtaaatgagtggtttgccctctggggaaaaatccatttaaaagcgaaactattttaaatgcatacctttttacaagaaagaaaagaatagttcttagtagtgggggagtgggtaggatatatgtatatggaagggcacagtgaaatgtattagtatagggtcttgtttacttgtaagtattttcttcctttttgtcattcctcacacatttacatggttagcactggtgatacaaagaagaaagaaatattcctagccttcacgtggttttagtctaaagggagaacactcaggaaaaacagtgtgcatcaacctagagatgccatgagaatgaaatgtgcagtaactaatccatggaggagaggatggtcagagggggtcgtgtttaaattgggtcgattaaggttgcaaagggtcagcctattttaagagggcaggtgggaaggaataggaacagaggccaaatgcaggagataatattttgtaaactgttttgtaaatgataaattgtaccttctgtgtggaggtaaagtatgaggggagatttctgccttcttcctatcttgttcttatatatttgttcatatatttaacatagctacccccttatggtattataattacctgattaccttttaatctcatctgtgaagtccctaagtgtaggagcagtactttatccatctcttttccctagtgcctaacaggtccagacagctggtagatacaaaatgaagactcttttagttgaactgagtgaatgaaaggatggacagatggatgcatagatagatactctgtaattacaaagaaatgtacttgggctatgactccttcagtggaaaaaacaacatagcagaaaaaatgcaatacatggggtgtggtagaattgtaaaaatatttttactagaaatactcttggactttatgacaaattagaaattatttccttctatgcctggcccttccaaaatttcacattcatgcatacactagtatacttgttaaattgttggacaaaaatctccttcgatttagaagtctattatttcgttgagatgacagtttttaactagtaatgaaagttttccaatgaaaacactctaattttgcaatgtgtacctcaattttgtgaaaataaacggctgagtatactggaacaatcttaattctgttgaactccttaaaatgatattacatatcaaagagtacacctttaaactactaatggaggaaaatagaataactcaaggagagcaagcagacagctggaatttttgggaaatgtctgtggtatttgggtttatttttaagggaaagaaaaatttcccattaaattttataacacaataacacttttaaaacttatactcaaaaagaatctttataatgctgttgtaaaactcagattatattttattcatgaattacagatttcttttttgatgacggtggttagggtaagaagcggcttttataagctttatttatctcttttaattacctccttctcctgtctcaatgctcacacttacactcactttaaaaaatttttatctttcatgggatctatatctaaataacaccacatcatatgtaaattaagaaacattccaaatattctccgggacattgaaaggaaatcaagcaaaacattctgtaatgtgtaggcaactttaaaagtgcttgaggcagaagcaaaaaaaaaaaaaaaaagtgagagaaagaggctttctagcctgtgtcttttttagttagatgtttcagaagatgaagaaattttaattatgtgcttccttagagtgagatattaattcctctgaatcattctctccaattttgagtcccactctcatttttctctccctcttcttttctcctggtttttccccctccctctttaccttttctcctccctctttttcctccctcccctttccttctcccacaaaaagccagaattgcttggtggtaattccctagaattgagcaggattgaactgggggtcactctggctttgtactgttccctttcttatctaacctgaatatccttggatctgtaagactttttctgatccatatcacagcctttttctctcctcaccgttgccagtgggatttctcgtgggcttttggagaggtagaaggcatacttgtgaatgtcaaaagagctgtattcctgtatcctgtttcaaccctgaggagaggcactgtgctagtgaggaaagaacacccaatcctagtcaaaggactgagttcaattcagcctcacaagaggctctaagtatgatcttagacaaggaaacttcaggccccagttttcccatctagaaaatgagagtggttagaactatatcacactgaggattatgtgaatttatatatacgtatataaagccgtgcacccaaatgctgtttacagcattctgtgatgaattccctatttcagttggtaccatttattcacagacaatcacaggtattcagagattgtaagaattatggtagcaattgcttactatagtttgtttattccataagagtggctttcatttttttttaaaaaagagacctctcccttggattttcgttataatatgtttcacttgccacattttctgaatttttccatgtcttgaagcctttgtgatggtgtttcataatcaacctgcaggttgtcagaatcagtggagcatgccatttactgcttgtcttagatacactcaatgattctttctttcctgagtgcttcaagttttggctttaaagatcctcctttgttttaatagattttccattagtgtctgcttatgtaattttatctccatttctaattgtgaaatttgttgcatagatgtaaattttctttcagtattattcagagagaagataatggttgatacccaaaagaggaagctaaaaatgccttttaaaattcttactatattttggtgatttttaccaatgacattattgtatagttgtggtcattataccgttcattaaaaatatttatttgaaattactgcatgaatgccaatctctgaataacatctttgcaaatatagcatgttattttgtcagtccaaatgtgtgctaaatactaattcatgttgttaaatgtggatataaaaatagttaattctcttgctaaggatactcatttatcaaagtaaagtaacattttaatatttttcaagacaactatttttaaatatttattagagaaactgttctaggagaaaaattaagataaggtattatgtattttactctgttatggacacatacatatttggatatcagatagtttcatatcaaattacatatctttgtactcaataaatattagaaaaactgtttactcatctgtaaaatataaataatagcatcttctcattgagttactttgaaaataaataaaaataatacctatgtacaggacttaacctagtgtctaccataatgtaagcacataatgaatacttgatactgtgattgagtacatgctatgactataacccagaataagacaataggaacataaaaatagaaatgatcatcattttagataggggaaaacagaagggaaatacagagaaatgacatcattgtgtttgagaccatatggtatcagaattggaatagaaggaaactggagttgggggagggaactggaagagtgttgggggtttgggaatgaagaggtgatactaagttgtgtttgggaatatattggatttaaagtgatagaaagtaattgtagtgaagatggactgtagtcatctcatgaattggaccagaactttaacattgttcatttagttttccaagagatatttactgtgggccgatactatgtgctagatactgtgcattggtacagtaaccaaggtacagtaaaccaaggatggaaatacataaatttgtgagtcggttttctgagtgaaagttagaaataaggaacaatgtactaggcatgaagtgttggttagtgattacaaataggagaggagaaaagaaaagtccccaatgacacaagactagaggctgaagacatatcaagagagtgctgcacgaggggagaagacaactttaagacattgtgatttccagaagaatcacttttatataaattgaatgctttctagagcttaagatcattcttatatgtttcagtaacagaaaatgaagataaagatagattattcttggctttttacctatttacacatgaaaatgattacatacatctacttattctagtgtgatattattttcattaaaataaaggtattgaaggaattgttcaatgaacaaagaaaactgtacttttgactaaattgtaattaagtatgcttgaacatttttaaatgcttagttctgtaattttctgcacaacatgtagtaaaccagacatatttccaataaacactgcttaccttctttttgtttccatgtttaatagccaaggtctgtctgtctttctttctttctttctttctttctttctttctttctttctttctttctttctttctttctttctttctgtttttctttctttctctcagaaaagaaaaaacaagccttggattcttgtttcagtagctatgtgcaaacaaaatggaaaaaaaaaaaacagagaaaaatcctccacaataaatcgtaatggacatataatctgtataacacaaaacttagtcaccaaaggatacttgaaatgctgctagatcagttcaaatcagcaaatatgtattgacttcccattttttagcactatgttaggtgctacagaccacaagctcacagtcttcaaattaaggagacagttatataaatgatataaaggagaatctgtccatcacagtgagacatccaaatggctatgaagattccaaggagagacagagcatctggttgagagagagcaagaagaaattcctagagaaagtggaattagagaggaacggggagtaagaaatgagagtaatgccaggctccggatgaggaacaacatgggcaaagacatggagacaagcttggtgtgtggtgttcctaggaaattattgtcctgttgactgaagaaaaagggacataaaagtggaagactgataggagatttggatagagaggaatatgtcgggacatactgtgagtgctatcatgaggaaattcggattgattcaataggcaatgaagagccattaatggattttgagtaggggaataacattactggagcagcaatttagaagactgatttgacaccaatgcatagtatattctggaatgaagacaaatggcaattggagaaactggctgggaacttattgttatagtttagcagttaatgaaagtctgaaccagcatggaatgaaaatgaaagaatctatatatgggtcttccaagatgcagatattcaggaacattccatacatccaaagtttacatctgtatagtattttaaatttccatttgccctcagatatttggcacagatctgagagtaaccttattggcacaggtgattctcagctgcagagtaccacttttgtctgtattaatggtgtcttctcttctttacaaggccaccaaagtggatgcataattaaaatttgttgctgtttctactctacttgtcctggacgctcatgcagccaaatttcactggggacccaggaccacacaaaacagtatggtgttatgaactggttgccccaggagttttagaaagtcttcttaattactttaaaaaggcagcagctctcctcacccactgtaacttgaacgttgcatgtttggcctctaggatcagtcctcaaatgcatctctacctagtattccatcaggagcaattggtatatttgaaaatgtattgctttatttaattttcatgaagctcagtttcccacatagtaaagacaataatctctgagcaaaaataatttcagttattcttatcacattgtctattcatctattatatctttgcaatattaaaatgcatttaattataataaaacatttaacacaagtaactggaaaacaaaaatctttctcaactgattattcttagtcttgcttttatctcccttttacctaataaaagcaaatttagttttcttcatttatgaatccaataaacatcatagactcaacttcctgatatttatgctctatgagggtttctccaccacacaaatttatgtccactgagagcatcttatctctggctctgacacttttggcctggaactaatcactgccattgaccattgcatctgggatgcattagactctgtccctaggtgcttcaagattttattgtacaacaccatttaacaaattattttattaataacccaaaccctgtgaatcaaggtacattttaaagcctaataaaattatggtttgggaggccaaggtgggaggatcacttgaagccaggagtttgagaccaatctgagcagcacagtgagactccatctctgcaaaaataaaaaatagaaaacattagttgggcgtggtggtgaatgtctatagtcgtagctactcaagagattgaggcaagaggatagtttgagcccaggagcttgaggttatggtgaattatgattgcaccactgcactccagcctgaatggcagagcaagaccctgcctctaaaactaaaataaatggaaataaaataagatagaaaataaaattaaaatgatggcatgggagaccactcacatttcacaaatttgttttagcctctacacaaatactagtaattaaatcatattttttaaattgtaagatttagaaatgtggatatgattttccatatgtaagagaatcacaattttttctcatcctctataaaaattcatcccctgattaattcacccagttgacaaatagatactttttcaatgaaatatatttaagtattatagtgcactttctcagaccgcaagaggttatttattttacttctgaaggttttgaagtttgcctcatagactgtaagtgcctaaggaaagaaacagggtcttgttcacctgcagtggttcctgggagatgctcagaagtttactcagagttgcataatgtgccaagactataaaatttttttcctcaaactaaagcctttgtagatagaaatctatagcttatttgcaaatgatgctatgctatgttatagttacagcttttatatttgtcgaacttgtataattgttacaattttataagagaatttaatgcagcctataaagcaacattagtttatctttgatattcccaaatctacctattctcacttgttattcgtactttgtgacttctccaacctcacttttcttgggaaggtccacagaatctgatgcattgaggccacattaagatgtaaatgattaccagacttctgaaatatttgcatttttatccacaacttagattcaagtgagtcatagctatgttttgtattctgggcatctgcaggccaggaagtatgatgggcagcccaagaagttctcctgaaactcttgaaatccttcccttttgggcttagaacattgataaagattcagtctgaattccaaaatgtctgttttgagagaataaatgcccaggaagaccctttgaaaataaaatgggtttgttctacaaattagatatttatgtatgtcaagttaaatagttaattacttcatttttggtgatgtgtaaagaatttaattttatttattttttatttatttttttgagacggggtcttgctctgtcacccaggctggagtgcagtggcatggtcttggctcactgcaacctctgcctcccagattcaagcgattctcttgcctcagcctcccaagtagctgggattacaggcgcccaccaccatgcccagctaatttttatattttttgtagagatggggtttcatcatgttggccaggctggtcccaaactcctgacctcaagtgatccacctgcctcagcctcccaaagtgctgggattaaaggatatatatatatatatatattttttttttttttttttttgagacagggtcttgctctgtcagccaggctggagtgcagtggcacgatctcaccttactgcaacctccgtctctcgggctcaagcaattctcctgactcagcctcccaagtagctgggattataggcatgtgccaccatgcccggtaacttttgtatttttcgtagagacggggtttcaccatgttaaccaggctgatctcgaactcctgaactcaggtaatccacctgcctcagccttccaaagtgctgggattacaggcatgagccacctcgcccagcctacccaaatatatttcatgatacacatttcttagaatcatgaatttttttacagttgttcatggctttaaaaattaatgtgagatttctaagcatatttagaatccagacatttccaaagtgtgctatacatacagcttagcagttaggcggatattgtaaggattttttaaacgtctccattaatgggaaagattagtttacctacatttaagattgccttcttgcaactttccatctctcatttgagccttattctgcacaatataatttaatcaatagtaatccacttttaaatttccacccatatctctcctcttgtttatccaactgtcttattaatatttccaaggatggctatagacatttctgcctgaatatgcacaaagccaacttcctgtttgtcctcatcccctcattccaaacttgctcctgtataatcatcctcatctatgtatcttgccacacccaactccatttttctagccactcagacaaaaacaacccaacaaaaaggcaaacaaacaaccatctatcttagttcattcgtgctgtcataacaaaataccatagactggataatttataaataatacaaatttatttctcagatttctggaagctgggaagtccaagatcagaacaccagcaaatttggtgtctggtgagggctactctttgcttccaagatggtgccttgttacagcgtcctctgaagggaactaatgctgtgtcctcacgtggaagaaggaatggaagggcaaaaaagggattagggtgctcctttcaacctctttcataaggtcactgaatcttttcttgagggctttgccctcatgacttaattacctccaaaaggccttgccacttggtattatcacttaggagacggattgtcaatatataaatttggagggatacatttagaacataacatcccctcggtcccccataaaaagcaaaattttgaattatcttgtccatttttttcttttcgaaaatgccatgtccaattgataaaataatccttcatgatatctctatagctgttccacttctaaccaccttctccactttcatcttagtagtttctgcagtggctgcttacggagtttcctacttccgttcttgtcccttgtgggctgttttcaacactgaagccagggcaaaccttttaaaacctaagccaggtcatatatttcctctgttgaggatgtttatgcagtattactgaagtgttatgaatattattaataatagtataagctaatgtgtgttgatcacttactgtgtagcggagcctgtgctaaaatagtacaagccaattctcattttatccccaccacaacctcttattattcctattttacgcatgagaaactgagctatagaaagattgaacaatttctcaagatcacttaaattatgaggtggcagagctatctttgagcttaagctgtcagattctagagcgcggacatgaaaaaactaagctcaacgttctctcctttctttgtaactgtttaacctcttaacatggtatactcaaagtctgtctgataatccctttttatcaatgaaaaggccaacaataacatgtgccatattttgaaggacagctttgtaatgaagtttcttagcatcctgtttcttaagaagtagttagcagtacactgagtaaataccaaatatttctcttgacattgatggtcccagcagcatttcagtgtcccggagcaactcctactaagttttaaagtttatcttgcacttcactcctcattaaaattctactattgatgtcctattttgacttttaatcataatttgtccttttaaaatcgttgctcattcaggcaataagtgagtataagtaataaatgctgttttcagaaaattgcattaataaattctgttcttcatgagaactaacaggtactaaaatgaatgtaattgtagataaagaagaatttgttcagttgtgaagtggtactgtgttttatcagactagtaatgatggccggaaccaaagttattataacctaaatattggcatataataaaaagtactcttttaaaatttatagaggtctcgtgtgtaggtgacaaaatttttaaaatcatactttttttcataaagtttaaacaaatataaatttcatccactacccagttttaaaatatttattattttccaatatttcagatattcatgtctaaatcattttccaaaggaaactcattttatatatatatagatatttaaccctcttgtcgagaactgagccactaatgtgttatttaatacttattttcttagaaatgtaatattctatgtaattattatttatatgtaagttataataacacattgagaatttaccaaatggagtacaacataatattgacatgagtttctatcttaaagtatttctaaaactatctccatagtttttctttagtcctatcatgcaggcttatcagcttacttagcatgatgactgtttcacaattatacaattaataaaaagtgaatgccttccttgaggtacaggaggtactctagaaaaatatgttaacccaccatccataatattctccaattactgtaacataattgagaatacatagaagattttttttccccataggagtaagtttcttaccatatgttttccatttattcagcctgacttttttagtattgatgtaggcttggaaatgtttttactattgccctgcattttccatgacacacacccaatatgtatcactagagtgtagtgattagatgagatttagagacatgaagattggtatttaaaggctgcctgtgacttaactagtttcgttggcttgttatttggtcagtttatttaatctccctatgcttgttcttcatgggttcatatatgtaaagcatttagcatacaatggtgcataatggaccatttttctgcatttacagcatctcatcaatgggctagaataagcttctttaaatgaaaaactggactgtttccaaattatttatttatgtttagccatcacagcacccaatagagtgtcacattcaaaatgaacttatgtgatagaggtggcgcagtgctcatgctttcccatacaacccatcttttttcatgcagtgcttggttcatattttcttccttctcctaaacctctttttggcataatctttcttcttatttctttcctcatctgatgcataactgtttccctatttagaaagcaatctttattattacttcttttcctctcagcacatttatatcttaaaccttattttttggtgcagctgaggagaataaattctattgccatgtaagcacatttacttcagtcacaatttatccttaatatttttaatgatcaaaagtactagccatgaaaaataggtattttatgtcctaggaataagaggaaaaataaataaaattttgtactttccttgtatagtaaaatatctgtggcttgtttctttttaattctctctagccaatcagaaatgtggtgatgatatgataacataaataacttttgtctggaatgtttttattgaaaagcagatgtgaatcagctactagacagatatcattacaccatgcccatgagagacaaaaaagaaattaaaaattaaataatattcacaaatagctaaactaaagcaagtaaaacatcaaaaactcaggttaacttggaaataacttttttttttttacaatacctaagtaatatttttcttttccctttagaaaggctcctgacattgtttagcaaatacaatattgtggccaacttaagaactaaatcactgttcatctttttaggagattgctttgttgtgttactgttttgttttgtttaagctgccctaattattagtaagagaaaaacaaggctattttgagagctacaaatatgcatcatacaaatataatgatctagaataattgctgattaataaataaaccgcatttattgcttatactcactgatactactttctatgcatatcagtgagtgtatgttgctcttttaaaaaccttccaagataaaatattttaaaggtcttccagaaaactcattcctgatacaatagtatttgcttgagaattaaaataatcctgtttctcaagaacagaaaaccgaacactgcatgttctctcttgtaagtgggagtagaacaatgagaacacgtggacatagggaggggaacattacacaccggggactgtcagggggttgggggctagggaagggatagcattagtagaaatacctaatgtaggtgatgggtgcagcaaaccaccatggcacgggtatacctatgtaacaaacctgcacgttctgcacatgtatcccagaacttaaatataattttaaaaaatcgtgtttctaaggaggcctaaagtttcattttattaaggtctgtcaaggatgtaaagcattaaatactgcaattataattatatttggtaatcatatttggtattttgccccctacaaggttgactgagactaaactagtcttcctaagagtgagtacaccaaaaatttaggtaacaacctggttaccttaattgctgcttaaaattagttcttaggaagtcacacttctctaaaattaaatgaagttttttaaaaagtaatattcagattttggttataagtataaagctgtaagtcgagaataaatctgaaattggcataatttatgctatgtccaaaagatcccaaatacaagttcccaaaaaaggaaattaaagtttaggaacatgacctaagtatagtgctttcccattaaagtttggagcttttaaaatgcattcttcaattccaaaataagactctttcaaaggcacttctttttcaaattttatggtgtgaaacacaaaatatattctttaaaaaaaaaagtacttctagtgttctcaaccattctttatatgtgcgttgacagtgtgtcctccgctttaaatcttcaagtatattatctgtactcactttggctacctattttcagaccatccagtttcagattttgtttggaaatacttctctggaccatcaccctactccccagagtttctaattctaactcatgaccttgtttccttcctccctcttcaacctgttacaatttcctaaatactttgcacatttacctgtaaaagctactgacttcaaaaggactttaaacattattccaaagtgctagtggacatggaatacaggagtgaacagaaagtgttaggaggggatgtagataatgaatcctatgtgatagggaagtgcaagaaaggagtgagagttggagtctaaagttaatacaaaaaaggaaaagttcacacagttaaatttattcctgaaatctctcaaaacgtcgggttccttgacaaataacaaaatgtattctaacaacacagtttgtattaatgaaatataattttagtaaatattatttggaaatcaggccgggtgcggtggctcatccctgtaatcccagcacgttgggaggctgaggcaggcaggtcacttgaggtcaggagtttgaaaccagcctggccaacatggtaaagccctgtctctactagaaaaaacaaaaattaactgggtatggtggcacatgtctgaaatcccagctactcaggaggctgaggcaggagagtcccttgaacctgggaggcagagcttgcaatgagctgagatcgtacccactgcactccagcctgggcaacagagcaagactctgtctcaagaaaaacaaacaaacaaacaaacaaacaaacaaaaaacacaaaagctatataagagaagcagggaaaataaactgagctcatgaaatgacagtttgagaaagtaatatcatcaaatgactcgaggtaaggccatcactcaaaggaatttcattgggataatgtgagttaaataaatacaaaagaaataggacattattcaaaactgttactgtcatttttaccattaaatgtaattgtcattaatctcataaatctcccctattgaattcccgataacaaagtaattagctacatagacattttatcaactacgtaggcagactgtagtttacaagtacaaatatatttttgcgtaaaagcattgtttttgagaataaaataaagccttcaaaattatgtaactgcctgggtgtggtgtctcacgcctgtaatcccagcactttgggaggccacggtaggtgtatcacttgaggttcagagttggagaccagcctggccaacgtggtgaaaccctgtctctgctaaaaatacaaaaattagccaggcatggtggtgcacgcctgtagtcccagctactcagtagtctgaggcaagaaaatcacttgaacctgggagacagaggctgcagtgagccaagatcatgccacctccagcctggacgacagagtaataccctgtcaaaaaaaaaaaaaaaaaaatctcagttttaagactgtgagttgaggataaaacccatttgtgtaatatggcgttttaaaagtaagtaccagagtctaaatctattgtcatcatttaaatccacccaagatttgccaagaatttctgaaaagaaaatcaaaagcatcctggtaaacttctaactagttctgtatggattattcacgttatagattggccattacataagaaacaacttcccaaatcaggactcacatgggggcattagaagcacagtctctgcccaaagcaaccagactacttcctttctttccatataactatatttttcatggatagtctctgttttcaaatttccacttgtttaccctcgttggcacagatcataaagagttgccgcatgagggtgattatagggtgccagaagttatataacgcacactctgttgtctttgaggtaatagccttaggaggccacaccactgctatattatattacagggtggctatttcttaacctctttggaattgactcagaatctcttaatgaactacataggaattttagtcattatttggcttctggtcatgaataaaattaccccaaacctgttacccaccttactcactactcttggcttctcatgacctcatatttgtttccgtaatcagaataataggaaacaattctaaaccaggagttctataaacgggttcagctgtgggagtaaaataggagtaatttcatagcttctccgtataattgcactgtatctgtaagagtagaagacgtcaatcttaaaagatttgaggaggttatttccacacattaaaaggtaaagttaaatatcattcatttttcagaggtaaataatgataaataaagagagatatacatcacgatattaaaaaggactttaatgttataatttaaaaagtctctaaacttgtattcattttagtggtgtataaaaggaaaataacaactggaataaatttacatattgatttgtggagaagtcacatcttatcccaaaatcatgacattatcgattaatcaatatcactatcgtaaaactgaatgacttaaaaatgaaagagcatttaatatttttcgccaaatttaataggctaagtggtttactttaaactctgttttgaatcaatttagattcgtaagtttgaatctcatctgtgcctttaaaaaattatttaatttctttttaaatgacttaatgtattgaaattatacctaatggctaatttgtaatgaaattattcaaaatacttacaaaatttactctaaagtgatctgaaatacagatttatttattgaatgttaacatgaagttttgagaaatatgttaataatgtactaaagtaaaatgctagtattttattatgaacgtttacacttaaaaaccttgagagtgcattatcataaaattcacaataaagtgtaaagtccagtaagaaacttattaagtatattcatgatataatggtgaactaactcctagggttccaactaaatgtgcaattagtaggttatggtttccatcttttacaattacatgttccattgtttatagatatactacaataaacattcctaaaatactggtcatgataaattagcaaagaaatcaattgaacaacttttaaaagatgtgtgctactataactttagcaaatattcattaggaaataaatgaaatatttttttttttcaaagaagatgtgagaaacagcttctgataagaaatgtctggtgtctgctgctactctcctaccactctgtcctcacatctgttttcagttgcctttacaacaaatctttaggctagctcagctcaaaaattggatctcatcaagcaaggggagtggaatgggcttgatctattaaattaaggcagccaccaaagatgacttaagcctcacctctgtctctgctctagagttaggcaccattaagcctcctattgtacttgtgttgatcactcagattcgtatcccgacttcaccctgcattgccctatccaggggaattcaggcctttgcctttttttgttttgaaagctgacagttcaggaataagaaaattgaaaatcaccattagataaatattatagaaatagttattgatagcaagatctacccgtgggtattaaaataagtggataagagatgaaggagacataggatatttatattgtctcaaagtatttcacccaagatatttattaattacgaagaaaaagatagtcactttacagtgaaaaaatcaagcaggtaccagttgatgattcggttaatgtcaacagtaacaggatacatgtatatcaaatggttgaggttaatatcaacagtaataaaatatatccatattatgtttcctaatgtaatagtaatagggcatattgaaatgatgtatccctatatgatggtattcatgttaacaatgcataatcttaatctaatgagaaaatatcagatgagtgcaagctgagaaacattttacaaaataactgaccaataatcttcaaaaatttcaaggtcatgaaaggcaaggaaagaccaagagactatcacacactggaggagattaaggagatatgacgaacaattacaatgtgggatcttggtttggatcttggaacagaataaggactttattgaaaaaaccttgaaattcaaataaaatttgtagttagttaatactataataatattaattccttggttttgataaatgtactatgattatataagaagttgatattgggaaggctggggaaagtgtatagaaactctcctatacacgatagtacagggtgtacaatttttgcctctttttctataattcttaataagttcaaaattttaaaagttatttcttaaaaaaggaaagttgacagcccaaatcaatataattcaactgcattgactaaacataattactgagcatcaactctgtgttaagcattgcagaggatacaatgatgagaaaacggaatttctgccttcaaacaatttacagtttggtgagagcaatgaaataaattaaggtagctatatgagagttggcacaaagaggacagaaatgacctcctgttgggactctgtgtgtgtgtgtgtgttttgggtgaggtggtagatttagaaaagtttttttgtgagcataacatgaactagaacttgattactccaggtgtaaccagaacttggttactccaggtgattcattagtagatgtcttggtcaggtcaggctgccataacaaaattccatagactggatggcttaaacaatggaaacctcacagttctggaggctggaagtttcagatcttggtgctggctgatgtggttactggggaggccctctttctgggagctcatgtgctctctccccaccatgtgagaacatggcaagaaggcagccacctacaaaccagaaagagggcctcctcagtaaccacatcagccagcaccaagatctgaaacttccagccttcttagaaggacattagtcctattggattatggccaggccctaaagaccttctttaaccttaattaccttcatacaggccctgttttcaaatatacttattggggatatggacttcaatgtatgaattatggagggacacacacatttagtctgtgacattccacccctggccccccaaaatgtatgtccttttttagtgcaaaatgcattcattccatcctatcgccccaaaagtcttaatgcatcaagcatcaactctaaagtctaaattctaaaatctcatctaaatattatttaagtcagatggatgagactcaaggtatgattcatcatgaggcaaaattcctctccagctgtgaacctgtgaaacccgacaagctaatgggcttccaaaatacaatgatgagacagttataggatagacgttcccatcacaaaagggaaaaatcggaaggaatgaaggggtgatggatcccgaacaagtcaaacttagcaaggcaaatttccattcaatcttaaggttggagaataattgtctttggcttgaataatcctctttgccttgaataatcctcattgactttccaggcctggggttggcagcatcactgccacagctctgcagggtggccccaccttgtgggtctctgaggcagctccactctctgaaaccaagcaggaaagagccttacccacctgtcttcccctccccttgggcctgtggtgggagtggcagttctgatcatctctgaattgctttcagagtcattcttccctttctttgaagactagttcgtgttcatagacaaagagctctatggtctggtcctgtagaacccaagaagttcgacagccttctgttattccatcccattttctgtctcccctatttttcaaactggcagagtctctgctggtgtaatcctactcctggctgtgctgagatggctgattacattcatgaattgcacctatgctctctatcaagcagttgttcagccatacccttaatgcttagttgcttagtgttctcttcaaaacaaactttctttccttttttttttttttttggaatgtggatgggctgagaaatttccaaatctctcagttctggttcctttatacttaacagttccttcttccattcatctctttcctcttgaatttgactataagcagtgagaaccaaagctacacgtttaatactctgctgagtgtccagttttattgctcacaattcctgctttctacaaaacactaaaggacaattcaggcaaggtctttgccactttataacaaggatcaactttcctctaagttttaatcagctgttcctcatttccatctgggccctcatcagaatgacctttaacgtccatatttttgctaacattcagtttataattatgtatgtattcactaagaagatgaaagccttctctccagctctcctcttttctttgtgagctttcaccagtgttgcctttaatgttcatatttctacctatgctctcttaatggcaatcttagctttttctagcatgtacctccagctcttgcagcctctacccatcactgagttccaaaaccactttagaacttttagggtttttgttttttttgtttttaggtacttttttacagctttaccccacttcttaatcccaaaatctgtcataatcagttcaggctgccataataaaatgccatagtggtattaaacaacagaataagtaacttaaacgacatgaatttattttctcacagttctggatgctagaagtcccagagtgaggtgccagccagttcggttcttggctttcttcctggctgtagacagacaccttcttgctgtgtgctcctgtggtggagagagacagtatgagatctctcgtgtctcttcttataaggacatgaatcttataggatcagagcccaactcttacattcttgtttaaccttacttacctcaataggtaaggacataagacataaacaaggacataagagtggggttctgatcctataggtcagatcctgtagacccggtagggtcttcaaaggccctatctctaaatagttatattgggggttggatattcaatattcaaaacactagagcacaattcaggcaagttctttgccaccttataacaaggatcaccttttctccaagtttttataacctgctgctcatttccatctgggtcctcatccaaatgacctttaacgcccgtatttctaccaacattcagttcacgattgtttagtattcactaagaagatgaaagcgttctctcaggccttctcccttttcttttggagctctcagatttgagggattttgaggggatacaacattaagttaataagagtagacagcctttactttgggaaaactgaatgagtcacttgctcaggagaaaggaatagggatactgatgagtttcatggggagtctacagtgagggcttatagggctgtgtggaaggcgtagatgtgtttattgtcagaatagccagaaggatttctcatagttatgctactagcattttgataaagtctcagtaattgcaactactgaggttttcataaactttattccaaaccacatacctttgtggtttttacttgagtcttgttttctagagagacaagataatgacaatgaacacatttttattcatcactttaaacttgtgctgcctcttgggcttaaattttctaatattatttatttaagaaaaagcaccaattttatacagaatgtaatactttcatctttatacatgacaaagtattaggattatcaaaaatgtaaccatgacaacaggcttccttgcaacctagttcatgatagcagagtacatgggcatgcagattcttggcaggaaatattttttggtggtatatgtatacacatagatatacataaatatacacatatatatcaccagaaatttttttttttcttttttgagatggagtctcgctctgtcacccaggctggagtgcagtggcacgatctcggctcactgcgagctccacctcccaggttcacaccattctcctgcctcagcctcccaagtagccaggactacaggcacccgccaccacgcctggctaattttttgtatttttagtagagacagggtttcaccgtgttagccaggatggtctcaatcttctgacctcatgatccgcccgcctcggcctcccaaagtgctgggattacaggcatgagccacgacgcctggcctaattttttttttttttttgagacagagtctactctatcaccctggctggagtgcagtgacatgatctcagctcattgcaacctctgcctcccaagttcaaggtatcctcatgcctcagcctcccaagtccaggaccacgcctggctaatttttgtaatttttgtagagacggagtttcgccatgttgggcagacttgtctcaaactcctgacctcgagtgatccacgcatctctgcctcccaaagtgatgggattacaggggtgagccactgcgcccagccttcaccagaaaattttatatgtatataaacatagagtaagcattttttaatagaagaaagttaaaaagacacactaagatccactaagattatttcatagacataagtagacagcctagtgtttttaaaaataaaagtatataagttttggtgtcagaagtcctagtttccgatacagtctttggcactttctggctatatatgctttggaaagtgacaacctcctggggcttcaatttcctcatctgaggaaaatggaagctttatcccctgccgtacctaccttacaaaattgtcagaatcagaagacgtcatgcccaagaaaggactttgtaaagtattgatttcactcattatttcattactataatagtggtaattttctaatatttatcactttcatttcataactaaagatgataggaaaaatctagaagtatcagagttagcataaaaaatgataggaatgataaaaagcacttgtgaaaagatttgagtgatttgtagtgattatgcatgagaaagagaaggctagtaggtaatccaataattgtcttaaagcacttgaaaactactccagtgagctaatactgatgaccagactaggagagttcagcatgagttatttaggctaactaaaccaaataactttccagtagtgaggttactacaaagtagaattggcctctggggaggctgtggaatcccatttgtgacagctgtcccattgcctggggatagctaacctccagtcttgcctggagtcaaggactgttaactccatagactcagggctcccaccccttcagctttgtgctctgtgcctccgtatggatctagggtgttgggttagtgggcaagggaacttcttattttcctggtcataattgtttacttacagaagaagaagcaagcagttgaaagacacaccctaaatatataatgcatcaagtgtattttcttccttgaaatacactttacttttccttggaaagtaaaatgtccaatttttattttaaaatattggaaacaatattgtttactgagtatagtaaacaacagaacatacttctttccaaggttattttcatttaaagtgattgagatgtgaaagaagacaagaaaaaagaggtagactaggaagagaggggcaaagggaaggagtctggagtgtagggattcagacaggcaaaggcagtgacccatggggaggagtggaggaggcgaagaggtaaggcaaggaaggaggacgtggagtgggaatattttaggtttagtaaagggtacaccccactcttcctttggactgtggaaattggcattgttatcctttatcctctgctttcaaagagttagttagctggttaatcactatgttcacatcttcaactatctgatacctttactttggtccattacttgagagggtcaccagattggacaatagaagttattttctatgctttggtagcagtgacaaagccgttttattcagattaaattgaaccaaatgttctcaaactagaagttctccacttcaactgtatggagaggataacgtgaatcaacttttttatttctagaatttcaaccagtattagtataatacgttactctaaaagcattgcttcattatttgttatattataataaaaaattgtcttataagctacatttctagccttaaagacttaaaaattgagactgtaccgtgaatagtaagtgtcactgtggatcctttttggaaacaggagaagaaaatatctatctgtatgtctgcctatctgtctatctatctgtccatcatccaatgttttgatttttttttttggagaaattatttcccatttttccaaagccttggtaatacttagagttaaatttcttaactagattaattgcagaatggattcaagagatgctaaatggagatccttaagaaagtgggctatatattgtgtacagtgcacattgctcaggtgacaggtacaacaaaacctcagaaatcaccactaaagaacttactgtacccctaaaactgttgaaataaaaatttaaaattaaaaaaatatttttaagttaaaaaaaagagaccgggtatggcggctcacacgtgtaatcccagcactttgggaggccgaggcaggcagatcacttgagctcagggctcgtgaccagcctggccaacgtggtgaaaccccgtctctactaaaaatacaaaaattagccagttgctgtagcatgtgcctgtagccccagccactcgggaggctgaggcacgagaattgcttgaacctgggaggcagaggttgcagtgagctgagatcgcgtcactgcattccagcctgagtgacagggtgagatcctgtctctaaataaataaataaataaataaagtttaaaaacaaagaaagtgggagtaagtgtggcaaattatctttgatcatctaactaaggctttgctatcaactaattttgatcttccacttcagagaatagttctattttattattcagtgaataagtatgtgtgtgggcctaactgcatggatgctatagatctcttactttaagtaatgtagttattacataaagactgctttgtagaaagttatttgctaagttgcactttagatttttcattacgtaaggcactgtagttcagtctttaaaaaattcagtagttattttttgctttgctcaggtctttttgaggcaaacaaaaccaaccaaccataaaacaaacaaaaaaattttctctggttgtatttcccaaaagacttatatattggtacctggggaccactcagttttcaaaactgagtatccaaagctgtcttgaggacacataaggcttagtagtcatgaacatatttgttatcaagttaattatactttctatccaagggacttctaaggaactgcaaaattgtcatctattgtaaaggaaattttaattcccagggaaaattagagaaagaggtttaaattgttctaatttatcttggaattgaagtaatatttaaattaaaacattgtgcttctgaattctattgtggaaaaccagtctttgcctagggcccactgatttcaattttcagttctgcccctggtgtctgcccctactttgtcttgcagtcttgcatcttaccagacaaacaatctgagattaaccatcagtagttaagattgagtgactggacaatagcgataactgccagtgagataataactgaactttcttggcatgcttctcataccagctttctgaaggtatgtgtgacagttttccagaatgactcccagtgaaactttgtttttgtggaattcatggcccttatttcactctagattcttttaaactaagccttagggttttatattcctgtagccttataccattaatatttagaaggattttccagtgatttatgagatgggagcattggcttagaaaaattgatccattttagaattgagggagtaaatcactgaacattttaacctagtttactagacagtctctttcttttgtttttaaatatatccattctgaatcttatattgattttgaaactggttattgctcctatgtaactgtttaagtaaattcagagcactgtatctttggagatacaattattataggatttaatttcattaactcttgcaaagacctttggacttttgaggttacaaaagcagtgtttttggataatgggaggtaactaacctgacttgatctactgcacatcctatttcgtacttcatgaaaaagactgggtattctctactcttatcttgaacacaaagacacatcagcatgcacatcagcatgtgagctaggaatgggagaagtgtgtgggaatgtaatgtatctgaaagaatggaaaattttgtctttctctccctttttcttggattatttaaattttttatgtcacaaagcagcagaataaaatttccatcataaagtattttactctattataacctcaattttactgagtcagaatatgctcagggctgacacaggagggagaagatgtttccgttgtatggtaagtctgagaagaagcagattggtgtctctgttcccagtttttgaagtgaatttctggagtaagcatcctaaattgagaaagaacataaatatttctgtatggaaatgttagaaaacaagattctggtaattagtatgaaattttactattcatccctttagattgtcgtggttgcattaattgaccaacattgctttttaaaaatgctgtcacttctccttgtttatatctatttttgcttttttccatacatttgacattttctttaaaatctgggcatataaaatgctgattaaaaatatttttatgtggagttgaaatcaatgtgtcaagattcttcattgtattttccttcaaaaaaggctgctgtaacataggaccaaatgttaagggtgcttgctggcataactccaaagcagtgtttttggataacaggagtctttaattcttaggtataattgatatttttagttagtacttttttcagctttgtttttggtttgatttggggtatatgtatgtatgtatgtttctataacaagttttgaatttttttgaagacttatcttcttaggccaccaaagcaaattagttcagtaattatagtctcagtttaccttgtttccctctcagtgggtcaaccaaaaccgcatggcgtactactctctgaagcctctactaccctgctcctccgtgttgacatgtggtcaggcaagccaggacttactcacatcagctacatcagttactggggtaagaaactctgggcttttcagatactgtcctccagaaacaccagcaccagcctttgggtttaagatcacctggtgagattgattatctttagggaatggtgcagatgggatagtttctagacaatttgggaacctcagaaatgggagtacttatattagaatgacataaaataactttttgccccagggatcttgcagtaaagattatcatcacagttggccataccatgaacttttctaagttatttaaatttaccttgaaatgttatcagtgtctgctgtcacagagaataaatgtatctggtattaacattttactcatgcttgccttgcctttactaaatcttatcttgtaattgaagaacttgactatttttaattctgaatacaatatgcctcagaataaggttttaagctttaggtaaggtaaagtttaactttagtttgtatctgtgacacctaacacaatactaaggaattcaactgaatgagaaatttattctaggcatccaccatgttcaaaacatactaagtacctaggaattacttatagaatagatgtaactctattgaactataaatcaaatatcaacatacaaagttgagtgagcagacttgtttgcctcttttcattttttgttacactgatggataccacatgtcttaggtgattgggggtgcggtggctagtaattactgccattattgtctgtgatacagcagtgttcagatagcagctattctgcttataatcagatgaacaagatattatgtttggctttgtttatggaaaaaaagaaattttattaaattgtggttagaggcctgttagcataaaggatgaatggtttcttggaattacaacttgaatattttgagagaaacaaatgaaaagtatctcactgtagggctgaattggtttgtgaccttgcttctctagctgaaatctattgactctctcagaagtattgctaggagaagaaataatcctataaaaggacattaagcaatgctaagaaaaagatgatgataataataatgctttcagctcaccatgtgccaaacatcatattaaacactttaagtgcattattacattgaattctcacaaccctacaccatatcctcattttacagatggagaaaattgaagcctagaaagatcaagaaactttctccaggccataaatagaggaatcaggattcaaatcagatagaccccagggcttgttctcttcaacaccacattaccctacattattattcaattattaaataaaaccttgcattagtggcatttccaaatgcataacaaaaaaataaaaaaaagtaacactggtcatatgtatcgtattttttataaaaattacattattccatttgtttttctggaaatttttattgcattgagttgctagaataccataatataaaacttggcattttctcaataaatgtgtatgatgctgtagtaggtgtttaagatgtctttggaacaacatttaatttgtaagatcttttttattaatgtgctgaattaagtaattatttctttcccactttgggtatgttccatatttgattttctgctgctttcaagaagccatacaatagaattcttaatcccgttttgactcaacttctttccaaaaactaaaataaaaataaaagacatgaagcacttcttttatcttattagaaaagccaataaaatgaaagaatcttcaaagcaattttttcaaaatataaaattggcagagtattttgtttatgaaactatggaaaccaagttgagatttataaacaaggacttcaaaacttgttttgctaatgcagtgtcactcaagaattcactgaacctcacaaggtaaacttgcagagaatgtttgttttgggaaatgatgatgatgacaggcaagaattttctaggtagaaaattgaattttaattcagctaccatacaattcactcttttaaagtatgaaagtcagccatcccattacagggtatatacccaaaggactataaatcatgctgctataaagacacatgcacacgtatgtttattgcgacactattcacaatagcaaagacttggaaccaacccaaatgtccaacaaagatagactggattaagaaaatgtggcacatatacaccatggaatactatacagccataaaaaatgatgagttcatgtcctttgcatggacatggatgaaattggaaatcatcattctcagtaaagtatcgcaagaacaaaaaaccaaacaccgcatattctcactcataggtgggaattgaacaatgagaacacatggacacaggaaggggaacatcacactctggggactgttgtggggtggggggaggggagagggatagttttaggagatatacctaatgctaaatgatgagttaatgggtgcagcacaccagcatggcacatgtatacacatgtaactaacctgcacattgtacacatgcaccctaaaacttaaagtataataataataaaataaaaataataaagtatgaaagtcagccaggcatggtggctcacgtctgtaatccccactttgggaggctgaggtgggcagatcgccctaggtcaggagttcgagaccagcctgggcaacatgatgaaaccctgtctctactaaaattacaaaaattagctggatgtagtagtgcatgcctgcaatcccagctactcgggaggctgaggcaggagaatagcttgaacacaggagacagaggttgcagtgagccaagatcgtgccactgcactccagcctgggctgggtgacagagcaaggctccatctcaaaaataaaaaaaattttaaaaagtataaaattcagtgggttttaggatatccacagagctaaacaaccattatcactatgggattccgaaatatttttattattctaaaaaagaagcctccttgtccataagcagtactctccatcccctaccaccacccctttcctaggtaaccttctatccattttttatctctatgtatttgcctattctggacatttggtataaatggaatcatgtaatatgtggccctttgtgccttttctttcacttaatgttttcaaggtacattcatggtgtagcatgtatgaatatttcatttctttttactgctaaataatattcagttgtgtggatataccacagtttgtttatccaccaatcagttaatgtgtgtttggatcagcttattttgtttatactaaaattctgaagagtaggagcaggaataccatccatgctagtttccaactggagaatgataacactcttgccttctctctcaaattaaacaaaatcacagccaatgaaatgaagataccttcagaaagaaaaaccttgacttatttaggcaatagataaccatttttttactcgttaaaatgcttcagtaagttaattttgcttctcattactttgcctagcatttgctagtgtaaattcattgtctagaactccccccaaaatccacatttacaaaaatataagaggaaatatcccctttcaattaagtataaaaataaccaaggtagtgctatgaaactaaaagtataaattagcattatgtttcctcattggctttgttggattagtcctaaataacccaaaaggaaacataaatttcaatttgtagggagttttgtgatctgatacttttaagtgggtgtttagcaagtggcaacagaagaaagagcactagactgcaattacttactgcaaatcagaagctgctggaaacactgcttactaattgtataccaaagcacttgagtaaaaaagtgtggaagggctatgaaagccctgcttctcctgttacttacttctgtaaaccaggacacaagttgagtgagctgtgcatttattggagctctcttatagagcacgcagatcctgcatgtttggaagttacaacattgaggacgtgagaagaaagcaatgggggctttctgtgtatgtgagaataaagcaacgggggcttgctgtgtgatgatgctagtttgtaactactattatgataacaataacaatgatgataagagataataatagcttttattcattgagtaattattctctgttgggctctttgcatctacacgttacctcttagcatcacaaccctcctggataagttttattatctctattttacaggcaagagaagtatgccactgaagaatgaagtgacttttccttgtgtcagctagctaataagtaacagaactgaaattcaaacccagatccaaagtctctctctttgaactagtcaaggatggataattaatgtttgacattaaaaccatagatgcttcaaatccataatattgatgataatatgacttatgtggcccaaaagatgcagcctctgcatgcatgccctaagtaaacctgttttgccagcttttgttccggatcttgcgccttcacagttgcccctttaagcttatccccacagcttatcatcatcatgctgtgatcccaggacattcagaagatgtgatagagttttcatgggataaacctgtgaaccattccctttcaatatcttcagtgcccctttctgacttatagaatatggagtcagtctaaattatttaaattttcccttgaggattctctagccctatcctagatttgctcctgggttgccttggagaatcaaatgagttcttccctgagggggaactggaaaaatcctggagttccccaggacttgaggatttcctggagtgacctccttcttgtgagatccttcagatccatggtcccagctttcaagtatgtggagaaaagagcctcagtagagttatctctgtccaaagccacttcataaaatacttccttagatattttaatgcttggcagtcccatctgtaacattacagggattggacaattcctcacatggttatgttctttggccagcacagtattaaaaaaacaaaacaaaacaaaaaacgctctatattgtttttaggaacaaaatgcttgctctagttctccacggtcttctccaatatctattgtatcacaaccagccaacttccctgattaacactccctgcctgacccttaaaggtgtttgtttctgaaggtactggaagtgataatattctaaatttcttccagctctactatcctctgattctctccttattttcagtttacaaaaaggatttgtaccttttttttcctttggccccacacttatgtcttccttgcttcctttcattctgcttttctgaccttcccttcagtgctcagacatcaagtgcttcaacccactcttagctgtccaagttctctgccatggcctctttccctgtctcaggaatccagccctcaaagtactcctcttatacccctactttactcttaataaattttctatctctatgaagaatcatgaaagtaagctctttaaattgattcataatgaaaatagattattcctggtatcttctattttaccattaggaacaagggtgggactgggatggagaggtgcttaggagctccaatgagtctttaattggtcaaggccagggtggcgaggatgaaagggttgtggaagggaaagacctaatctgctgattttttcacacttaccaaagaaagaggagaaaggctcctccaggagcctctttacgtttttatgttgaaaagaggagctgatcgctgccccacttagaaatgtctcactaccttctctggagaggacagcttctttaaggatggctctgccctcagccatacgtgattttttaactcagtgtgtcttccttggcctggatgcagaggatggaagatggcgtccttactgcttcacctgttttaccacaattttgttaagtggagaaattatgggtaattaactcaagttcacacaaatgctaagtgttaaaactagttctcaagctaaagtgtgtctgaaccccaaagccaagcctttgctgtcagactttctgaggctctcagaatcccccattttcaggtacctgtggtcagaggagggagaaatcagcacacacattctcacttactcttggattctggtctttggtgggagcttgaagcaagtgcttgttagccacatatacttttttttttttttttttttttgagacagagtctcgctctgtcgcccaggctggagtgcagtggcgcaatctcggctcactgtaagctctgcctcccgggttcacgccattctcctgcctcagccttccgagtagctgggactacaggtatgtgccaccacacccggctaattttttgtatttttagaagagacggggtttcaccatgttagccaggatggtcttgatttcctgaactcatgatccacctgcctcggcctcccaaagggctgggattacaggcgtgagctactgcgcctggcccacatatactttttctcttgcccagctggtcttaattgtatatggtttagatgtctcttaggaatgcctgggtttgtatgtttggtgtggtaaaaaaaaaaaaatgccatttgtgtaactgcttaccaacttaccaagttatgatgaataaagtaattatgtcaaaatgtttaggtttacattgtctggagcttataattttataattgctgctaacagctagtttttcttttatgttttcacatcattttctgtcctcatggaaagtcttaacctgtgagaaagccatcggtatcttcattttagtaataatgaaactgagacttagcttaccaacccacatggtcaatatcaacacacaggtcttttgatttcaaaacctacaagaaaactctgttcatgtatgtataatcattacctattatgcacatggcatgatcacctggtctctataaagcaaaaacaaaaagcccgacatgattctcttagccttccaattccgaatgagtatgggttccaccatccatagtcaccaaggtccttattcattcaagatccttccttagtcagatcctgaggcttttgtgtgcactggcagcaatggcatcccacgcttccctgacactggaggatacctacagaaaagatcctagctgcttgccaattttaaggcacatccatgtagtagagtgagagcctacaccgacaaagtattgtggtttcttcccaagaaactatttcttaactattttgcctggaaatctccatccacagaggcagacagtaaaagtttccaaaaatctttcatcagtgtctttgagatagacttgcctctgccacctgggcattagtatcaggccttgatattgattattacacattgtatacatgtatcaaaatatcacactgtatctccaaaataggtacaatggtctgtcaatcaaaaattataatgcaagaaaaagtgttgttttcatgcacttggaatgggcctttgcatatgttatctgtgtaatgctatgcattgtcatttggaaagttttagttcactagttatgaaaaccttccaaatattgacatattaatttatgaaataacaaaatgttacatttgttaatatgaattaataatgctggcatatgataaagaatgtgtgtgtatgcatttgtgtctgtgtgtgtgtatgtgtgtatttctgtgtgtgtgtatgcgtgtgtgtctgtctgtgtatttctgaggcccctaggcattgctccatctctcctctatataattcttaagaaacattccactgggctgcatttcttggcctacaccattgtccctccctctatattgtttgtttgtacttcaggccaaaaacaaaacaagcacaaataagcacactgaacaagaaagagaaaagggcccttaaaatgagatgaagagagagggtgtagggctatgtgttgtgcagaatgattgaatgaatccaggcaaactctgatttggtttgtaagttctattttatctattttagtaacctgtattgaaagcctggacccaaagagctgaggtcctaattcaatggtttctgtctgtgatacaaaaagtttctggctactcactaagaggtttgcttagagtaaatccctcagtcaagagaaacatattgttttgaattgaagctcagtttttagttaacaaaactatatgcattccaacatacactggttttgttccttttcttttgagctggatatacatgcatataatacaaaatcaaaagatatatggtggttaacagtgagaattcttccatcccgttcctggccccctgacaaccaatttcttactccagagtcaactactatccttgcattttttatatccttcagagatgttgtatgcattatcactatggatgtaagtttttgtttttttcataaatgttatcatatcatacacactgtatattatgccttagcagtttatacaatactgccttactcattttcatagtatacagaattccatcaaatggatgtgaactaatttatttaactgccttcaattatttctaatattgtctatcatatttcaaggaaaatgcttatatgaatgtcattttacttgtatgttagtatatcaagaggataacttcctagaaatgtatcttgggctcctctaagaaaataccattgctgagtggcttaaacaatagacatttatttctcacagttctagagcaggaaagtcctagatcaagatgccaacagattcaattcttagtgagggtcctcttcttagcttgcagatagttgccacctagccgcgtgatcatgtgacctcttctttgtgcatgtttagagagagagctgtggtatctcttctttttcaaggatgttgacccccttatggggcttcatcttcatgacctcatcgaaacctgatttacctcccaaatgtctcacctcctaataatatcacattggggattagagcttcaacatatgaactttaatatgttgaaaattcagctcataacatgactgggtcaaactgtgtaaaattttggcagatttgctattgcttcacatagggtcctacccgtttccaatataagaaagagtaagactttgaaccttgccaacaaactgtattatcaaattttgtgatgttccctcgagctgataggtcaaaatgatagctcagtatagtttcaatttacatttcttttgttaatatatgaggctgatgaacatttcatatgttcatcatttagcactttagcactattagcactttatttttctaagaagtaggtattcacagtctacccacttttctgttggattgatgatccttttcttatgtgtatgtgaaaattgtcatttttctttgatataagctgtaaatacttttgccagtttgtcttgtgtcttgacttttgttaagggtgtttttatttttcataataactttttaaaaatttgtcttctattgcatctgtaagatgaaattataaattacttcactgcccatctttagtttgagaatctttatgggttgttttttttttttttttttttacttttaagtctttgatacatctgggactactgtggtacaggttatgagataagaatccaatatctttgtttgattttattgttttgttccttcttttaatgttactcaggtgttctgtatctgtttatttcttcagaaaaaaataggttaatctatcaaataagggaacatatctcaaaaagtcataaaagggctaaattatatgattctatatgattatctactgatttttgtcactgtaaacataatctggataattcagatttagaatgtgtgtgtgtaagtaaatatattttaggacagttcttaacttatcagttaattgtgtaactcttgtatttaatttacagaatctataaattacatttatatagtgaagatgagttaccttgagcagccagaagtagcatcaataccaagatcctccaaggctgtatatgaagcgttactgaatacttaagccaatattgattgctctctgctctgtttccactgacattgattgtctggaccatatatttgagtggaaaatcatctttcttaggatgttatgtctattgtatatgtcttatctaccttccccagaaaagctgtgaactccttagcagagagatcatgacctatacttctatttaatctgttcagcaaatattgagtgtctaccatgctccaaacactatcctgaggacaagagagacaaagagaaccgtaggccctgccttcaaggagcacatggctagtggaaacagacagtaagtcgacaatgacaatacatgtgaccatatttacagtgctccaagaagttcagaaaaaagccatctgatttggactgggaagaacattatggggatttaaggagataaaaagtgaaagcatacttgaagtgctaggcaaatgatggatgtaaagtaagtttaggaaagtcctgagtcacattttacttctgtttatattataagcattgtgtctcaaactgtagaatgatgtttcatttatttggctttttctaggaaaaagaaatgaaatatttttcctaagaagtgaaaagaacccataagagctccagtttgcaaaatgctagtctttttattgatccctttttttttttttttttgacatggagtgagtctctctctgtcgcccaggctggagtgcagtggcgtgatgtcggctcattgcaacctccgcctcccaggttcaagcgattcttctgcctcagcctcccaagtagctgggactacaggtgcgcatcaccatgcccagctaatttttgtatttttagtagagacggggtttcaccatattggccagggtggtctcaatttcttgaccttgtgatccacctgcctcggcctcccaatactgatcactttttaaagtgttctaaatgcatgttacattgctttcttaatctaactatactgagcagagtttacactttatactgagcagagtttacactttatttgaagtttcagaaatagcattcagaacatcttcttttgtacaacacagcaacttcaggggctcttcaagatttcccaggttactaggttcttaaggttcactcttttaagagagtttctttctttcccattgtctaagtctagactaagatccaagtttacttccagcatttctttatctttatccttcttcatttgcagcttcttcttgtttatgctttgggaaaccagatgaagaaactggtccaaattacagtatacctaaaaggagaatttacagggtctctgtggcagaatggagttcccgcttgtaaataaatataaaagttttagtgcaaaaagatatgcaatcaatttttactgtcatcatatctgttaaaattattgttgatttctctcagcaatgttcaatacagttgaggtttctggataagttatctaagtatatacggagtatggtcatacattaaaaaaatacaaaaggtttcagacagcatttaatgtcattcttcaaattcttattaaaattgcatcgtatttatctatagacaataattatccacctaacttgtttgaatgttctataataatgcaaaatgtctatgattgcaagaaaagtgagtttttaaaatttttggtcttttggtgtgtttttttctcattgtaactgaattgcccaaaaatataagcttggtaaaagcttattacctcaagaaatatttcatgtcaaaacagagcacatgttaaagtaaaaacaattctttagagtgagaaaaacattatagctataaaaataattaaagagttttgactattaaaaatgtaaccttaagtcattaaatgttcattactcattcaaagttcttgcagttgggaatttactgatggcctatttgcagttaattttgaggtttaaagtaaatgaacttaccagatataaccctttggagtcctggttagaaaacaaaaaccatgcagctactcccatagctctacaaacctgtggtgctttcaagcgtcaatggcggaacagaatgagtaagagcagagacaagggggcagtgactaagggactttaagtcatgagtctaattcccctgggacatagctagccttcacacagaaaaaacaaaacagaaaatctccaccaaaaagaagcattcttcgatctcaagcaacatccctaactcatccaaagtggtcatttgtccaagggggactagatgagacagcatcaacccagaaaaattaaggagcatctggcagatggggaatcccaaacggcagcctcgctaacagagtaaaacacatttgtgagagacccacaatggaacatttcagtccctttagaaagtttcagaggtggcagactttgtagtagctgagaatttgtgtttaactaaaaattggaagattatatatacttatacccacaaagtattaggcaaatggtaaaagttttaaaattattgatactgtggtaaaatttacatacctgaaatgcattacaattcagtgacattgcatgcagttttaaaataacttagctatatttagtttttctagttgaaaacaagcgtttttttttttttcaacctcagtgcaacaggaaagtgaaaaacaaaacaaaaacccatagtaagttgacagtaatctgattgggtaactgatttttcttctgtttcgagagttatttagttatttaagagttacttaaagagtacaagattgaatttgtaacttgaatttccagatttagctagagtggcttacaaaagcatgaaaatggccaggcgcggttgcttacgtctataattccagcactttgggagctgaggtgggtggatcacttgagaccaggagttggagaccagcctggctaacatggtgaaaccccgtctctactaaaaatataaaaattagctgggtatgatggcggatgctctagtcctagctactcaggaggctgaggcaagagaatcgcctgaacccagaagccagaggttgcagtgagccgtgatcccgtctccaaaaaaacaaaaaagaaaagaaaaagaaaacatgctgtttccacagaattaatttgttacaatcaaacatagttgctgtcctatgtttattaatataatttcatcatcatcatattttcaagttactcttcctaaattttttttacctgcttctgaatctctgttctttggttcccactcttctctttgcctcatctccctcactgaattgtgtgtttcatgaaaggaaagtttgtttcctatttagggttgtggacagaagattggtaaaatttcttgacacctactattgaatcaagtttacttaatgtaaaacattggtgttcccagttatttgtaaatctacaaaagatttacagtagaagaggcaaagcctgtgaagtgtcaacataaaggctgctgctgctgtcaacatctgttcccccaactgcatacagaactctaatggggcagcccatgcctcctgaaatctgttaccaagaaaaaaaaaaaaaagcctaatagtacaatactttttatttcttaagccacaacaatagtgaaactgtatgtgttcttttgcagttttttttccattcttcataggaaagatgctaaagtataatttcatttagaataccatatataaattatatatagatgtcctttaagaattataaaaataatgaaaattatatttatcctttatgtcttatgttttccttaatatttcctaaagaattgttatatatcagaaaacaattcaaaatattcagaattattagcctcttaaccactgtgtttattagcttaaactagtaatagagagcaaactggcttttcttcttagcataggtttttggaaacttgaactcaaaaatcagtaaattcaaaaggagttatagtttcagagtatttggcataatatatttgaaaagaatattcccttcacttatctttgtttgcattagacttgtgttaattatgtgattcctctccatagcctcaataataaagagatctcaagttggaatgtatagttctatttttcataagtatcatttaaaaaccgatttataaaccctatgacttatgaaatatttgtgaacaaaacacccaatgccactggaataattcaaatgaaagagggtcttacattgagcaatttgtcagtttaatacctgccctttacaattgctctgcggttgaccctttagtcgtattttgagttagcagatgaaaataaggtttcccttgaagtagtggttgctaagggcaactggtactgacgccgaagacgaatactctatctccttagtataatgcctactttgtgagctaaataaagagctaaattgtagagaagaaagttgtacaaatgtgaaatatcaagaaaggaatagaaacaggaatattagagatgggaaaataagaaaaagaattactataatcacttttttggtaactgcctggcattttggacagatgtccttatctcctgggcactctgcatttccacctttcatagctggaaaattaacattgttcactggggcaagactttcttttgtaatatgaattcatgtcattagttcttagtggattttgacaaaatggaggtgagactgtgatagaaatatttgtcaactttttaggcttggattttcaagcataaatattttgtgtcagtagaattgctttatgctatttggacaacttgtagtgtgcagggtcagttatctctaactccatgtcagtacagattgttttatgaacatgttggtttaatgagagagtcttcatatagaatgtgttataacagtgttcataatttcttcgaccaaattgcacttaatgtattcattgctgtgatttcagaaaggtttttaaaaacttcattgtatcctaggcaatgctgtttctaaagggtgagttcattactcctttatgagcatctgctcgatgccaggtgttttgcctgtctacaagaagcccacagactgggaagatggacataaaatcaagtaattacagatgagtacactgtaagctataatcaaggcataaatttgatgctataggagcacagagtgagaaacattcactgagtaagtcacatttagcttgcaggatggtttggagtttgcaggttgtgcgagaaacatctgcctgcagcagcattccttccatgattatcaaggttcatgcaactgatctgtttcattgcatgtatttgaatgtctctttccttcctctacacttctagaattaatttgttggttaaggaagataactcagctagaggaatcagtgggttttttaatatgagactctgcaaatacatttcttgtaagtgtgaacattttgaaattttctaaggtgatgaagaacaaaatgaaactctgtaggcacagctaggaatgggctctgcaggaaaagtgtcaactttatgttccagatttctcaggacagtctagactccaagtgagtccttttaccctggtagaagtttgcttatcagaccttatgtactgatgctcttgatcatagaaatatggtcaatgtagcaaagagacaaagtaatgaaggagggctagtgaggccctgctgtaatatggtgtaggatttatgagactggaaaagtatgtaaagacatactgtagaaggttttgtatgcaacaccaagaaatttggactttgtcctccaggcaaaggagccatcacatttttcaaaaaggaatgaggaggtggaattatttttataatttattttctgtaaattgttgggaaatggattattttttaaaaagaatatttctaatagcaatatagagaatggattgggcttaagttttcaggaaaaagactaactttgaagtatagatttatgtgttactaacttatagataataattaaagccataggaaatgggtgggagaacccaaaggaagcatgtggaataagaagacaagcaggaagaaggaaggaatcattaaaagcatatatgaatatgaaaaagaggagaaacgtgcacacgagacttggaaggagtgtttagagagttagaagataatcaggagagtgtgtttgggagcaagatgtggagagattttaagagagaagagttgataaggagtgccaaatcctgttagggctgtaggatgagacttgaaaaagtggatttggcaattaggccatttgaaccttagcgctggtaggttcacttcataaggtcttctttgttagaaaacaaaacataacaaagctgttagtgatgggattcaggattctttagcagggcaagggagtaaaagtttttctctggaggaaaaaaagggtaagattgcaggaaaatgaaataaatgttagggcccagtaaaggaagccctaatcatagaattgtaggactagctattactggttgtttaaattgtaccaccataggtcaaaactccacctaaaactattccggagaggtgaatattgtaattgcttatacagaatcctaattatgagctaataagaagaggcattaaaactagcaccccactgatttaatttggagagagacacttatattagctgtttctaagacttatcttttaattcttcccaaaaccagttatttcacagttggctcacagttttgaaagtagaactgctagagtaaagaaagaaatttacagcttcagatgtttagtttctgaaggtgtcagaatcccatatttctcttttatttatttttcactgaattttggagaacactgattaacttaaagttttagatttaattttttcctatgggccattacacatgaatgccagctgtcttctgtcaagtaaaaactaggacagtcccattccagcccaccctgttttaagctacagggtcactgagaatgtagtaagaaattatacattttttgatcatgtaaaatatggatccttttttttctagtaattactctcttccatatttcacaatttatcatttctgtgaggaatagcagcacaagaaatatacaacatctgtgacccttagaaggggccctcagagaggccttgcataaagttgtgcccccctgtggctgggcaggaagacttggtctgcagataaactagctagataatggatggtttctgttattttggtctgaaggcttgatatgtaagagatgcatccttactttgtgcctgtcctttcttctcatggattgagagatgcagaggggttatgtgacagagttaggagaaaaaacattggcctgggtaggagttctggcctctagtgttgacctgggcccatataaactctatagctgatggtgggcaagtcaatgaagctcactgagccagaatttcctcatctataagataaaggtggttgtgccaccctgactacttcatagaatggcagtgaggacccaaggtaagaatacctggacagactacctcaagaaatgtgttattgtcacgatactggaactacacctttttttaaaataatttcaacttttcttttagatgcaggacatacatatgtgactttgttacatgagtatattgcatgatgctgaagtttgggatgcaaataattccaccacccaggtactgagcatagtacccaacagttttaaaacctttccccgctctattagttccctatgactgttgatgccatctttatggccatcagtacccaatgtttagctcccacttataagtctcacggagagcttttgtggtattggttttttatttctgagttaattcacttaggataatggcctccagctgcatctatattgctgcaaaggatatggtttcattcatttttatggctgtgtagcattccatgatatatatacatataccacattttctttatccagtccaccaatgatgggcacctaggtcaattctatgtctttgctattacggttagtgctgcattgtacatatacctctctatatatattctaggacaactgccgtcaagatatttgtacacataaatgaccgttgttgtaaaacatagcattgtgtgtctatatttcatgacttcaatgctgtttcaaaaggaccttagtttttacctaaactcaataacatttttatttctattttttctttatgattttttaagcttactgaaaagtacagaaaacaataaatattcccgtactttcctcttatataaaatggttccaccatcttgtcacatttccttcaaattttcttacaacaaaacaaagcttacagaggttgctgaaaccccacctctccatcccattcacctcttttcctctctgaatgttattatctttaaatgttcacacaatgacaaaaatcatgtaacaacacttctcagaacatatacatgccatttagctatgcatgactgtgtttataatatataatattacgtatattggattataaatattatgtatgattttatataaatatatatgtgcaaacatacacatatacacacatacacttgttttgggaagatttaaacttgtacttaaattgtttcattcaaaaataaggttttcaagagctgggcgaggtggctcatgtatctaatcccagctattcaggaagctaagatgggaggatagcttgtgcccagaagctcaaggccagcctgggcaacatagcaagtctctgtctctaaaaaataaaaaataaagaaaaggtaacaatttttttaaaagtgagccaaaagtaatgttttgagagattcagccatattgatgcatgcagttttagtttattttaacatgagaagagaatgtggctattaaattgctggtaagaaggtacaaatatctagtagaccaatttggaaaaaacaagtaaatttgggagaatgtatatcctgtgacccagcaatttcacttctccgcatgagaaactcttacacatgtgcacaaagatatctaaaaggttgttcgcagcaatggttttaatcatgaaaacctggaagtaatttaagaggccctcattagtaacatgggcaaacagtggaatattatacagcagtgaaaatagcattttaataaaatgaattatggtaatcagaaaaattgtcaaactattaaccacatataaatctacaaacaatacttgataaaatacgggtgtgaaaaaatttttaatattaggcactttatgaagcaagatgttttctcctattcatcataatttttacacaatctgtttcctttttaaatgagtgtattaggcttgcatgagataattacagaagaataataagacattttcaaaaaagatgcaggttaataaatgggcaagatctattttgcaatttttctccaacatttttgtgtgatgctgagtggcaactctttatctcttagtgggccacaatcaaagaactccataaattagtgttatttataggttatctgctttaagaaaatcttgcatattaaaacatagacttaaaaatatatagtaagctggggatttttttaaatagaggcatacttggatttataattggaaacacctttgcataggaacactcccagtatcttaaatatggcttactatatgaaatttattttttcaaagcttcaagaatacatatcttgcataaagaagaaatatatatagtgatagtagtaattttagcactaaataatggttgacacttcagtgccacatattagtagctctagtgataaaactctatcaaagatgaagataatcagtttactgctaccccttacaaagtctgatatttatttgaggtcaatcgcggtatcattctttaatttcatatcttgtcatgttcatcaccgtgaagttgaggtaaaattcttttaactcattctgtaaaactgttaagctataaatcagatgttcattaaagtcaaatagagtttagttttgtgatttcattctcctcaagaatcattgagcgatcttttccctgtgaaacggtacttcagtgaggattgattttgtagctcagataggatggttgtttttactggtcattccccatgttcatttatcctaatcttaccaattatgcacttctgggtaccaattgaactgtggaaggagcaagtgggatgcaagggaagaggaaagggccatatagaagttataggacacaataactcatggtgggtcacaactttatttcaagcagcttcttctctgaaatctggtatgcaaattctagatttattcctagatttaaaccttaaattctagatttaaaccttaaactatatacagtgaaagcagctgatggtggtaaaacaaactgtaatccaagatgaatttcagaatgagaaaatttagaagaaattaggatataattccttaggtttctgtgaaaaataagcaaggcaggagtgatgaagaaatatttggtaatgaaagtcaagagaattacaataaaataaattacttaggacatgagtttagttactgcagttttatgtggatgtttacatttttaactatttcacctgttatattgttttattaaaagggttccttttttcagctttattgaggtgtaattggtaaatggatatgttaattagcttgattatggcgattatttcacaatgtatacatagatctaaatatcaatttatataccttaaacatatacaatttttactaaggaagttcttggttaaacaaaataccttttcaaagtgtatcaactggggacggtggctcatgcctgtaatcccagtactttgggaggctgaggtgggaggattacttgagtccactagttcaataccagcctgggcagcatagtgagaccctttctctacaaaaataaacaaataaataataaaagtgtgtccgttgatgtttgtaattgatttctactcaagtaatcaagtcagtagcttcagaataaagttattctttattttaaaacccaaataggtaaagcaccagtaaaaatgaatgtatttagacttttttttttctttttgagacagagtttcactcttgttgcccaggttggagtgcaatggcgtgatcttggctcaccggtaacctccgcctcccaggctcaagcgactctcctgcctcagcctcctgagtaggtgggattacaggcgtgtgccaccacgcctggctaattttgtgttttgagtagagatggggtttctccatattggtcaggctggtctcgaactcccaacctcagatgatccacctgcttcggcctcccaaaatgctgggattacaggtgtgagccaccgcacctggcttgttttgtttgtttgtttgaatgttgcaattatggggggattttctggtcattatatgaacatgttgaaaggtttttaaatagggaaaagagaataaatgttccatgataatttggaagtaaatctgtgtttttttcttcttcttcttttttttttttttttttttttggagagataagatatcactctgttgcccaggcagtagtgctggagtgcagtggcatgatcataactcactgcaacctgggctcaggcaatcctcctgtctcagcatcctgagtagctaggactgcaggcatgcacttccatgcctggctatttttttatttttattgttgtagagatggggtcttgctgtgttgcccaggctggtctcaaacttattgcctcaagctgtcatcctgccttggcgtccgacagtgctgggattacaggtgtaagtcaccatgcccagccgacttaagttttcttaaggatttattatactttaaaaggcagaatagagttaaccgtaacacagtctcgtaattagagattatattgatttcttgttggaagtgccagaaggtacccattctaacactgttttggctgaatcttatagataaggatggcactttggaaaaactaagggtaagatggtacatgaatggttaaaaatctgaatcagctattagagctgaaatcaggtgggaccttctaaattttagatccagattctcttttagggaatagcttttatggaaagggaagtgaaaatatttttctgtagtctgctttgtggtatgaaatactgttgatcagacgactgctcaggttcaaattaacagtgactaaagatgagatcagtggttaaatgctgacaaactgtcatttagagattcacaaattgctccaatgaccaaaaaggaatttaaatattttttatttgtatcagctgagtaagacctctcttggctcctctcttgacctccagaatgaattatttaagtctaatgttttttcttaccaggagagttacattatcctacttggctgcttatatcaagttaattagaagattgccaatttccccactctattagaagctatataaatatcacaattaaaggacaaatgatggctctgctaatctcaagaatttataatttgatgatctaaagatttatttaatataagaatactttaacaacataaatttttgttcttagccacttagtttagttcatgttgggatgaaacggctaatttgaactttggttaatttgaaaatgtagcataatacagttcagacttaagtactcttattttggagtactgttcattacttagactgttaaattaaacttctgtgagcaaaacagttaacatttattgaatctatgtttcgggcgtcaagctttccatgcaacacaccttacttttcacacataattaattgttccttattgttccttcttcatctgtaaaataaggataagaactagacccatttcaaaggcttgtttgaggattaaatgaaatgtatagaaagcacttaaaacattatagagtaagcactcaataaatgtaaaatattaaaatcagctgctttgaccatcaaaaaagttatatgttttgtcatgttattattatgtttaggcattattgttatcccaactcttaaatgggcaggaagctcacataactcataactaacaaagctgggatacaaattcggttctgtttggttttagggtccagtcttttatcttcattcaaagagataaatggccaatctatatatctatatctatctatctatctatctatctatctatctatctatctatctaatctatcttagtttaaggtattctgaattcttcaaacaatttctgccatgaataattccatccctaccatcactattctggctcaggcccattcaactttctcccattccttttttattttgttaagattgattaggttttggtggagtgtctactcttaaaacacaatatccagttctgtggttctaaaccacagtgaaaattgcttgaggtgccacaagtaacttttttcaaactagtaaaatagtacaataaaaatctaaagtttagaaatgactttttaaacctaaattctagcagatacaagattattcctaaaatagcaacccattcactccgccatgatcttatatgctttcttgagagggaaagcaatggtggagctgcaaccagttctccagcaaccttacacaaagcagagacctagcaccggcacattcccagcacagcctcttccattccatccatcatggaggccaggtgacaggcccagaatggctgagcaaacccatccctcagctaagcctctgtggaggttttctttctgccttaattgaccagataaaaaagaagtattaatattacctagaatcatcagataccctgtaattttaagagcaattcacatagttttcactcttctgacatgcgactacattgctgtttactaagttcattgtagacatgcaacagcaacaactgcaacaaaatttccagatgggactttaataccagagatatgaggggaaatttctagtagcttgaattactaaaatgatcctctgaaagattaataaattgtattttggtgtactttgtgtagaaggctatttgttaaataccagttcaaggtaaaaggatgtttaattaaagcttcatattcatgagaatttaacaaaacaatcagccaaattgttttactgtagttgtgcagcagttaactgaaacttacataacgtttaaggctttttaccccaacttcagaccctctgaaacaaactccacttggtttaacctcaaaaatactgctttagacaatttttttaacttctgaagagcaagaagcaaattttatgatatcggttttgcaaataaaatgttgtcaaagaatgaataacaaatttgttaattttataaatagatagtattacaaattctatagctaagagttattttgtaatccatgcatatggagaaaagaaatagagacttgtgggggcggttctttttttgatttttgttttgttttgttttgtttagagttgggggtctcattctgttgcccaggctgaagtgcagtggcaccatcataactcactgcctcaaactcctgagctcaagcaattctcccacctccaccaagcctggctaatttatttttatttttaattttttgagacagagtctcactctgtcaccgaggctggagtgcaatggtgcgatctcagctcactgcaacccccatctctggggctcaagtgatcctgccaagaagcttgatgtgcaccatgaagcctgcctaatttttgtattttctgtagagacagggttttgccatgttgcccaggctggtctccagctcctgggatcaagcaatctgccagcctcggcctcccaaagtgctggcattacaggtgtgagccaccatgcccagctaatattttttttaattttgtgggctgttttttgaggtatttaaataaactccatgttacatcttcatacatcattattagagagaatgctcaactaaattgttacattctttccacagcacaatagaattacagaataattcaaagcaaatacaaattattttcttagcccatcttcttaatttgtaatattgtcccagaatacccttccagaataaattaacatttacaaacaaatgagttttcaataaggatacattatgagtgtgaggttgagcaaagataaaatactaacatttgtgtagcaatgtgaagggctgctgagataacagtaggaaccaaatacacaatcaccaattcatgtggctcaagggaaataaatatgaacattcctgagttattggccaagattaaggaaatacaaggtttttttttcttaaggagtatgaaaaggtttaggaaacaggtaattttttgcaagtgataaaaaagtattaagtgcctggaatgttggaataaatagctatgatcgaagtagagaaagatgtgtttttaaggaacaaaagctccctttgttttgttccactctctgtggaaatgctttaagacttagccctgaggactgtgaagcatcagataagttgtgatgttctcccatgtcttcagcatgtgacccattcacacagaatattcagatacagatatgggttctaattgccaagtagtttacatttccctagacttcattgcaattgatttaaaaaaatggccactttacggtatgatttcacttcgtacaggtacacttttggcagattcagataaaaagaaatcattcatatttattatcattctgcatgttcagcctttttccttccttagaatcagtcttgattacttttaaagggactttactaatctttatcttcctctccatcctgccatcactgacctgcctcaatccctgttcaactctctcttattcagtctcctatgtggattgtcccactgccttctgtcctctgcgcagccacaaggcagtctatttaggatgcagatctgtttctgtcaccccactgctagacccccgcagtggctcctcacaaccagcctatagcagacaagcttttattagagcagactatactccttgtgtgcagaagtggtggttatttgtcatctactctgcccttgagattctcaactccactccagcaactctgaacttcttgcagcgtcctgcccttcccagcatcttatctttgcccatgctgctctttatgttcattctctttcctcttactctaacttctccttttagactcagctcccatatcacctcctccagacatttgttgaatgacctttgtcaatgagcccacgtcctggcatatctgaattactgcacttctatggctggtttgtttgttttgtttttgtttttgttttgtagttaagtgtctgtctcctccagtagtgttaatttctgagggattggaacaatgtcatagtaatccaacaaaatttgaaaggctgaaaatagttagttaaaccatttcttaaaaaatgttttatttggccagaaccaaggtacacagacataaattcctgtaaacaagcatttgcaaagaaccccagttcagtctataaagtagcaagtttaggtggtgtagacgtatgtcagtatttttaagtattccttcatatggtctgattttttaaaaaaacattttccatttatcgaattctatttgtgatatgtgcttcaattttgagctagattgcaagaatgtatatggccctgcaaagaaagtaattacctaggatgaagacatttgatatatttgctgttcctgtgaaatttgtaaaactactcattccaagagattttctcttaaaatgagatttttagaaagggaaaattcattaaatagtttacttgtggctgcttttaaatactaatattttgtgctatactttgtgtgccttaaaacatttggcaaaaccatacttttctacgaaaataaaaatgagtcctagcttagttctttcttaatactgacaactgcatttaacgtaggtgttaattttgttttggaatttttaacaacagtttctgttctagggttgaacttcagactttcagatatgattttattatcaaaaatcaggctttgggcaaggtcatttcctattttcctctcttttatgtgtgtaattataaatctttagagaaatattcctccctctgtttatggagtaacagtaaaatcatgttaaattcatttttgaaaattattttctaaaacctccaaaagcaagctgaaatatttgcaggtttattatttaaacctttaaataatacattcacaatgtgcatgctctctttgtctttattaattactctgggtttttttttcccaatttcttggaaattacctggtgagaaccctgcaggactgcatgcagaggtactcagtaagttaatttaggcaactgcagtaatggctgtctttgcttagcatgatatatgaaatattttgcaaaaaataaaatcacatgtagaatgacatatgcctatagaaattctataatttgatgggttctttcctaagaaaaaggggatattaattgttataaatgataaaaaaaaaagttacttccattcatgtaaatataaagtttcctctttgcttagaattaccttttaaaacatggaatgttactatctgatctttatgtatcttaatcctattgcaaatcttttgatttggtgatacagcaaacaacatgctatgtctttccctaccccactaagtttattacatttaaaagataattataatgctattgcattaaatgtataagttgtttacagagaaaatgttaactttgtaaattttgttatgcccccctcagttcagaaatgtggaggcacaccactgactacacaatagcttagcccacctttcaaattatttctaatatgattctttcatggtgtctttgctccgaataaactgaactagtcagtgtttctccaataatttttattcttttctgcctctctgcctttgctcaatctatttttccatctgatatgctttccttggtgttcagtgcaaatcccaaacacatcattccccttaaccacatagggaggtggtgacattctggatacttccaccatggggcgtactaaataactgcttattcacttcagtctatatagtctagttgtgagaactgatatcctggatcattagaattcactgcgtgtctgtcagttatcaataggttaaaccgcagaaaataaagctagaatatgtctttgtattgaattcatttattcttttttcaatgtttgacatgtatgaataatacagatatactttgccaagatatagatgttagaattgtctctatagagtgaaagaaatacaagttgcttctttgtgaaagcttcatgctttcttaaaacaggaaactttaagtaggtgcagattgacatgttgaagcattttgatgcaactattcttaaaaatgcctagaggttttactgtccaaattttttttttgttttttgttgttgtttttgtttttttttttgttgttgttgttttgctaaagcacagctaatacaataaatcaaaatttgtaaaatgtaatctcttcccctgtaggattttgtggtccctttaaaaaataaggtaggaaagaaaatttcaaagcaattatcagacctaatttttaacacaaaagagctgtcagattttatacccttattactttaatctgggaggtaatttgttgtattgttataatgttgacaggctcaaattccctgaaataaattatcagaataagaagtgtagtataagatagaaaaatttatttttttgggtattgcttcttaccaaaaagaaatgagatttgtgtgtgtgtgtgaacatttaaacgaaagaaaaaataacaaactattaaaatgtagtattatgtttgcataaattgattttgcaataaatattggacaaatctttgctgcagagctgattattttggaattttgattaaatgaggcagcaaaagtcagaaatattaagcactataaaaatgaaatttggttaaaatgtcactcaaggtatagttatgtcttttctttttatcatgaattattgaatggatcaaaacagaagcatcttatctaccactgtaaatctagccatcattatttcttattttattaaagcagaaacattaacatgctttgagtacaaattctgaagtggaaaggatgttttctgtgtaagatgaaggattctgataaatttaatattttatatttaatattttataaaatatcttgttacaattaaaatttaaaagatgccttgctttgcttatggccctgtggtgggtactaaagtatttcttatgtgaataatatgttcatatatatgcataattttataactgaataatctgagtccatatgtgaatgtatatatttacatatttttaatcagcttaagaatatcaatctggaactatttgtttcttattattcccatgcccaaatcacttctcgatattggcttaagtgaatgacaaaatattaactactttaagtgataggttctttaccttagtcagttcctaatacagcaacctaaactgatgtcatagaggccttccttgaaagcatcaaggtgccttctacatatctgaatgaaaacaaaagcataatttaaccgaaaaggagactgtgactactgcaaatgttcataaaaagaacaaaatagttttctatagtaatccacaccatctgtgattaaaaagtatcatctttactattccctcttgtcaaaagaacaatacttagaaccacatgtaataattttccatgctcattcatatatataaacatgaagacacatatagcaacataatcattctaccagtattatacttttaaggaaaattcattatcttaactgtttcttggtttttatatcagggacaaagatgtttagctaacatgatcatacaaactatgagtgtgtgtatatgtgtatacccatttaggcatgtgcaccagccaaggttttcaactggaaatgacaattagctacttcataaatgcttttggctatgcgtgcatattcacaaagccacctgctttttaaaagtattgaaaatttttattactaaatttcaaatctggattttacgaatgttgcctatcctactagagaccagtgttgattaatactcttttaaatatcaaggcagaaagcccaaattaatattagcataattaatataaatcagtactaatttgtattgataatagggatgttctgtatgtgatcattgtgtcctgtgtcctcacctgcaggcattatccttatatgtgtgtacatatatgtttatttcagaattttaaaaatgacgttgttatactttatatctggattcagtagggaatgaaacaaagtttatatttgttaattgaaatgcataatattgaaaactatccaaaaattgccttgagaaaaattatagccaagataaaatgcttaaatattcaatttatttcatgatccttgaatctcctggaacttaaattatatattaacctgataatagttaacttaggacagaatgtaaactagatcccacttataaattttatgtgcacatgtttaaccattcatcagacacagaacttcttttattttgagacagtcttactctgccacccaggctggagtgcagtggtgcaatcatagctccctgcaacctctaaatcttgggtttaagagaccctcctacatcagccttctgagtagctgggaccacatatggtgccaccacaactggctaatttttttattttgcaggctgatctcgaactcctggcttcaaacaatcctcccaccttggcttccaaagtgttgggtttacaggcatgagccactgcctcaagccagaatgtcttgatgaaatctgaattaaaaagattttgtttccaccagctatccagggcaaaacagagtaggaccacattaatccttgatagtagctctctttactcttcctagatttactcttagatctgtacttctgaatagtctttactttcttaatcatatgacctcctacaataaggtttttgttttatttgggttttcgccaatgtatttgttgatatttaaattttaattgcaacaaaatgacaaaatttcatgacttttatttttttcaaataatttttcacattaagacatattttacatgtattaagatatgaaatgaaaacagggtggagaaatatttggaaaaatttgattatatgtattaagatgtgaaatggaaaagagggtggggaaaatttatggaaaaaattttgaagtataaaagggaaacttcttttagacgttcttaaagacatgaaatcacttcgaattttactctattgcaaagagaagaaaaagctacatttgagcttattaagcaaatacatttttgggttgggtggcagcggggacagggtctcactctgttgcccaggctggagtgcagtgctgcaatccacagctcactacaacctctgcctcatgggctcaagcaaccctcccacctcagcctcctgagtagctgggactataagcccacaccaccctgcccagctaatttttgtattttttgtagagacggtgtctggccatgttgccccgcctggtctcctgagctcaagtgatccacctcccttcgccttctaaagtgctggaattataaaagtgagccactgcacccagcccacaaatacttttttttttcagacttttccctaggttgaaaaacaaatcaaaatggcaataggtgtaactactcttttggctcaagtacttttcaggaagtaatcaggttcctaccatgatatggtggaagagaaagatcacaattctctaaaactttgcaaatatgatatatatagtttttattaagttacttctactttttgacaaattccaaaataatctaaatataatgttgatcagttttgttgaactcctgtcctcaactgatccacccaccttggccccacaaaggtgctgggattacaggcatgaggcaccatgcccagtgatcagttttccttccttttaagattctctaaaaatgaaacatgcataggaaatatatctactttcttaataatacttggtttgaactagaagttattctcaaagtgtgcttttattgccttgtttttaggacatttatttcaatccatacaaaacatccaaataatttggtcttggaatcccattcattagtgaactaaaggaccatccaaaaaaataacagtctggggttacacttgatccttggagaggaaatatttctagaaatataaattctgtcattctcttttctcctgtaatttacataacactctgatggcggttttatggcccctaacagagatttggcccagaaaagagatgcttaaactgagggtatacccctgctaagtcaaaatgaattgtgaaatcactagaaatggctacaacttctcttcatgttctgcaaattgtttcaagatgttttctataaactttcactacttttgctttatttttatttcatttaacaaatatttactaagaacacaccatgtgctagccactagatcttaagtgccaagtcactggtgagcataacagacattcttcctgtactacagagattaccctctggtggagaaaacagtaagaatcaaataaccatgcaaataaatacacccattaatttattaaaaaaatgtatattgagcgctccctgtgttatgaatctgtactagatttgtggaatatagtacctgaacccatgaatcttacattctggtgcacaaattaaacagtaagcaaataaacaaataagtaaatattatcatggtgggtggtgatatgaagaaaaataaagctatataagggcacagaaaatttgaggggttgaaataacatgtttagagaggaatggagtgagtgagggaaagaatggtaacagataaggtcagtgagataggaaaaggcctggtcttctacatggcaaacagtgcttgttattacaaatggtgaaagtgcactgtaacaaatacaagatgttaaaagaatggacaactggaagcctacccaagggaatcaggggaagcttctgttaagaactgaattgtgtccccccaaaatacaaaatttatttaactctcaatgtagcaatcagaaatcaattaataagctggcattggtaagttcttaccattcagtaattactttgaatgtaaatggattaaattatccaatcaaaaggcatagagtggatgactggattaaaaaaatttaaaaagcaaaacaaaacaagacccaactgtatgctgcctacaagagactaatttcaccttaaaatacactcagactgaaagtgcaggaatgggataaattattacatgccaatggaaataaaaagagaagaggggtagctatacttatttcagacaaaatagactttgggtcaaaaactgtaaaaagagacaaagaaggctattatgtggtgataaaagcgtcagttcattaagaaaatgtagcaattgtaaatacatatgcacccaacattggagcatctaaatatgtaaagcagacatgaagagatttgaagggagacatagactgcaacaaaataatagtgggggacatcaatacccccacttttaacattggacatatcattcagacataaagtcaataaggaaacattggacttgaattatactttgggccaaatggacctaacagacatatacagaacattctacccaacagcaacaggatatacattcttctgaagtatacacagagcattctgcagaacagatactaggttaggccacaaaacaagatcaaaattaagatccaaatcatattgaatatcttttctgaccatagtagtaggaagctagaaatcaataagagaaaggatcatggaaaattagcaaatatgtggaaattaattccccatgtgactgtgtttggaaatagggactttaaagaagtaactaaggtaaaatgaggttgtaagagtggggccttaatccaataggactggtgtcctccttatcagaagaagagacattaagaataaatgtacacagagaaaagaccatgtgagtacacagcaagaagtagccatttacaaaccaagcagagaggcctcaggagaaaccaaccctgccaacaccatgatcttggactcccagccttcagaaatgtgagaaattaaatttctgttgtttaagctacccagtctgtgccattttgttatggcagcagtagcagactgataaaaaagagttaaccccttgaaaagaagcataaaggaacaacatgtgaaaagcacttggtgcatttgagaatctgaaagaaagccgaagctagagatgacacatgagagtggtgcctggggagatgagagaggtagagggaagccaaatcatacaaggtctggtggactctgcgaaggattttggcctttatcctaaagggctgacatgatttgatctgcatttttaaaatcatctgactgtggagaattggagtagggaaagtgtaggtgcagggagacctatccaaaggtcccaggtgataaattacgctagatttgggaaggtgacagtggagttggagagaagcggattgatctttaagaatgaatttgttgggacaaggatttcttctacatttctgggtttttcagatggaaggaagttggtgccattttagaagtggaaaacactggactcacaattttatccccaacttgacagttccattttggccatgctgaatttgagatgcttctgaaacatccaagtggagaatcagtcagtgaatgaatctggagctcagagaacagatggactggaaatataaacttggaggtcaaagcatatgtgtagtaatcaaaatatgctacagtttcagttctctgtggacagggattttatctgttttgttcactgatgtattcaaatgcatggaacagtgctggtatacaggaggtactgaatacatgtttgttttaggaatgaatgaatgaatgaagaatggatagattacctaggaaagagtttgacataaaatgagaaacagatctagaataaaaccctggggaacacctacatttataggcttggaagaagagaatgaacttacaaagaaatagcaaaggaattgtcacagacagaaattcatagagtccaaggtttaagaagccaggggaagaaggcgcttcaagaaggaaagagaatatacactctgaagtgagtagcatgcagcagcaagcctagcatatgaatgaacacttccgaatcctaaaagcaagaccagctttaaaatacttaaatctgtttgtcactgttgtcaatctttgaatctaataagatttaatttattttgtgtaagatttacctcagttaatagccgcttggaactacctttgaaagcacatctctgacacattctcagcctgggtggatatacgataacatcatcattctttgtattaaattatgaccataatgacagttggggaaaaatgtcagcaactaatagaacaccaataggttttcttgacaagctcacttggagtatcctctctggatgaaagctcaataattttttgctttactacctcctcctgttacttcactctgtactcccttatacttctgcataagaaaaactttattaacttcatgcataaccacataatttgagtcataattaagattcagatgagcagtaaaacaattttatatcaccacctgtatataccttctaaaaatagatgtttattagttacttagttttggtcagtcttcccttggaagataatctacgtggcaacaaaaactttctctctcctgtttgctgcattcccagacccaaaactgtgcctgatgtattttaggtgctcagtaatatgtacataataaataaatgaatacatgcttaaagtcgcacggcaggaggtagatataaaaatgctggttgggtttgcagcttagtcagagatgcaattcctaatatcaggttacacatttgaaatccaagcaaacatcttggcttgctaacatctctggctgacttttaagccccagccccatttcggatgtttccacatgaaagccaaacaggcattttgaactccaggcgtcccaaacgtgactctttccttttcttcctgcaccacccttccccagccgtcataagttcgcctctgaaaggcttttcctatctttgagagaagcatcaccatcccatcaacctgttcatctgagttacaaaaattttctaccttcatcagaagtccaaccaatcaccaaattctattaatttggcttctacaattttttttcatatccaccttccaaatcatcttggttcatagaatgatttgcgttttcccagcagttgcagtgatctcctaatagttctggtgcctctggcctctctcttctccagtcaatattccatattgtcagccaagatttgctaaaataagaaactgatacaaatcttcattaaccaacaagagaacatcagttaagttccttttatgcatctattctaggctaaaggaataagtgcttgaagcccacagagggttctttgtcttagagaggggcatggagactagacaggcttatgtcactgcccttctcaggcttctcctttacagtagagtaaaacttaaccacttaagatgatattcccagacctttaagtgcagactctcttgcctttctagcttcatcccgtatcatttccaaaatcctaaatacagtctacctggatcctgtgttgtgttgagagagttatgcacttccatccggagttatgcctttttcatctcatttccctaactggaatgagtttccctttcccctacgtgcaagataaaatgccattcattctttgaatctcaactcaaatgttagctcacctatgtgtccttacccattacacagacttcatttatttctctgtaagaacaattacaactgctgtggagcagattctgagcaacatagagacatatgttcctagtgagtccatttgttgttgaaggcctcttcttactaagtcttaatctctacctaattaactatcttaggtattaagttcatatcaactgctatgtttgtaagaatttcctagattccatactttatgctctctaaagcattgcccatcattgtgcaatgctgcaatacctgctttgttctttatttgtaaagttcttgtctctgatctgtagcaatggaggagcttgtcataacccttttggtagaaaggctcataccatctttggagttcaagatggaaatggatcctccactaaactgaaaaaaaaaagcctttataacacatcccatgcaatattgttaaatactctgcttttccttttctctctgatatggcttaggaacagttgcttatataattcatgcttaatattgtgtgggttacaaaaggacatgaaaatatctttttatcatgagtatggatagttaccttgggtattgtttgatagctaaagtgctttcactgatgaccatctgaccagtttaattgtcagctgatacatgtcagaactccttcatatactggctaatttctgtcagtttctaaatgataactgctaatgtcaaggcagttcaaaaatagcaaaaacttgatttcctcttaatatcttgaagatcatattcatgggcaccagcgagtctggaaaataaatctgatggatttttctcatcatatttagaataaacaaattaatgctagaaattgtttctaacaggagataataaaggaaatgggcaaacaaaaataaatatatagcttctgtgagccaattgttttttgtaaactggatgagatttttttaatgtaggcaagaattctaaaattatacagttaagctaaataacatagtatttgttcctgtcataaattgtctttcaattgggaccaaaattggtgtttaaatgttgtattataaagaagtgcatgcaaactatttattagtgaatatttatttaatttgacagaggtaagtgagagtgttatttatccatagcctggccaatttcaggcaagtaattgcaggatgaggagtaattccagtccctgtacctgctggtgagatcactgaagaactcactcagcgtttgtagcacacagaatggccacggttacatacctgagtgcattcacagtataaccaagcccaaatcctcggccaaatccctaagggaatctgggttttaccttgcaaactttggctgctaggcacagttacagagccttgttatgctttaggctctcaataaaaatgtttgccctgggttattacaaagactttcttggtacagaaattcagacaagatcacgaagcacagggtgaaaatacaggaatgagcagaaggagccaattctaaagttttctgaagtcagctcatgccttcataaatagtgagcctccttggtcgctcactgaaacaaaaaagatggacatgtaatttacctagaaatatggatgcctctaaattttaaaaaggaaaatcatttaaaacatgacacttataaagtatcttaagataatatttggttttatactatggtattttaatgataattagagaaattcaatgctatgaaattctaatgatattccgatactaactaggataattattttacaaaatctgaataatataatctccatttttcatcttttaagaaatatctacatataataattttcctttgttatgtatatcaaaattcaaatgtttgtgattgatacttatgttatactttttactgttgatcttaacaataatcactctaataagctttctacttatgccagtgataatattatagagttcctcttccacaatttgcctttgtaatcaagttatgaagccacataaaaattcctaatatgttatagttgcatcttgttcttaactcaaatgtcattgctcatcttgattatttatgttgtttatcataaggaattccaactgatttttcacagccccccaaaataaaatttgtcccttaagtttacttaaaagaataggacatacttctgaaaaaagtaaaaattgattctgaaatatttaaatggctgttcatgagaataaatgcataacttcacaaagtgactatttcatacaggaaagcaattatttggatgtgtaaggcatggtatgtgtggtcatactttttatctgcttccttataaatgaattaccatattagcatgaaaaaattcttagcatcaaggaggcttttgttttaattgctggttttaagttcatttgcttagctgaatattcatttggcttttgtaatacctaaagcagtgggtgaaacccggctctaggggcttcttcatggcctttaattgtttcaggagaagctttactttttatcaattaatcctgggtaccatattttgtacagaagattgaattttttctttttacacaggtaagactggtttagtgacatatggccatatatagtaggtgtttaattactatctattaagtggatgttggatgtcagacatgaactgtcatatttaggttttctgacatttgagagaagcattcaactttggtgagataagagagaagattgtgttttcacaaaagcaccctttagagaacagattgcagggatgtgtattcataaagtgacgtataaacttttttctcatctttaaccactttcctcaatgccatctcaaagcagcaacttaaattcagttatgcatttgatccacacaatgtttattaaacacctactccatgccaaagagtcttccagggatggggaaaacagagcttctatggagtttgcattctaatggagggagtgataataattctcaaagatgctgaaattcatttgtgagcatgtttctgattattgacaaaatgtgagtcataatccccatgtagtggaatctcactggcataatctgatgagcttcataaactgtgtcacagcaggaagtgccagttatttagtttgagcaaatctagacaatttgaatgtctaacacctagtcttctttcacccatgttgtaaatgacctgcttaaaaggaatggttgagccaatcaacagtaagttattgtatatctcaaaattgctagaagaagggaatttttatgttcccaccataaagaaatgataaattttaaggtgatggatatgctaattactctgatttgattattatacaacatatacttgtattgaaacatactgtatttcataaatatgtacaattattatgtgtcaaaaattttttaaatattttgaaaagagaaatgggtgaccactctagatttcacaggaattaattaccaaataacatatcatgagagaacattcttggatgttattttagaaaataacacatgtattgtcagtatgggaacacttatttttggtacagtctttaataaagcctttattcatttatgtagggccttggggctctcaatcttagcattaaccacgtatttaaggggtgataggcacaacataaattgaatcattagtttagaatcgctctccatgaggctgcctgtagatttttgttatcatccatctaagccacagaaataaaaatcgagtgaatacttttgtttatgtaccatgaatgcatttcccaaaagcaggaaaaatattcctagcactaaggaggtgtttgaaaaatttatttattaaggaccatttgtttagtagaatattcactcagcttttacggtacagtactaccaagagtagttggatttctgccttggagtcttccacggtatgacctcacacaactctttctcccaaacatcatatgccagtcattacctgcatatgtctaagagggcaaggatcccaccctctatggccaccccaaagcatacatgcctcatgcatgaggtttattatttacattcttacaaattgactttgggtgaagagtttaccctgtattgctaaaaatttgccttgagtgactttcctgagaaactgaggttcccttggcagtcagtatttactgattctaaattccattagaaatccatgatcttctaagaaagttcctctaagttgatcctaagaaggtatgaatagctaattatgttatgatgtatgcctctccctttgctggtctgcatgttctgcttgccagttttccacctgcagttggtggcattaagcagcagctgcattccttttatcttggttttcaattggagattgaggagctaagccaggtcttgagattcttcctttctgctcttttttttttttttttttttttttttgacagagtctcgctctgtcgccagactggagtgcagtagtgtgatctccacttactgcaacctccgcctcccaggttcaagtgattctcctgcctcagcctcccgagtagctgggactacaggtacgtgccaccatgcctggctaatttttatatttttagtagagacggggtttcaccatgttggccaggatggtctcaatctcttgacctcgtgatccgcccacctcagcctcccaaagtgctgggattagaggcgtgagccaccgcacccagcctctgctccatcttatggtcttatttgaaatactttcatgcatttggggtacctagacaaggagagactaaacaaatgatagtttctcctcagcttccattataggttccattttaagcctgctattgtatatcaattgctctttttttattgaaatgtaaagatagtttaattttgttttataaaaataactcctaagaaatagttcaaacatggatataaaatgctgtcaatggaaaaatggagagaggtagaggtatttatatttagcatttatttatttcttcattcaataactgtttactgagaatctcctatttgttgggatctgtggggcataaatagataagatataattctacttccttagaacctgcagtctaaatggaaaaattctaatcttgccctgaaccagcaggaatctgaattcccgttcagatatttagaccaacttttctgatggaaaagtattctgtcttcactgtgaggcatattttgaaagactgacaatgctcattgaggtggaagacagaggcagagatctctctgcattaggcatcccttgctgtttccattctacctgctgtttccaaagataactaggctcagaagcccctctctcatgggtttctctgagtacatcccaatgttcttaagtaatgatgaagtaacaggaaaaaaaattaaaaaccaaagttcagctatataccagcaatattccatttaattctcttaacaatgagatgatatagatatttggctaatgaaaaacctggatactaaatggccaagccaagccaggattcaaagccatgtctatgtgactccatagccttgcacttttaaagtcctaattttggggcctcttgcttagagatacttctctgtgaaggtggcacctattcttggcagtggtggcccagtgagccctttgtgggtagctcccataggttcctctcttgcctctctggtaactcctttgctttctcaaacaactcctcagggattggacagtgcagtgtcactctctcagcaccagctctagaaccctctaatgcaggcagttctctagaccactcctgaggcacttactcagggactgacaccccagacttggggcctcctgtcttgagaccacagagctggagtttatcaccagtgtctcaggtcatcgaataatttggcaaaatctcatatttcccttcatcctcatcctttctatgcctgatatgtacactaaactctggtggggactcagcaaacatttgagtcaatgttagacaggtgacccgccgccatatctgttaggcatgcatgcaaggcagtgctcatcatcatgccaccatgtggcctctggcagtgtcctttgtcccattctgaggaactgcaggcactgtgcttttgagtcacagtgtatcaactttttgtagttttagtatcatctccgttgctttttactgctataagtgcacagtccacttaaccttctggcaagttagctgcttttaacctgccatggaatggatactcaggtattacaatgcttttttacattatacttaaaaagacagatgacaaaactcccaggaaatgacttctctatgaattagtgcatttttttaagttttgaatctaccaaattaattgttgcctgttctaggggcatttttgcttcctccgtggttctcacttatatcatgttatttgtgttgctgagtctttggaaaaagtgattgcaaaggctgttttcttttcccttgttcccacagattctagatgggggtttgaccttgtgattttctgcagtttctttcctacttagccatttttcagccaaagaggtttctgctaacatgtagaattccttttatgaggaatccatgctatcatcagtgcggagtgatatgtgagtcataattactatattcataaaactcctagaaatgtagaatgataagatattttacagattagtttgtctcgtcttcttattttcagtctgagaaaatgcagaccatggagattaagggatttgttcaaggtcccagagatagtgggctccaaatcagaagaaaatctcaacttctagctctaagtccattgcttttccctctctcaatacctattgcttcttcttaaaaagaatcaggaatatctattaaatgattgtagattttatatttaagtttttgagtagttagtctcctgtaggtgagcattccttggaagacaaagcagcaaagtcaaaaatgtatgaatttagaagccagacagacaataaccaaatagaggttctatcatttcctacctatgtgataatggaaaagctattttccattatttccatattttatctacacctcagctttctgatctgtaaaaactgagattataacatcaacatgtagggttactgtgaggattttaaaaattaatattatatagtgtttagaacagtactcagcacatagtaagtattcagtcagtgagatgtgcagttcttggatgtcttcttcccctttatctgaaacaggtaactttttttttcctttatgcttaaaagagtgaattttgttgcagtgttattattttaggtttgtgataaatcttacaaacaaactagtgtgtaaacaagcttaaaatacacttttgatttgcacttttttttttaaagtcctgatctcattcccctcatagactggggaaagagtgaatgtagatttatgaagacatttacatgtcatagcccagcatttcccaaactgtggtcttggacttagaccacttgcatcagaatcatctgtggggattgtttaaagaagaagattcctggactccaccacagactcataaatactgtatcttcatcacagatccagtgatgaagaggcccaggaacctctgtgttataacaaacacaaaatgtgtttttatacactaatttttgagaaccactgttatagatgaattgccagtgaaactccagattacttgaccaaaaatattactttaatcatgctacttccctgttttctcacttgtcttcaattggccaaggagggctatcaggctgtgtgaaccttatggctgtcctaccttatggtacactgaaaatatgcccccaaagatgtccatgtgcttgtcctcagggtctgggaatagggtaccttatttggcaaaggaactttgcagatgtgcctaaattaaagatcttgagatgggaagattattctggattatacaggtgggccaagtgtcatcaaaagggacttcaaaagagaaggaaggagaatcagagttaatacatgatgacagaagcaagagactggagtgatacaaggaagggatcctgagctaaggaagttgaaaaaggaagggaaactgattctcctttcagagtcttcagaaggaaccagccctgctggtaccttgactttagcccagggaggctgattttggacttctgacctccagaactataagataatacaaggcatactgtccctttgctccactctgtccactacttctatgactttttcaaagttctgaataaaacctttctcttgcctaaaagccgtccttggcccttccagccaagagttatttccccttctctgaagttctaagtcaatcagaatctgtgcaattattgtgcatccagttatgaaaagctctgtctaggagtgtttatatgcaagatctttcaaatcagaacacccaggtttaaatcctgattctgccacaactaccttggagaagtttcttagactctccaaatctcattgtcttcatttgtataaatcgcatcagatggtgaagtttagagatgctccacctagaagtgaactgacatggtggctgaatcagagtcaggacttcacacatgtggcaatcatgggaggcattgttccttcggcatagctcggattattgtcataaacatgactattcagaccatgttgttgacattttattaatatgttcatgtttctgtttccctgttaatcccatgaaattaagcatgataataattataatgacaataataataataatagcaaagtagtatagtgaaaggagtattagggtttggttgactttttttttttttttttttgagacacgtctctttctgtcacccaggctggagtgtagtggcacgatcacagctcactgcatccttgacttcctgggttcaggtgatcctcccgcctcagcttcccaagcagctaggactacaggtgtgtgctactacacccagctaatttctgtatcttttgtagagatggggtttcaccttgctgcccaggctgagctcaagcaatcctccctgggctcaagcaatcctcccacctcaacctccccaagtgctgggattacaggcatgagccaccacgcccagcctgattttggtagtcttttatttcacttctagctttgcaatttactggaatgtggaaagaaaagaacatgatttatttatatttaaaatggaaataataatggtacttactcttaattatttcaggatgaagtaagatttcaggattaaagtcttagagtacctaacacatagtaaaaatttagtatgtgttaacttattaacggtaattggtatctaattttcttttttatttgtttctattctatactatgaatcttgatatacctgttactttatatatggcaataatatgagaaacaggaggaataatactggataaacatctaatatttaatgttatgctttgctatcatatgcgttataggatataaatctcacagacagggtttgctgttggagcaatgctcatgctatgaatgtatgcaagaaacacataaagcctgcctaggaacctctattctcccctcactttttttgcttctttcttttcctttttccttcctttctttctttcatcacaggtgatcatataaatagtttggtaccttaagtactttaaaatccattggattttggagcaatttttcaaaatttttcaaatttttcaaaattttggagcaagatttcaaaaaaaaaatctatgattcaatacattgccattcatcattaccttccctttacaacccttcatgctattttagtgcagatgagaactctcctattgtagctagtttgaattcatttttcaaatgagaattcatgagctactatgctaaaagtaaggtctgttacatcttctgcacttccattgtctgctaatgttgtaatatgatttttaagtaattgactttcttttgacacgctttcttatttagaaactcaggcttatttgtaaatctgttatctctatagatgtttatatattttatatagatgttttctctgtggtttgttccctaattattttagagagtcttggaattacttatttttatgtaagacatataaaatagctccatatgaccaaggaaatgtgatacaaaaatgctaggaaaacttggtagtaatactacttttgtggttaaaggcaaggaagggaaaatcaagccaattcctataagaagaaaaaagtatacttgaatatactaaatagatgctccttgtcatttaatatttttaaaggaaagaaaaattacctcttcttttttcttttgcttcttttatccaaagaaagacgtaattttataaataacttgcaggattaaatttacctgaaaggcaattgggagtttcccctctgacctgtggaatagtccgttctttctgtattcttcctagaacataaaaggggtaattgcagtggttgtaagctccccctagaaactttttctagtagcccagtgccttggaaattgtccatgaacttacacacacacaccacatgtgaatttaatatgagaaatggaggattcgtttgaaaaaactataaaacatgtgctctcttgagagatttatgccccttgtgtccctccttggccactgtgcatgagtgccatggctgagaagtaaaagtcagagctgaatgaagcccacattactttatagacttgacgacctgtggttttactcatgaataagcaacaactcatgcttgtacaaaatgcctgtttgtctgggtctctctcagttaaaaagaggtattttaagtcaaatagaaaatatattgtttaacttaccataggcttcagtgcagaaatacaagtcatatattacttcataacatggttgcatagagaagggaaaccatataaacaattcaacataattctaataatgtcttggttcacccaagataaaattaaccacctatcttaaagaatacactacgttaaaaatttatttcttatgtactaaagcgaggatgtatttattacttagaattttttctctgtttttccccaaaatgtggtttctataaaaaaaatcttaatagagaatttggtatcctttcaaatagactttttaatgcagtatgaaattatattataatctagttgatgacaaaattacattgggttatattaactattaatatatatattccccaaatctgtaaactcttaatttctttaatgaagatcaagtagtcatcattttttctatgcttgtacaagttttcccaaaaatgattaatcatattaattgttgttttggaattccacagattaatttaaaagtagtatatgtgggaggacatttcttgaagaagtgtagtagaaaaagagaatttctataagaattatttttaaaggttgaactcacagaagtagagagtagaatagtggttgccagaggctgagggagggagatggaaagggaaggaggagatgttgatcaaagagtacacaattttaattaggcaagaggaataagctttagtggtctgttgtgcagaatggtgactataataaaaatgcattgtatgtttcaaacttgctaaaggatgagattttaaatgttttcaccacaaaaaaaatggtcagtatgtgaggtggcagctttgttaattagcttgatgtaatcattccacagcgtaaaaatatatcaaaacttcacattttctcccataaatatatataattattacttgtcaattaaacatttttaaaatgattgtgtttaatcaccaaagatagtgtcttttattcttagtaacaacctccattttggattagaatatttgaattttatagtgaaaataatctacaaaatcagttatgcatttatcagatagtttataacaaaaatggatgcatcacagtcatagctttcttagcacagttttctgaaatgacttaatcccaaagtaatttacaggcagactaaatggatttattatgtataaacatcctcatctcacattatctaagaaaaaaattgatgtttggtaaaaaaaaaaattaattcacaataataacatgagcccttacacttatcagaaaaacccaggtatttacaaagtatagataaaaatctgttttttaaatttaaatttttttttttttttttttcgagatggagtctggctctgtcgcccaggctggagtgcagtggcgcgatctcggctcactgcaacctccacctcccgggttcaagaagttctcctgcctcagcctcctgagtagctgggactacaggtgcccaccaccatgcccggctaattccctgtattttttttagtagagatggggtttcactgtgttagccaggatggcctcgatctcctgacctcgtgatccgcccgcctcggcctcccaaagtgctaggattacaggcgtaagccaccacgcccagccaaaaatctgttttttaatattgccatattctcacaacaaacagcttcttttcataaattttaaagttcaaggtaaacagggcacctttaaaaaatcttgtgaaaggtgactgccagtgcaggcatggcaaatagggggagatgatcagatgattaaaaaagaatggagaacagattatgaatgttgttgaatacagaaaaaatttaatattctctttaattctgttctgtagttaaaggaaagaaagaacagtgaggaataaaatagagaggatacaaaaagcaggagcaaaaacagatgaaagccttaagttctaatgattttttaatttttttcaaattgttttagagatggggtctcactgtgtcacccaggttgcagcgcagtggcgtgatcaaagctcactgcagccttaacctcctaggctcaagcaatcttgaggcttacttattaaagataaaccactcagatcactcttagtcgtgacatgcagagaagtgatttttttgttgttgaaatataagtcagttggttaactactataatacttcagtaaggatttcagtccttaaatgtgaaaacactttcttgaaattgagtaaatgtaaccattaattttaaactgtgatgagccatataccccacatagcacagcagggtctcaatatgacctgccatgggggcaagagggacaaaaagtgagaaatgttctgagcagtaacttctcgcatagtcacttctagctcctgggctagagattcctaccttacaccttgatcaagatttatgaggaagttaaaaatgcagaaaatgtcaagcccatctctgaagtatgattcccagtttgtataagattgtcatcttataatatctaaacattattcttcatattaaaaatgttttcacatgaaaattcaatgatggcatttatgtactcagtgcccatccctctcaaagaatatccctgttgttttctgaggggcagctactttgatttcacaatttttctggattttttttttcacttttgtagacatatagcagtgatttacaatgattgcctctaaaataatttagaatcaatagctagcaactggtactccttcagtaatgcctcaggtttctggattggtgtgttagttagctgttgccacaataatactgcataatatattacctaaacctgaggggtattcaggaagtatttatttcttcctctcagtttgggtggggtcagctggggtttggctgatctaggctgccttcagctgggcttggcctcagttgcaggttgggtctaggtctactgcaccttgatttcattattcttgaaccaagagctctgtaaggcagagtcttcccatggccttaagttgcaggttgggtctatgtccactgcacctttatttcattcttcttgggccaggagctatatgaggcagggtcttctcatggcaaaaggcagagtaaatgcaccaaagcccaacctggcaataacattttaatcctctgctagtgtacttctgctaacatactacttgtcagcaaaagtcacatggccaagcctaataacagtgaggaaggaaaatatcctttgattccagtggtaggttatgcaaagtcatataacatatggtatagctatgggaaagagtattagaaacaataatgcaatataccatgttccaccttctagatcacaattattcgcatgccacccacacacaaaatagcttacttctgtctcattttgtatataaatataattttaggaaattcccatacttttaatcataagtatgaaatcaagttcaaattccaggatcttattatttatacctgttccagatgcagttcttcttgatctggaggcctgttaatttaaaaaaaaagttatctaatgccccccaacacacactcccaacatgtaatagtggagtactttggtctgtgtgcctctcattgtccactttttgaacagaatattcattgtgattatcctgtgaacaatccattcaaaaagggggacaatgagaggcacacagcagtcattgattggtccatagcaattctgaaaattgccaggtcttcctattctggaagaaggtaatgttctttgattaggtgttacttctgttccctggaaattagctagagagaaaaagagattgtatcaacacttgccttggtgaatgtattcagaagccatcagggtcttcaagacaagcaaagaaaaaaatttccttttatttttgacattttctgtacttcattaatatgacatctcctggtacataactacccaggtcttgagatttctaaagttctcagtgatatgatcttttctttctttatcttactaataaatacttatttaggtttttgcctaggtagcatattttaatgacccaagcatcaaaaagtatgcaaatgtataaagtgaacatgtatttcccaatatatttttatttttcttatctttttttacacacagaatagtagtatactataagtactgcgcaatgttctttttttcacttaatatatatcatagatttttccatatcagtgcattaagagtgccctcattttttagagctatgtattattccatttaatggacataccattatttattacaggacaaatgaggtgtttccagtgtttttccattacagataattgttgcaatgactaatcttgtacgtgtgtcttttcacacatgggttaatatatttgtaagaaaaaaattataaaagtggaaatgtaaagtcaaagggtttaggaggttttgttttgttttgtttttctgtcacccgggctggagtgcagtggcacaatctcagctcatggcaacctctgcctcctgggttcaagcgattctcctgcctcagcctcccaagtatctgggactacaggcgtgtgccaccacacctggctaatttttgcatttttagtagaaacagggtttcgccatgttggccaggctggtcaaactcctgacctcaggtgatcctccttgctgggattacaggcgtgagccaccatggctggcctggtttatgagtttttaattttaaaagaaactactgaattgccttcagtagaatttctaacagtacttactcccaccaataatataaagagggcttctttatctacaatcttgtcaacactgtgtgttaacaaacttttggaatttgctcaatgaagtgaaaatgaagttgcttttcctttttaagcatgagagagaacttatttcaggtattagagaagtttttgcatttttctaaacaaatttactttcttatactgggcctatattttactgggttgttggcttctactgccttcagtagatattagggctaggcacaatggctcacacttataatcccagcattttgggaggccgaggtgggaggaacctttgaggccaggagtttgagaccatcttgggccacatagtaaaatcccatctctagaattaaagagttagccatgcatggtgatgtgaacctgtactcctagctactcagaaggctgaggtggaacgatcacttgagctcagtacttcaaggctacagtgagctatgatcacaccactgcactgtagcctgggtgacagagcaagaccctgtcactatataaagaaagaaataataaataaataaaagataagtgaatattctgtaggacctgcatatatgccaaggaaattagtcctttttaggttaattgaattgtaaatattttttgtattattgactttacttatattttaaacaactatttagatttttttttgttttctttaatatggattaatttattagtttttctattatggcttttaaattttaggaaatagaaaggccttccaccactttgaggttataaaaagaattctcctgtacatttattctagtacttttgttattttattttgttacattactctctgatcctttcagaatttgttctggtgtaatgtaagatagggattcaacttttttctgtatggccacccagttgtcttagcaccatttattgtatagctcatcttttctatacacatatgaaatgccacttttatcatataccaaaatttcatttattttttgtgtctgtaactttatattttgcttcttaaatttacatctctattcatgcagtagcttcatatcattttaattactgaggctttatggtgttttatgtggtagagttactcattcttcattacacttttttcagaattttcctggctgctcttgtttgtttctttttccatataaactttagaatgagtttattttgttctgagaaaaaaaaaaagtattgacattcagggtgccattacatttacaaattagctgtgaaaggatgaatgtttttatggtacattttcttatccaagaacatagtacgcatttctatttatgtattttatgtcccttagaagcatcttaaaagctttcttcatatggttcttgcatatttctcattaagtgtttttctatttctgattctatttatggcttagcatatgtgatactaaaaaggaaggactccagctgttttaaccctggctctacctccaaattcccacagattagaagaaacagatagatgttataagtaagcagataaaagttttaagtgaaaatgagaggacaggtgggtagagatagcatattaggtgctaactagtttttgtcatcccatccaaggaaagccaccagatttgtctggcacacacaacatgggcaaagcacaatggagatagaaaggactcagaaggcagagcagttgtcatttagaagcagaaaagcagtggatccaagaatttttattaggcttggctccatataaaagctatcccaaataacagtgtctttcaacacaataaaggtttatttttctctcatgtaaatgagttatgggtataggcattccaacactgttatgggactaactaacgcatctgtgattcaggcttctttttttccctcattactatgtttagtgtgtgatctccatccccaagtttgcctcatggttcatgatggctgcttaagctctcaccaacatgcacatttcaggcatgaggacaaagaaaagaggagttaggaaaaatgtgtgtaccttcaagtgaagccggttctcttctaatactttccaagaagtcccactctgtcactcatctcctccttaagtgtacaagaggttgctcccaacaatatagagattctgttactaaggaacaaggagagaatggattttggggagacaacttccagtcctgccacgaggaacaaaccttcaaaaaattatatcctccaaacatgttgagaagtgagaaggaaaataccaagaagaaaataggaaagtgaataaaatgagtacagttcaattagttatcatgttttagaataatttaagacaaactagtgctcagaaaaacctgagctagatattgctgctttgattttgtagtttttgagcttgaaaatgtgttcaagagtaattgaatcacatgttcccttttttcctttggaattggaacctcagtaaggggttaaaatacaatccccaacaagtacagttggtacaggggtcacaaagatgattaagacatagtccctgccttgagtaatatgcaatctagtgtggaaggcaaatagatacagagatacttctagtgtggagtgaggagtgatctgacagaggtgagctcagggtaagagggactacatattacaggaacctgaggaagcctgagtaggggagtagcattaggaaggggaggggaggtggaaattgcactgagtcccaaaggatcagttgcaggggagggtgtggatgtatatgagggaaggggaggaggtggtgggaggatagaattagttagctaaagagaagagccaacgggcagagaacttgcccagcaagaacagagtgtgtgaagtctagcaagtgaaagagagtgcggtttattcaagggctttgcccactcttatgtctatcttcagttgggaatgactgaagagatgaaagtggagaggaagccactgggactagatcataaagggtctttgggacaaactacttgatttttccattatgcttgagtgcaggaatcactggaggacttgaagcagggatgtggtgtgctcagacttgcatttcagaaaaatgaatatagaggtacagtgagaatgggttggaggtcagcaagattcaaagaaaagagtactaaagaggcacattagacaagaaatgatgagagcttaaacaaagtaaagagtggcaagtgacttgcaagtccttaaggcgggagaaggggaaagaaactacagtatttggcatggactgaatcaggaagtggggaaaatgggggaaagaaaggaggaggatgctccagtgtctgtcctggacaactatgtgaaaagtattactcttcataaagaagtgaaaacaggaaggaaagtagattttgtagcaaaaataaggtgtgttcagttttctgtgaaatggggttaagatgctagttggacattcacatgggactagagaaggtttgaacttaggaaaagaactgggctgaagaaataagtttaagggtagccttaagccatgctgtgactaagccacggtgagtagggtagggtgaaaggaggacagaactatgaataatacaacatttaggaacaggaggatgagtgaataaaggagacagagaaggaaccaaaaacaaggagaagtgaaactaggcaatagtagcactgtagaagtaaagaaaaacacttcaaatactatagatgtcaagtaaagtaagagccaccatacttattggatttagccataaaaagatcattgaggaacaacgcaaggtagctttagcagaaagataaggatgaggagtgcatgagcaccaaggaagataaatgtaaaatactttcaagcagtgatgctcactgagttagggagaagttagactttatgtccatctttttaaaaatggaagagtcatgagcaagtttaaagccatacaaaggtgagagacagacagtataagaaagagaggagatgctgaagcaagtttctgagaagttagcagcaagaggaatttggagaatacgtgaaaggattaaccttgaacctccagtgtaagaggaagaaagaaaacctggataagtgtggctaagaggctcctaagtgctggggaggacagcaaggacagcaactgtacatcttaatggtttctaatgggtaattgaggaatgagttgcctaggagcagatcctgcatcagtcctgcagccccatgaggctgaagatttggaatttgtacttcctccagtccacgtggctatgtcattttctccattagtgctctactcagtaattcaggtataaggtagctgagaacagtttgatttacacagggttgaagttctcccaaataggtgtgaagggaggataagggacaaggaaggacaagagacttgttggtttgggcaataaagtggctacattggaaagagaatgaagacaaaagaccaacatggttaattgtgtgggatgggcttgagattagatcttgttgatatttaaaaattaattaaagtcaaagtgagaagcgagctgtaactttgattgcagaggagctttgtaatactgtgatttccttctcaagttcaagactgaaaaatgttatttaattgaatgttaaattgttattgcttgatccaaaatgacttaacacaaattttttaaacatgttcaataactagtttttgtttgtttgtttgtttgtttgtttgagacggagtcttgctctgtctcccaggctggagtgcagtggtatgatctcggctcactgcaagctccacctcccgggttcacgccattctcctgcctcagcctcccgagtagctgggactacaggcacccaccaccacacctggctaatttttgtatttttagtagagacggggtttcgactagtattttttttaaatgtagcattgaagttatagctgatttcatttgatgtttgagacttttatttgtgctgtggtttcaaatcccccttttgatacccagttaagattaatcctttttacttacaagctattattctacttcataggcatataaacttttattgcagtagagcccagaaaaactggtggatgatgttgcaatttatatatcacaaactacaataattttaggttctgtcatataattttagtaattttatttaaaatttaagattacccagtttaggccctgtagtaacagaataacttcttcagagatcaattttctcagctataaaatcaagagactagattgcttgttaactctacttctatgattctttattttaatctaattttcaatttcacttcaacttcatgataattctaatatcagtcaattaactgtgcacagttacaaattctgtaactcagtctctaagccttctacattggcacaagaggaaggccattggttagaagagaagtcaagtgactacttgtggatagtttagcaaatatctaacatactggaaaaaaattcaagatgcaaggcttgctgttggataacttggtgatcaaaaaaactcttttcttagactaaatatctaatgacaattgattattataacctatatttaagcttaaaactagcagtatctgtaggatggttctcctgaaagaattatacagttcaggacatgtatggacaaggctgcaccttcagaattaagtattttatttcagcagaatccaatatgaaaattaccatttctttcaagaaaagcattgaagacattatttgcattttagatgttttcaaatgacatattttgaagactaggttgaagccattgttataataaacagcttccaatgtttctcttaaaagagttatactttttgtatacaatagagtactactaatatttttaatgtcttaataatgcactaaatatagtgtctttaaactatcttcataaaaaatgactatgtatctttaaataaagaaaaatcttaatttttagaactatttttcatttttttcaaaacttaaagttttgaattagtgagtttcaagcacaacacaacttgtcattcctctagatttagaattcagattactattggtgactagtagttagaagggtcttctattaaacaaattggattgtttttatttttaagaattttataaatgtagtcattttagatgctttgaaaaatgaagaagctttcatctctcttctaatttgtataaaggctttgtttatataacaagtagaaatttaacatttttctagcattttaaaataaatttgaaaaactacttagacaatattatttttatctttttaagctaaaaacttaaaaacaaatttttatggcagaatgtgtatagctagtgtagcaatttcaaaactggatatttattttatttttgtttcttttttgttaatagtcttttttaagaaacatgaaactcacaatttaagattcatgcacatatgtgtgtacacatacacacacacacacacacacacacacggattccccaattcaaatttttaacataagatttgtgacactgacaatttttgtcagaacatatcaaaagctctaaaatatctcatccctttgacccttgaattctattcccaggagtataacccaagaaaacaagaaaaatggttctgtacaaataattttagcagtgttatgtatgatattaaaaagtggcagcaatctcaatgtccgataataaggggcataattgagtaaattatggttcaatagtagtagtgtggattacattgacaaaaaaagatgaatataaattgctaagaaaaaatatgataatctgcttatgaagtaatataaaatgagaaagtgtagaattaacataatataaattatgcttacatgtaaaaaaagatttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgtaaaaaaagatttcaaaggaaaaaatttacgtaggcaatatgtaaaggtgaaagtattatcattttctttttaaaaatactttaaatttgatgtgacagtaaacatatttgtaatatagagcttttaaagaatgtcaactgtatgatgaatataaacaagatttctcttttttttgagatggagtctcactcactgcgtcgcccaggctggggaacagtggcgcgatctcagctcactgcaacctcctcctcccgggttcaagtgattctcctgcctcagcctcccaagtagctgggattacaggcatctgccatcacgcccggctaatttctatatttttagtagaggcgggatttcaccatgttggccaagctggtttgaactcccggcctcaagtgatctgcccaccttggccttccaaagttctgggattacaggtgttagccaccaagcccggtcaggcttcattttagtagtaacagtttgatcataactttcatcatatatattatttaatgttagtaaaatatttataatgaaagaagaaaaaatacgtaattgttatgatatgtctaatcagcaatcaaacaaagcttgcactgcctctggtgggacaacaatatacaaaggataaaggtgtgtgacttctatccagaaaacacaggtgatttttttttttctcttggaaagccaccagcctggtgcagttagaagcatttcctgagagtgtctgagagaaggcttgggtggacattggagggtggtgttctacctgcgaattttggctcattagtagggcttgatatcaatttagtggatagagaactacatattggtttttgtttgtttacttttgtatcatatattttggaaacttttccttttacatttaaatgctaatgaaatcacattccctattgactttcttatatttgtactttatcataatacttataggtaagtattgtttcatgaaacttgtctcagttttatctgcagggaaggtgcaaggtggagaggtagaaggacagaggagaggaaaggagagcaagaatataaaatttgttacttggggctgggcgcagtggctcacacctctaatcccagcactttgggaggccgaggtgggtggatcacaaggtcaggagatcaagaccatcctggctaacacggtgaaaccccatctctactaaaaatacaaaaaattagccgggcgtggtggcgggcgcctgtagttccaactactcaggaggctgaggcaggagaatggcgtgaacccacgaggtggagcctgcagtgagccgagagcatgccactgcactccagcctgggcgacaaagcaagactccatttcaaaaaaaaaaatttgttacttatggtttgggtgaaaaaactttgaaaagtaataccttacagggcaaaaataatctgttgacaagacaggactcaaaatgttgactttccacgtttctcagattcaaaacagcctcaggcccttgtgacctcattcaccagaagttcttgggctgctttcaattcccagagacttcattatagaatccagatattctggtgtgtaaaaaaaaattattctctaaattactataaatatattaaaatattatattacactttaggttctcaactttgtccatttactattttttagtatatctaaaacagtatgcgaataaactggtaagactttcagttcacagattcgttataatatcttatgtttctttatttctttctgctgttgtattgatttatgacgttattttccatggtcaattacaagaatttgcatggtagtatagaaaaaaaaatttaagaaattagggcaaccaagatgtccttcagtaggtgaatgggttaatgaactgtggcacattcagacaatggaatattattcagggcaaaaaaaataaggtatcacatcgtgaaaagacatggaggaacgttcaatgcatattactaagtgaaagaagccaatctgaaaaggctatatgctgtatgattccaactatatgacattctggaaacagcaaaactatagggatagttaaaacatcagtggttgccaggggttagggagaaggagggatgatgaggcagaacccggaggatttttagggcaatgaaactactccatgtgatactattattatgtgaatatgttatacatttgtcaaaacccatataatgtacaacaccaagattgaaccctaatgtaaaccatggactttgggtgataatgatgggtcagtgtaggttcgttgattgtaaccaatgttccagtttggtgggggatctcaatagtggagaaagctgtaccttgtgtggagccaccgggtatatgggagcgctatacttttgctcaattttgctgtggacctaaaagtgctcttgaaaatgaagtttattttaaataaaagaaaggaattatgaattaatatgagaattgcaaaaaggatataattgtgggggaattatagaaatcagctacgtaattccatggagtagctctgctgaaagtctaacgatatgctatgtccaaaggactgaagcaactatctggggtatgctatgggggccaacacagaagacatggaaaaaaatcttaaattttaccacatcctgttctatcaatgacctttccaccaactgcttattttggttttactctgcttcatctctattgcttctgaacttccttttcatttcataacagaaactctgagcctttgccgcctcactaaatttcattttaaaacctattctttcttagaaatgataatacagaaaccactttttacaaatacaacatttaaagaaaatcacagtcacctaaataatctgtttctgtatcagagaaggcagtggacctacagacggtctgttcagtcagctgaggatttaggactgaggaactgttaattcccacagcagctctactgactattcgatagtcccaggacctgaagtctttcagagtctgcttcatgcactataaatatataaaatgagaaaataaaattaattattgtgttttaagaatatttatagcactgtaagtttaggctattatattaattatctatctctgggtaacaagataccataaacttgctgcctcagaggcacataaatttattatctcacagattctcgaggtcaggactgtaggcaagacttacttggattatctgctcagggtctcacttggttgaaatcaaggtgttggccactaacaaactgaggtaccagagaaattgtttttccaagtgtttattacagtaatcccctaggcttctcaataagtttcagtgtcttccctggatagtgacattgcagagagctactgtcattttttcaactatcttcagttcaaaaatatttactaagtacttcttatttgccagtttaaagcattggaagtaagagacaaatcagaggacctgttctcagggaacatatgatctactagcaaagcaaactgggggaatgatgtgaagggagaccaagtctgagtcattttgagaagagaacggaaactcagagtggctgtccggttcagtttgtcttgagagaaacatccctgctagtgagtaactaaaattctctgcagatgttacatttgccatgagtacctgttacatttggagactgaagcagtctgcagaggttatccaaattgaaagctaaaatgagattctcaaagaaagattaagtccaaatagcaattttatggcagggtttgtggaggatctggggagagatcacaggcaatggatatagttgagcaatatagttgtattcacccagcccataagggagatgaaattctgacaagggtatcatagggtgaatgaagacttctccaagcagagttatgcagatggatgaaaagattctaggaagttggattgtgtgctgaaagtgtcagcaagctgctggtgccattttgtgccctgaaccctataggtagatccctaaggatttcagctgctaagcccttaagtcctgttagcccttgtctccttctccagtctcctttacctgccctctaattacgactttattgatgctgattgagcatcttttgggagggagacctaggaattgttctgagttgttcactgtgtttgcagtgtaatgacccttggtgccaaagtaacaccattagagggctctttcctggtgaaaaacttaaaagtgtcaggatgacattggtcacctataaattagggaagagagtgcagatgagaattcaggtgaagtcaatgatgtcttgcccttttcctgagggcgaaatacaggagttgggatgtttagaaaagctgaataggcaacgagttgaactttgattggcatgagcttgaatgtcagattgcccagtgaaaatgttctgaaaagaagctccatggttaaggtgtcaaagtgtcacatcagtgaatacaatgtttccttttctgtggcttttctaataataatgaatagccaggaagattttgtggtttacttgcagagatggcaccccatgactttctgtcacctttgggagccagcctgtaagagagtcccaaaggtgaagagactttctctcacctgggagagtaggggtcccaatgtctcgtagggcagtgtttctcaaacttacatgagcatatgaatcacctgggactcttactaagatgcagggtctgatgtagtaggttagagagttggaggaggtgaaaagaaaaatttgcatttcaaacaagtttccaagttattcaggtgcttctggtccataatcttcattttaagtaacaaaactttggagcattagaataggaaagacataccttagatgatgttattgtggccttgatatactataaagccacaaaatgagaggaaacatagcttaccccattagctgatgtatgaattaagaaaagaacgattcaggatcacttacagatctatgagaaaaaaacaaaacccaggcaaacaaatatgcttcctggtggtagtttctgtcttttcttaagaatatgttataaaagaacaggaaacctggcagttgctagaaaagcagacaaacctaactccattgtcccctaagtctgaaggacataatcttctgttttaagttttaggggtcacttaataccagatggttaagtaacttggtcatgctactaccaacaacctatccgcttcatgctctgccattgagcctatatctcccactggctgtcaactgccttcatacagtaatactggaagcaactgaaggtttattcgcttggggatgaattctatacttagttatcaagtattctagagtgacttgtggtcgggggaagggttaagaatctctctaggagtggactcacagtggagccctggttagaagatagcttcagtattctttattgtaaataggtcatttgaatttttaatgccatgcaattcaaggatcgccacataatttgtatttctcttaaacttaatgcagtgaaactttccttgtgtaatagatgcttttgtaatgcaatcttggaaatagttttcaaagttcataagggttgcaaaagttctacttgatctgctcacatatacaattgttcctttccctgctcctctttctactgctatttatatcagctgtcctccaggagatcagttttcttctcagcatctgatataaataaccacagttctctaagcatggtctgttcaaaatttccaggtagttcatggactgatatctggttaactgttttcatgatgtggcagtgacatgcatttgttactaatatctattaatactctttatataaaatgcaataacggttgcacctgacctcaatgatatatttattaaaaaccctgctatttttaatggacaggtaagatgagtttggatactgcagggtcgttcagaaacaagcagcagtgatattcctttaggccatgcccttgagttgaaattttccctgagagtcaactccaaatgcagaaatgaacataatgtacccaatagaatgcagctgtctgatttgccccaagcctattcaatatctttcagactgaaggagtgtgggcttccgcttattttcatgttccttatactgtaactaaaagaaaccggaaatattcttgcttctttgaaaatattacagataataaaaactggaatacaaaactctctttttaggggtgaatattgtttttagtttaaaattgtccatgtgaaaggctagtcagtctagcttctgcaaaaaattcttcaaaaacctttgatcattttaaccattttaggtgtattttgagctaaaatgcactcttgacttcaggtaatgtagcagcagccattaaatacttagaagatttaaaggtcaaactatggaacagaagtagaagttttaactatataaataacagcattaataaataggctttagtttttcttcactggtgctgaatcaaaatattattaaatataattaatgaaatattttataatatacattatgtattttaaatatttttcattttagtcatcaaaacaatttaatgattttaatagaattttaatagatttaagctaacattaccaagcaacttcgtaatttaaatttcaaaatgaatttgtagtaaacacaaacccattttatttttattttatattatacaatataatggatgacaacagaatgtaatgacaatttttcaaatccaatttattaatgtccctagtagtgaccataccaagattatgctgcagtaaacccttttaaaatctaaatcctctccttactattaggtccatgcttatattcactttgtatctattacaaacaacttataaggaaagaatgctggaactggattcaacctctggtttgtattcttaccaggtctgctgacactgagtctcagctttctctttgacgaactgcggactctaatctgtaccttgcctgttttttggagtagtattaactgaggtgaaaataaagtattagatgtgacatgaatttttttattgtatctttcatggtagactgagtaggttttgctgcagtaacataagaaaaacaaagccccaactctcagtgaatataatcttagcccataggcagaagttcatttctccctcatgcttcatgtctacaggagctcagcttatgatccctttgagacccagcctaacggaaaccccatgttagcatgtgttttcataatcaccaggtcagggaaaagatactggtaaatcatgcactggcacttaaaacattcttccagaaatgatacctctgctcacactctgttggccaaagtaagtcacatggccacacaggtaagctcagagtaggtggggaagtgcatttctatcgtgagcctagagggagaggggaacaggcatatctacgatgagatctaatgactatcacaggtatttaaatttaaaactgcaatctatttatcctgtggtgaatttagtggagaaattatttttgccttgcaatggtaaggaggactgttatgtaactttctactatgaattatagatgtgtactgccatctacttctcatctattgagaaggggagatgttctgatctgaaataaataaacatcagaatacttttttcacaatatatgtactatgatgtttctatcagtaggaatagacagctatacaaaagtgaaatagaaaaagtggtaagagggccaggcacggtggctcatgcctgtaatcccagtactttgggaggccaaggtgggcggatcacctgaggtcaggagttcgagaccagcctggccgacatggtgaaaccttgtctctactaaaaatacaaaaattaactgggtgtggtggtgggagcctgtagtcccagctgcttgggaggctgaggcaggagaatcacttgaacccgggaggcagaggttgcagtgagccaagatcgttccactgcactccagactggtgacagagcgagactccgtctaaaaaaaaaaagaaaaagaaaaagaaaaaatggtaagaaaggcaacagaggtacaacagatttgctgagaaatcctatagttagaatggggaaggttttttgggaaacatgagttaaggactggatattgaagcctggaatggatatggatttatggacagggaaggatgatctataatacagagaagtataattcaacacagaaattctgatttctaggctattactggaatacactatttcaaggctattaatgactacatttatgttatttttcctaaaatatcaggaccttttaatctaatgactcagctcttctgtgtctctgtttttcttgcactttgtcttattgctttgccatttaaaaatccagccatgaaaggaattttggaaattgtgttcttttccatgtatgtaattgctccttaaaactgaaaagatcaattaggaaattattggctccttcgtacttcttttaccacctctatttattaattgattgaattgggttcgccaggtttagctctttaatatcagatcaataaaagattaaatgtttaaattaagtgagcacacatgtaactttcacactccttgcaatttctaggagccacatccaatcattcaggattgtcagtaacggcagcaatcaaggctagaatcagagtacttgcaacttttcattctttttcctaaacttcagcctacatttatgggaataataatgcagccatactttcctcaaactcagtttatatttttgtttgaaattaaagcagctttttgagacaagaattaagattgttgccctgatgctagtcatagtgaatttctaacccttctaacccttcttaaaaggagatggtcgtatttgtttcctttggatgccgtatcaaattaccacaagctgagtggttcaaaagaacagaaatgtactctctcacagtacttgatgccagaagtttgaagtcaaggtgtgtctgaaggtcatattctttctgaaggctccagggaagaagccttccttgcctcttcctaacatctagtggttcctagcaatccttgacctgtgttggcgtgtagccgcctcactccggtctctgcctctgtcatcacatggctttttgccctctgtctcccctgtatctctaactccaaatttctctctccttataaggacatcagtggttgaaattagggtccactgtaatccagtgtgatcacatcttaattatatccgcaaagactctatttgcaaaaaaaaaaaaaaaaaaaaaaaaaaaaaaaaaaaaaaaagggtcacattcacaaataccagagtttaggacttcaacatttctttataggagacacaaatcaactcacaacaatggcattattgaaacttttttgtaattttttagcattctattctgtgggatacttcccctcccagcccagaaatttatgccagttactaatttcatcaagattattccccttgctaccgattgccaccttatttaaaagtctgcattattgttgacctgccccaagacctggtttcttgatacccagtcttctctttctcatgattttctccgtgcaacttgttaaacttttactttctttcagaaagcactgggaggcagttcagatgtaccagggtagacaggctagtgatcaagggtgagtcagggatttgctgacaggtactaatgggagtagtcattgaactaaacctgaagcaacagtgaaacaaaacaaggtttgcatcacttctaaagaagatacttagaattgttttcttcctcttgcttcaacaactacattggatatatttagctgaatgctttattttgactctaagcaaaatctcatagcaacatcttttctttcaaagtaccattaatgtaattttgagtacaggaataaggaaaaaagttagaaaatttcattgaggataataaattgagaccaaacactaccagataatacatcaagaacattaacattaacaacatccttttatgttatgctacattcttgtgttaaactaatgtataccatacattatagatactaatgtagtagttgcggaaaataatgacgctctttgattctatctagcagaactgcaaactcttaattataataacaaaagattatgtgttacactctaagtcttgcctagaatgatacaagatatggattttgagttattttaaggattataatccttatatttatgttctagttcaggggttgatgataacctaaggtccagaatttggataggaaaaaaaatgtatttgtttttcctaactctaactgatatttgatatctccttcaattattaatgtaagccacaaacctcaggggttatggcatcaatagaaatcctagattaattttaaattatatcacaggtattgaatatatctcaaatataatttatacttagcacttcttcagaattatgttagctacttagacctgctgtgataccttatttaatgcattaataaagaattcttttaatattttgataactatttctatatactcatttttccttggaatatttttattttatgcattttaaaacaattctgttgaaaatagttcctcgggcttcatgggactgccaaagtggcccatgacacaaaatcggataaaaatttctctgctagttttagtaccttctgtttcatgatggcaaattaaaaggcaggttcaaatgtcagcattatatactacaattttctttctttctcagtcagacaattcattaatcatctgatattttttataatactatacctaacatggggataaatgactgaaaaaacagggttgtaaaaatagaagcatagcatacattcctgtcctcaatgatattcagtctagttagttacatagcatatgaattgccattgtccatatcatatcttaaaataattcttatactgtatttttataatgcttaaaaaatgtactcaaaatgctgtcctctgtaagaactcattgaacaccttcaacagggttgttaaattggtaaagcaagatcctactaggtttataaataaagaaaaggctttcccttaagtagtgagagatgaagcaagaaaacactcagctctcccaaactgtagttcagtgggactttcatttcacatcatttccttagaaaaatcctacgtcagaaaatcttcagtctttttcgttgtataatctatacatctccgaaaagtgtaagatggcttgttaagaataaagtgtggtttggttgtgtaagaccaaccagaaaggggaaagggaagaggaatgatgttgagattgggagagtagttgctgtctgtgatcttttatacagttgatgtgtgatagttgtttgtttgtttgtttgtttttttaattccaacctgttcttaaatgcaaatacaaaaactagagaaagagatggaatcaagctaaggttaaactcaaaagtgacttcagtatcaacttgttggttgtatgtagcctttctgtcacagaactgtgccctgggttctttttactcaaaaagtattccataaaacaaccgcctattggtgcattacttcacagcctgttatgaatgagaatcttgagtcccaccccagacttaatgaatcagaatctgcatgttaacaaaattctcaagtgatttgaatatacagcaaaatttgagaaccacagatgactttcaattcacccataataactgagaaaagactgtaaattcctacaccttgttcttccataatttaaggagtttcttgctttgtttctaccttcattaagggatatgaggcccatgctaagaaaaatgcgtttaataactactttgagtgaaaaatctcactaaatcaggcagttgttcctaaagagaatttaaacagattttcatcatagacagcatggtatctgagacaaacctgcccctgttggtgctgtaccaggcaaactcagtgaatgtaagtgggaaatgttttgggagaacaagaaagcccaagtattgcatttaggcaaatcataagtgcatagtgtgccagagaaaacaaatgtttttcctgcactggctctgacacgttcacacatgaatgtgtttcattcagaaaaagtaaaggctctagaatggcacagtctggttttatgagaaacagatgtgccatggttcacccactccctgaccacctgtggtttgcccatgactcaactttcttgaatgaggggagttaactcttggattctgaacaaactctaaattacatatttattttcttcctcctcatacttcttttcaccactcattgccatgatagaaccttacaattctgagaagtttgaattctcaacaccccaaaacattttcatttaaagttgaatccttgctaaaggtgaatccttgctctgatatttagattgagattctgttaaaagttcaaatagaataccaatttatccagctagttagagtgatttttggtttatattttaaagccacctggttatgaggtatctttacttactgcctattttgttggttgaggataggaattattaccagtcagaaatatgcttttgatgtcattggttagtcacttaattttcagctacctctgtttattggaataatgtggaaaaattaaaaaaaaatttctcagactttaattcaggtaatacctgctgttaaatgttactgtgaactacttcctccaactgctcacaagtagccaaagggaaggatttgaacttcattacattttatctctcctgccatgctctgccttccactctacagaaaagggacagggaaatagtccaatcataggtaggtggatggaaaaatacaaggcacaaatagcccacatagggaataatcataccttaaatagtcactgacaacatttaaaaaaatatatttttatttccatttatgtaatcaacttagggttgttattgacctgccactgaggcatttggtttttcttttcataggacctttttcatttatttcttcagaagcattatctaattaaaaacaaacatttaaattaacatggcctgtcaaggaagtacaaaccagtcttgagttaagctataattacaatgacaacaatgtcaaaaagaaaaagcaaaaaccttttttaaaacctgtaattacttcattgtttataatttttaattggaatgcaagtaacagggaattcaaatttcataaaaccgtggtctgtatatcttgttatcaaaatgctatccaaataacacatggcaaaatgtaatttttttatgtaaatggggagacttatgagacaaagaagcaaataatctggccacaatgtgagtctttggcaaaccttggaaaggaactcccaagtgcatttcctaaaagagtactttgtgtgttcaaatgtactaactctatccagagtgaaagaatgcctaggaatgaataatctgcacaatctgatagaattaagtgttaattatttagaagtaaaatttactagaaatcaatttcagtatcattttcagatttggttttcagaaaaggaaataccctgttttaataggtttggaaatgcaggactacttaaagtttacttgggtaagataacccttaataaattatcaaggtacttttggatttattaattttataaacaataaaactagctgttgctagatgtcggttatagactgagctgtagaaaattaatgatcttttaaaaagacagttgatttttcacatggccactgtatgatgctttttaagttcacttgattaaaaaggtgacaatactaacatttcaaaatttaagtcattctatatgatcaaatatggttctatttgatacattaaaatatcttaatttgaagttaaaaatgctttgaataattaaatagatatataataaaaatgttgaattcatgtgtcatgcatactgattttgtacctcataagcaaagctacaatggtactaacagggtgtaatttgttcaaaataaatttttataccagatgatagtgaccttaaaaaggatttttattgctcaagccttccacttccattcctttgacatacttaatgagtttcatcaatttatgtcattaaaaaagatacatcttctgaatatgccagttgaccaaatctattattttggatgtttgctcagatagagctggtactgggatgaaaaaaaaatggctaagatatggttcctaccattaagaagcctatgatttggctaaagagaaaaatctatccaaaactaggtttaatacaagaagggttatccagagtgctggtagggagggagacacataggagagtaagaagtagcatttgaattggattttaggggataggcaatttttttattgaaatactgaaaggcaatttcaggaaaagggtacagtgtgagccaaggcatggactcaagaaagtacaggatgaatttaggtaatgaatcatctgtgtgatttggactcaaaatgaaaaaaaaaaaatataagaaaataagagatgaaaacataagtcgaagccagatttgagaaagcttaaatgatgtactacagcactgagatgagtctttagatcacgagggaccaagaaaaaaacataattttttgtcattaggtaaaactcatgttcattattaaaaaggagaaatgtaaagtaaatatacacatttacaatacaaaaatcatcaaatactttgaaccacttgaaactgccattttcaaaagtcaacagcagtcaaatatcatcactttaatatagctcatcttaataattgattctggaatcagaaatgtgcattttaccattgactttttttatgaaaataaattattaaaaagcagcataattaggattaatataggcatcactcttatttagtacaaaaagcaatgtatcaattctataattttgaccacctactgtgttctgagcatactgtaaggcgcattacctacctttattcattcattattactcgaatcactttaatgataaatgatggtcagaaaatatttatatagattttcccaaatcatctgtaagtaagtgatttttaaagataggaaagtgatgctcaagatatttatataaatttcaccaagtagttagcaagtaaatggtggtgataggattcaaatgtacatcttttgccttttgtttgtttggggtttggatttggtttttgctatactaccatacattgcttcacgttgggggtaagctatctccatagcatgacccagcaatcccccagtgaaaagtcaaacatttgttgagcatctgtcttgaaggagaccccaaatcaggtgctgggtgtaagggcggacagcatgaaagacgttgtcctttttcatatggagcttatatttgagttgggagacaggtgcaaaacgttagttacaaactaatttcttcactaaagtcatgctatgtgcaaggagataaagtacagatgagttgatgttgtataagaggaggaagttaatctccaaagcaggaaaaacaacctcagacatttaagctaatacctgaaggtaagtagaaattaatgagttaatggaaatgagagaagtttaggcaaagaaaacagcctaggtacagatttctgctttctttaggtaacaactatatctcaaggtaaacaagcttggaatgaaaagcagggtcctaaagaacatagtttcactctggctctgccccacccattgatatgagcaatcaatcatcttcaattatttctgtgagtctccaagttgtattcatacatgttcacaaccacagtccattaaacaatttggatcttcacagtctcctgaattgcctaaattccaaagtgtgtacagtttaggctaacaaacgagaacagccaatccatgtaaaataggggactagactaagttattttgaagctgtatttctgtcctaataacctatcatattgtgtttctgattttctacaagtattaatactataaaattaaatgtttggttttattagaaacagggcatagtggatatgtacagtaacaaaggacaggaagtgaagaatgaattgatcgaggttcttctagatagactctaaaagaatacttccaagagacaggaaatattgtatacccattgtcaatgtttgaatattattaatgaattaataattaaaatgtaaggcaagtttttacttgctaagaagacctgtgcattcatgtaacaaacaccatgatgaagctatagaatgcttccataacccccaaaatttctccatttctcttcccttggtactagtttctgacagtcactgatctgatttctggctctatagtttggccttttccagaatgtcacataacaggaatcatacagtatgtagctttttatgattggctttttttcacttggcataatgcttttaagatgaatccattttgttatgtgtatcattcccttatttcttatatttttgagttggatcccattttacaggtataccataaaaggataatttgtttattctttcattaattgttggatatttggtttggtgattatgaatgaaatttctataaacagtctcagataggtctttgtgtagggactttacttggataaatatataggagaaggagtccttgattgtatagtaagtgtatattcaactttataagaaaatgccaaatgttttccaaagttgctgtaccattttacattctcttcagtaatgcgtgagtttcagttcaacatctaaaccaacacttgctggtgattgtttataaattttagccattctacttggcatctaatagtatcttatagttttaatctaatttgcatttttgtaataatgatggtgaacatcttttcacatgatgtttgccactcatagctcaagtgatgcaccttttaaaatattttgaccaattctaaaagaaaaatgggttgtttgcttttcattattgaattgtaagagctctttatgaattcaggatggaagttatatttaatgagatgggtgttttacatatattttctctaagtctatgacttgccttttaattttgttagtatgtagtactttttaaacttgtgtagattctttgagattttctacatagacaatcatgtggtctccaaataaaagacagtcttatttattcctttctaatatgtataattttgatttcttttttgtactttattatgttggttagaaccttcattatgatgttaaataggaataatgagagcattcttgccatattcctggtcttaggtaaaaacactcattctttcaccattaagtgtgatgttacttataggttaacttaaggtgccttttttcaggttgaggaagttcctttctattccaagtttgctgagggtttttatcattaatggatgctaaattttgtcaaatgctatttttatatctattgacatgttgatttttatttgtgtaatagttgttgttaatatgctgaatattgacccaaacttgcatttctgggataagctcacttggtcatgatgtatcatcttttttgtgtttcattagatttgatttactaaagttttgttgtggtttgagagcatattttatatcagcgcttctcaactagggacagttttgctccccaaacgacattgggaagtgtctggagaaatatttagttgccacatttgagggaagagagaggattttctacgggcatctagcagacagggaccaaggatgctgccaaatatcctaaattgcataggaaagcaccacacaacaaagaattatcaggccccaatgttgatagtgcaagttcaagaaatgttgctgtatgggatctcaaaaattttaaatttgttcagatttattattttatgacccagaatatgactatctcggtgaatgttcaatgtacacatgaaaacaatgtttatccttttaatatagggaagaatgttgtataaatgtcaattaggtcaagttggttgacagtgttgttcaaattttgtatatctttactgaattttatacctacttattctatagattactggaagaaaagtgttgaaatgtccaactataattgtgagtttgtcactttttttttagttctctcagttttttactttttattacattttattttattcatgtctgttagttttttgcttcttgtattatgaagttctgttgttaaatatattcaggtttttacatattattaaagaattgacctctttattattatgtaatgtctctctattcctggtaatatttcttgttctgaagtctactttttctgatagtaatacagtcactccagctttcttttgattagcatttgtgtggtatattttttcatcctttaatttttaacctatgcctttatatttaaagtgtgtttatttataacacatataaagtgcatttatttatagagttgggacttcctttaatttaatttgacaatttctgtctattgatattttagagcatttacatttaatgtgattatcaatatggtaaacttaagtttaccatattgctagttgtttactattgatgtaatatgttctttgttccttttccttcttttcctacctgtggattaactaaatatttttatgattccatttttatctacattactgatctataagttgttcctcttttcaaatatttttagtagttgtgctggtatttacagtaaatatctttaagctatcacagtctatcttcaagtaatttatatcatttcacctgtagtatcaggacctcacagcacatattccatttactcctttccattctttgtgttattgtcatacattttacttctacttataagcctcacaatacattgtaactatgcttgatttagacggtcaattatctttaaaggtgattaaaaataatttttaaaaatatcctttatatgtacctttatttctatcattttcagtgctatttatttctttacatagcccacaatttccatctggtaccatatgcattctgtcttaaggacttcctttaacttttcttatagcataggtctgctggcttcatgcctgtcctccagcagcaggcagtcacctcctgcatgcctctgccacagcagggacctctctctcgtttcctgctcccagtctttctcataagcacctcacgcaggcctgtggaaaagtttataaataagtgtgggcttccctgtgggtggagttcctagatatttcaaactaataatagttcatacttgtcttttagaaatttgtgaaacttttagctaattttttcctactcacatttgtagggaggccacctatttttcccatgctttgccaaagattaaatactttgtatgtccctcttgaggggcatatcactctttgaacttaatttacttggctgccttgaacctcagctctctaatgggctcaaggaaagtagtaattttgtacatcttctggcttttggtcattgttagcaggaacaacgttctcttgtatctctctacaacatttaccaaagtggaactcctcttttcagcatcttaaacaaattttggatttgaaatggctcaaagcatttgggaactctattttacatacattttaaaatgaagcttctatagttctgtggtatcttatatgatcttaattgttaattagttggaaggatatgtgtcatctattagtaagttgtagagtttttgtttttagacattatttgtcataaccccaaagggtctatttctacataagtattgaaatcatttttcaaaaagcagcaacagaaaaagctgctataaatttcatggctaaagattgggagatatttgggggtgatggtatctgctgatattaaccttgtgatcagcctaaatttctatttattacatttttacttgtttttattcctataaatattatatataagattaatagtcaacttatggaacatttgtcactggaacatatttgtcattccctatttatatatatacaaatgaaatacacatacttgatcgaagtaaatgcattaaaaacaatcatctttaattcctttgaatctgtactacatacaaacgacatagttttaggattctctacaaattcttaagtataattaaatcagaattaaggtgatcatctacatattgaaagctgccttccaaatgaatgaaatgtaatataacatttcaaatataaaaggaaatgttgatgcccacgaaataatttcatcttcatttatctaggatcaaatattgtgaagaaatttaacattatctatggattaatataaagacaaatgcgatgggctgtaattgagcattcaaattaagtttttcatatagtgtgctcatatgttagacctttaagaaatgtgaatcagatctaatcatagcagcagtgagtgataatgcagtttgccagctaaggcaaggcaccccaggaaaatgctattcatataacattgcctaatcagtgtatatctaaggcatctttaaaggaaaatgtatacagatgctcctccatttatgatggggttatgtccagataaagtcattgtaagttgaaaatatcattaatcaaaaatgaatttaaaacgcttaacttcccaaacatcatagcttagcctagcctaccttaaaagtgctcagacacttaacattaacctacagttgggcaaaattatctaacacaaagcctattttacaataaaatgttaaatatctcatggaatttattgaatgccgtactgaaagtgaaaagcagaatggccgtatgggtacttgaagtatggtttctactgtgtgcttattattttcatggtgtcataaagtcaaaaaatcatagcgtaaccctggttaagtcagggaccatctctatgtccttcatatacaagattttattattttacttttcagaatttctcgctgtgatgaaattaatgtagttgggaaaatagtactggatttaaattcatttctaagaacagaagaaaattaaagatattaattatgaagttacaaaacatatcaatgagctctttttggaatttgagtttagtatttgagtcagagtgatgtgagagatatttatttgccaagcatgaagcagagacttcagtggctgcagtagcatagtatctgctcccaagtggtttccagtctggtaaagggatatacagagcctcagtctaagtgctgcaggaggcatggacaggattcagaatgcccagaggtcccccaggcagccagggaaggggaacactgaagatggagatcattggaggaggacggcattgcaagcagaagataagaaagaatcccttcttctcatccacatgacacatatcataagatcatatggcctcaaaatcatagctcttcttattttccttaagaacatggagtttcacatgcaattaacttaaatcttcccagccctccattctcccttcaataattacctttctattttgctgttcatctaatgcgctttaacactatgctatgttagaactattttttctattctgtttattttcaggcttttaagaaatttttattagacgattttagtaattcatgtgaaaaagcataaatttaccaatctgtagcagcagataatccaagggagagttcatgctagaagtgggggatcaggagtaaatattctcctaactaagagcttaggtcaaactagagtccaagagagtagagaggtaaagcctgtgctaagagccagaatatagcaagaagcttttgatactctcagctgccaactaggaaacgggtgagaacaggcacacaaatgagcaaaggggtagaaatgagatttacagcaattgtaatatatttattcagtgcctataatcatctttgaatacactcatttatttagactgtgcattctgtgttgcatatttgttgattaacattttcattagtttaccattgtagaaacaaaaatagtaagttatgtgtctgtaagaaagagacatgacctgctaggtcctgtccagaggtcttactaacttggctgacttaaagatatgattaaaggaataaagccatattaggaagaagtggttattaacatcacccagaatggccagaaatttcagcataaatatttatgagagagtccactgaaactacacatttagtaaagggaaacaagatctttggtttttgagaactttctactggacaaaaaaccttgaagtcaaaagctagtcaaaggtaccacgtgatacttcttgtttcaggtgaagctgcctgtctatcacagagcaaccactgcacaacatccagagttggcattaaatccaaaagctttggagatgaatgacttcgttaagattcctctctgggaatgtgaagagatgggatctaaactcaaagactctgatccataaatttttggagctgtaagtctgaggtcaaaagacatgaatcttaggaaacaaatttccttttctccagggcttcctgtctctttcctcatccagttataagggaaaaaaaatattacagtagaagaaaaaatggtcagtgcaagctgatcttggctaaggttaaaggagggccatacaataatggtctgcctcttcccatttttatttagcttcccaatagaataatgatcatgctgtggcatgttttggaataattatatctggcagaggcatcactcaggttttgcctgtatgtaaatggaggactgtttccttgtgagtagatgaccatgcctcccaatttacctggcactgtctcaggttgtgcccctttcttctcaaaataccatgatttggatgaaaatataaattgccaccctgttaatgagccactgttttagagatggctccctcccagaaggaaagctacctaaaataccctcagatggtattagacattaacgaaaaataaactttaaatattttctagtcacattaaaatagctaaagtaaaaaaagtgcaaatatcagtaaagggataatgcttcacatacacatgcatgcacacacacacattcacacacacgctctggcctatttttcaaatggaagtgcctgtgaggcttaaaagtatgataagaagaaaaggaagaaaatagataagatgtgcaaatgagacaacccttactaaaagggtgaagggacaaggagaagtgcagccaatcctgagcagaatgtactgaaacattcagcatttcttccccaggatggcacgctcctctgaagaaatgattccatacgaaggagaagggtcccctttccagatgacaggctttgtcttcaaagcaagggtatgcaactactggactttgtctatacttggtaacttttataaataaatcaagtctggtaattcatgctgtaccaagaaaggctctagttagaagagcagcattagcattttagattttggtctaacagacagtgtagcaaggtctcctgggtaaagttttaagagcaattagagctaataaaaagacaggcttgtcagcacctgaacaatgtggaaaaggagagccagtggcttggcttttgattttgaactggacccaagttaaagctaatagaattgtttttttcaggagtacgtgtgtgtgtgtgtgtgtgtgtgtgtgtgtgtgcacgtgtgcacttgtttgtgcgtagcctgtgcatggggtgagggggttcatgaacatagatacagttcagctttggaataaaagtgaaaggcatttttagttgctttcaaaacctctaaaaatagccataagtctctgccaaagctaatatagacaggattcccatggaaaccctctgggctagaaggggcgggtattattttttcactggttattggttaaaagacttctacccattttctataatgtaggagtgtgtttactgtcaaaactgatgaatcaaatcttaaaggcacctgcttatctgttctacttatctgaaggagagaaagtacagtagtgtctgtacttaataaaaaattttcgcaaggaatgcgttagttaagaaaaaaaagtaccaccttctttcacattctgtgcttatatgttctgtagctagtttttaaattcctactttgagtccatggtcacagccagatttcatgatatttttacccatatatttatctgtgataacagtcatctgtttttacattttctcattttgggtggtgtcttatttggatgtatgtgtcaattccgaggcaccaagaattaaaggatgtatgatcagcctagaatttgacattgtgaagttaacccttaggaattttcattttcttcactttcagctggaagattaaaatttcaaaaaatattaagagctaagaatgatgaacttatttcttttcttttgaattataacacctttggggaaagtattttaacaaaataattagctgtttatcagtttacaaatacagagataagaagaacttaaatctttttaaagattacaaaaagcaagaatacaatagaattctaaaggtattttccatatatttcagtagattcagattatgactagttaaatgattaattgatagttattttaaaaactttgattgctttattctttgattttattctttttcttctttctaataatgcgttttctaaaccatattataagtaataattaacatatgtacatggttcttaataacctactaaacacttccatgtaaatcatatttaatcatcataaatataaacataaaggtttataaagtcaccatttttataattattctataattatgaaataatataaatattctttatatgtcattttgttttatttcttcatgtggttaatgtcatttaacttatagttctagaagatgtttttgcagtaactacaatatgcatatttttttgcttagtattttacatctttaagtaaagattgaggaggaaacgtaatgccctaaaatattacagctcaccaaacacatcatggagtcatattttaggatattcttagtcccagatagcaggagtagtggctagaaacaaacctttgatacgtagaagtcccccagattcctagatagtatctggaagcatccagggcctggtgctgaaaggatctggttttcttctcctgttgtagtggctaagaggcctgtgtagaaaaagctgtgggtctcacagacagcgatcttatcgctagagctgggttaggggtatatccaggagacattttccttctctgagccccacttgcaagagacattcgctatacccagagggaactccagtagaagtgccaggtaaatctgaaatatgtgctaccattccatataggaaaaattcaaaaaatcacgtcaaatatctggggggaaggaaaggaaagggtatcacagtcaggaaataacatttttgtggttaactttacagattttaaattgttggttttagttttgtgagactaaagggaggtgaaaagggaggagggaggtcccagtgtaaaaagcgtaggtttgggaattactcaggcctgggttttaaacacagctttgccatccaactagccaatgactttagaatacttaaaaaaaaaaatagaatacgttttaagtttagatcttacacactttttgatcgaagacagcagagttaattatatgaggtggatcgtgtatcattttaaccaggcatcagctttcacaatggttaaacaatgcttgacactgaaggattttgaaaacatcaggacgaaaaggtggtgtagtatggccaaaaatgtgatactgttgtaatctgccagaaagctgatttagcttgggcagtgtttcctaggtactagaataaacacagcctattgtccagatgagaagaggatgatagtgtgttgtgattaaatgagtaagtaatacttatatattgtttgctgctgtttgaataactaacatttactgctgtatctcatgaattatttaagtatattacaatcatcaattttagttagattttctctttatttactaaattggcctatcattgtcacttatatcttatttaaatatttagtcttatcttcccaagatataatagtaattgggcagcactgagccattttagtaatgcttgtagtaagcacacacatgcacactgaaacctatacaattatattgataagctattatccagaatcggatgttttcataaataaaaatttgttccataaatggtagattttagtttacctaggggtaaactgtgaatcatataatgcatcacttatttattacaaacataaaaattcactttcatataaagatatatctttatatttatttttctgaaaaaatgctagcactctgggtcctgggtgtgtcacttccatagcatattgaatggtattaacaagccttacattaattattttttaaacaggcttaatagccccacaggcaggatgtgttggccttaaagggctgagttattataaacactatctgtgtagacatttaaaagaaacagtgtgggagttaaaattacaggttcaagaacctatttttcgtctttctcccacacatagactcatctcctgtcatattatttcccaaaagtttgcaaatttccagtgtttctccataaatccttcttttacataagtgtataaaatgtcaattacaagtcatgcttggtgccctttattgtcttaagattcttaatatctgaatgcttagaatgtaaattcttacaattctaataccttagtatttgaaaatgttatgttatgagtacaaaggtgttcatttcaagactgaggcttctattgtaatttctgtcctaaaggaggcctccagccagggctttctctgaattccataatattctagttaagggtttggcaagtaaggaaagggaaagcctaaagaggaagacacatgaaagaacaaagtaatgttttccaagtagtcccttgaggggtaaacatgagctgttgtggaaagaaacaggacttctcggggagaaaaaacctgggttgaattctgattccaccattttgttgtcctgtatccttgagaaagtatgtaatcccttttcacttttgtctccatttcaatatagaacactaatgaaaacaactttttttgatcagatccagtactctcttttgtaaaatgattcagtacctctaagttactgtgcaagtataaggtcttataatcattattttgataatagctaccaagaataaggaaagaaaatctacatagccaagtcactagaaaggctgcatttgccaaggtcatacttagaacactgggaaatgttcatatgtgacatctaataatgaaaaaaaacactctgttagtttaattgtaaaattaggctcgattctaaattgtactcatttggaacaacaaaaacaaaaataaaaaccaaccaaccaacaaacaaactgtatgagactttatcaaaatatattcccctaacccactaggtagaaattggtgacaaaagaatataaactatttggtgtgacaaataaatattaagtatctgctatgtgctggctactatgggaagtgctaggaatactgttttgaacaaggaaagcacaatccctgatcccttttttatttttcttctatttttaatttttgtgggtaagtagtatgtgtatatatttacggggtacatgagatgtttgatacaggcatgcaatgtgaaataagcacgtcacgaagaatgggacatccatcccctcaagcatttatccattgggttgcaaacaatccagttatactctttaaaaagttattttaaaatgtacagttgttattatttactatagtcatccttttgtgctatcaaatagtaggtcttattcattctctctattttttgtacccattaaccattcctacttccccctgcccccagcaccccactacccttgcaagcctcttagtaaccatccttctagtctccatgtccatgagttcaattattttgatttttagatcccaaacaagtgagtgagaacatgcaatgtttgtctttctgtgcctggcttatttcacttcacataatgatctccagttccatccatgttattgcaaatgactggatctcattcatttttatggctgaataatactgtattgtgtatatgtaccgcattttctttattcattcatctgttgatgaacacttaggttgcttccaaatcttagctgttgtaaacagtgctgcaacaacataggaatgcagatatctcttcaatatattgatttcatttcatttgggtatacacctagcagtgggatttctggatcatatggtagctcaatttttagttttttgagaatccttcgaattgttttccatagtggttgtactaatttacattcccaccaacagtgtacaagtgttcccttttctgtacattcttgccagcatgatcccttgagtttatattctggttgtgggggaacagtgggcagggtggagggagaagaaatacaagcaataatcaataaataagaatctcagatcaagataaggaccatgcagaaagctaaaacagagcaatgagtcaaaatgaccaacgtctactttacactgggtggtcaggaaagtccatggtgatatttaagcagaagtcttaatgatcaaaaataagccaacactttgaagactgaaataagagtgttctgtgaagagggaccagatattatcaaaaaaggtcctaagacagaaatgatgtagagggtcttgaggatcagtatggctgaaacataccaataaggcagacgtgtggattcatgtactgagaaataggcaggaggcagctgatatcaaccttcctatatcacaggtaagctgtttagattatattataagcctgatgagttaccactgtggctttttaggcagaagaatgacttgatctgatttgtatgtatataaaacataatgctctatggtgattagactgtaggtaggaaacaagagtggaaactgggagacctgctaggagattattacagaagagacctagtggcttcaactaggatgacagtaacaaagacattaattcattcatctgtttatgccttcaacaaatattaactaatgatctactgtgtgccaagtcctctctagatatcaggcatgcaccaagggtcaaaagcaaagaaactgcctttatgtggcttatattcagtagaggatatagacaatcaaggggaattaagagtgatgggtctaattttagataggatggtcagggaagacttctgctcatacctaaatgaagagagggagcaagcattgcagttgtctgggacaaaagggactcagacagagagatagcaagaagaccctaggatgggagtgtgcttgaggagttgggataacagcactatggctggagcacagttcggtaggagacaaatggcaagagtttagatctggaggccagctaaaagctaaatcatgcaaggctgggtagaccataacacggcctttgaattttgttctaaattcactggaagtcatcggaaggctttgaaaaaggaagtgacttgatctgatctgtattttaaaataatcactccagctactgtgggaaaaaaagataatggatatggcggtactagaaaggaagcagaagaacctatttggagactattggactaaaccaggcaaaagatgatggtggattggcctaggttggtagcagtggaagtagtaagaattgttcattttccagatacaatctgaaggtagagcctgcaggatttgctaacactttctatgttggatatgagagtaaagagccaagaaaattccaaggcttttgtcctgaacaattgagcaaatggtggcaccatttgctggagatgagagggaaaaatatggtatgttgggggcaataagggaaggttggggatcaaatgtttgcatttgggcatgttaagttagagatgcctattgtggagtttgctagtagaaagttgtatatataaagctagagtttagagtagaagatgaacttagagatatatatgtgtgtcatcacagcataaagatggtatttaagctatgtaactaaatgaaatcacctagaaaatgaaggtaggtagaaaagaggagatgaggagaatgaatttaaaatgtgctttgaagatagagataagagaacttgctgatgggtcagggtaaggaacaatcatagctaaatttgttttcaacaaccgagtggataggtataattcactgagttgggagagactggagaaggagcaacaataagtttgtaggaaaggaatgaagagttgtcttttggtatgttaaatttaatgtacctgttagaaatgcaaatgaacttgttaatgcataatagacatttaaaatcaagagtgaaatcagttaatggtgttagggtaactggatagccacatgaaaaagaatgaaattggacccttacctcacattatacacaaaaattaagtcaaaatggatcaagacctaaatgtaagagctgaaactgtaaagctcttagaagaaaacacaggagtaaatcattataatcttggttttgagaaagaattattaaatatgacaccaaaaacccagcaatagaagaaaaaattagataaatttgatttcatcaaagttaaaaaatttttgtgcttcaaaagacaccataaagaaagtgaaaagagaacccacagaatgggagaaaatatttgcaaattgcatatccgataagattataataaccagaatatattagaaagtcttacaactcaatagtataaagacatttcattttaacaaatgagtgaaggatctaagtagatgtttctccaaaaaagatacgcagatggcaagtaatacatgaaaagatgtttgatactgttagccatcagtgaaatgcaaaacaaaagcacaatgagataccacttcaccccaattaggatggctatagtaaaaaaggcagataatgatatgtggaggaagatatggaaatactggaaccctcatacatgctggtaggaatgtaaaatggtgcagtaattttggaaaacagtcaaacagactggcagcttctcaaaggcttaaatttaatgttaccatatgacccagcaattccactaatagacatatatccaagagaaatgaaaacatatgtccacacaaaaacttgaacattaatgttcatagaagcattgttcataatagcctaaaagtagaaatgcccctaaatgtccatgaactaatgaatgggtaaataaaatgtggtgtgagaggcagggatgtgtcagagatagttaagaggaattgggcagtgactactaaaaggtacaggatttcttttagagggaaccgtcagctgaaacctaaaaagaggctgaatacaaggagaccagatgactgactattgagtttggtggcctggaaacaattggtggagagccttcttggtggagttgaggagggaagtcgaactggaatggatggaggagagaaaaggtgaggaagggaagataacttctgatagcttcttcaagaaattttgctttgaagacaaacagaatatgggataggaaatgggttaaagttgacttttgttatttattttctttgttttagagcagttttgctttttgatgtgactgttttagtatagaaagagaaattgatggtacaaatgggagatagaggataattattgaagtctctgagagagaatgagtccacatggaaaacggatgaaacttagatagagatggggcccttcattcaacgtaattggaggaaagtggaagactgagtaggtaaaaataagtggccccagttatcatatcacaatctacttcatgagaattaatgggcttctttatagttaccttatttttaaaaccactgtgtgtgtgtgtgcgtgtgcattaatgtattaaatttattttcattgtaaaaaaatttattttcattgtaaaacccaatttttgtttccctttcatcgtgtcccaatctgggatcatccaacatggtttacatttaaaaatatttcactgcccacttcacaattggagctatctgtaaggctttagccaacaattcttgcagtggaggagagggaagcatttcatcatatggaaaaatagccactctgcaaatagtgagtctcccaatctttggccctagcccggaagtcctcaagtagtactctcctttcctcagatactttgcttttcctatttccacgtatgcaatgatcagaaaaggataagcctccagaagagaacagagttaaataattttgactctaaaacagaaatatcatgccataccaatacatgaatagagaacaaatgcatatatattgttttgttcaccttttcaaaaggaattttgaatttttgaaagtaatgtgatataatgtttaatgctgtatgcttaataaaaatacatacttttaaggtaacagctatgtttggattgtttgatagaataaagtatcaaaataaatctaagcatgatcaaatacaaaatcatagatacatcataaaatatgagggctatctgtatttttcaatccttagaatcatctggtggagtttctaaaataaaatatcgatgtctaagctccaccccagatcaattaaatcagaatatctggaggggtacctgagcagagattttttttttttaaagctctgtagctgattccatgtgcagccagggttgagaaactttgggctgattattgacaatttcctgtagaaatgcacagaactgcctcataagcttgagttctggacattgcagactgcctgctactgacatacagaaggaaaaacaaacccactaaaatgcaattctacaccttctgaaacttcttatttcatagctttgtctgaaaacaaagctttgtataaaggacaagaagttaaaatgttgggcttttctcttggtttgtttcaagatggggaagtagaataaaaagttcatcaggctttggagatgcaaagaactcaacagctgttaatttgatagaagtgggaagtcagccagactaagaactatttttaggcagtgtattgacaggtgttttaccttctctcacaccctcctggacagggcttgcctagagtagatctgagttttaaaactttcaataaaagaaacagaagcctgtaaaaacagagtccacagcaagtaagccatctctacaccatctcaagcaacaggttgagaaagcttaaatgggagatatggttttaaaatggattttaatggctcatttgactgaaatttattttagggagaaatggattctagaaaatgttggcagttatatcaggtgaaattattttgttgtcaataatccaaaaatgagagcaatgggaagagaggaaagagacaaaggccaagtaggtctagctcttgagatgatggacatggtacctcagtaagcattgggaaacatctcacatattctgcttttgtgttaaagatgataaagcattggtagatgatggtgaaatgtttcagtgatggcttgacaagtaaatttatttcaggggtttgacaagaataaaatataatgaaacaaaatattataatctttgaaagatataaaatacaatgacggtaaatattataatctgcagaacaatcagttttgtttttaaaaacagaatctgtaagatgacctgaatcacacatttataaatcaaaaatatttagtatgaaatcaataattatttcgagaaagaaaacattattcatatatgtgtaccgattttattttccatacttttagagtgctgtattgcctgtggactttaaatatttaaattcctagtctgttattaatactaatttagtatttgcatgcgaatatcattttagttttatcattttcagttgtagctgaaaagctaaaactacttaaggattccattgtgtatacaatcataaattagtaatattagcccctaaaagttttatcaaagtaaatataccactgcagaaaagattccttcatttatttattcatccacaaattttactgctcactaatgtgtcaagctctctattggctttcacatttagagagaaatatgaaattctctcagccctcaagggaccctcgatctagaagggggaagggggcggggaattataaccaaagaatgccagtaaatttggtgcactgaaagaagttgttgcacatatagtgaaggagcagataaaggagtgggcagccttctggagcgtgagtggggatgaaagtgagagaaacaggtttgctgtgtgcatgcagatttaactgtggccaggcagaggggaatgggtgggtgtggggcagacagtgacaacagcaggtctcaaaaagtaagtaggcatttagggctcagacaagatggaagggtatccatttattccaacttatgaaaataacaataaatatatcttgacttaaattaaacttaattttttgaataaaggacttgaagaatgggaggatgttcaacctattaggcaaccaaagtatttttcagcaatttaaaagccaatagtgtacaaggattcccttttctccacaccaacacttgttatttcttgtctttttgataatagccatcccagcagatatgaagttatagttcattgtggttttgctttgcatttccctgctgattagtgatgtagagcaccttttcatatttaggtgctcttcccacacacacaataaagggtaactatgtgagatgatggatatgttaagacatttgaatatagtaaccatttcactgtgtgtgtgtgtgtgtgtgtgtgtgtgtgtgtataacatcatgttctataccttaaatatatgcaataaaaatggcttctgatggtaatgttatttctaagtaggaactttttttcaggcctcattaaaacaagacttctgtgattttgataagagatttatgtagtagctcttgtgagttgaaaagctagggagatagatacaaggaactagaggatgcaatctatggttgggttatttacgtatagggaacaaggacctcgtgaagccctagactattatatgcaaaaagcatgcttttgtttatttctctggggagatagtctatggttttcagcaaattctaacatgattcataaccctaaaaagttgattttttgccttaagaacttactttatatattttatgataccgacttttcactgagtgtctttattattttgagtttatgaaaaatattgcactatgaaatttagccctaaattagcaaattctctatcttgacttacattttctctagtgcagttacaattttaaggctattacatatcttttaaaatacttacacagagaatacatcgatgcaaaagatcacatacaaaatttcaatgtagacctgaacttataatcaaccattgcaatagcctctaatagcctattttatgacaaagtgccatgaggaaactctcaaagctaattgttgaaaagaatgataatgaacaagttttagagagtggacagcaggttataatatttatatataactcattataaattgtcaagtggctttatacactaagaagagaaatttattttctattctggtaaaataaatagcttcagagaagtgaaaataaaaacaggtattttgacaacattaacacgtgttaaccttgtgaaatggccatcctttaccagcctccatctggggttgttctaatgagagaatgtagggaaagtgctatgcatctaacatgtcagccgaagctagctcaaaattcactaaatcccacaagatgtattgaagggctgtgcagcattcctacttgctcaacctgtcaattgttgcttgttggataagaaaacaacattacttttaaaaaatgtcactgaactgcaatgttcagaaaaaataacagcaccaccctttctcacttgcaaacattgagaaatgttcaactacagctttctcctaagaactctgaagctaccaaagagcttttattgaaaggataatgtctgcacacctaccacacctgaattgcaatagttctttatagatctctaacaggaaattttaaaattaaactatattgttaaggacagcttttgtttgcatgtcacggataatctagattttagcttatcagtgttgccccttgtaaaacgctatattgaatatatcaataaacaaaaggatctagaactagaaataccatttgacccagcaatcccattactgggtcaaattactgggtgtatacccaaaggattataaatcattctactacaaagacacatgcacacatatgtttattgcagcactatttacaatagcaaagacatggaaccaacccaaatgcccatcagtgatagactggataaagaaaatgtggcacatatacaccatggaatactacgcagccataaaaaaggatgagttcatgtcctgtgcagggacatggatgaagctggaaaccatcattctcagcaaacttgttctcactcatatgtgggagttgagcgatgagaacacatggacacagggaggggaatatcacacaccagggcctgtcagggggtgggaagctaggggagggatagcattaggagaaatacctaatgtagatgatgggttgatggatgcagcaaaccaccatggcatgtgtatacctgtgtaagaaacctacacgttctgcacatgtatcccagaacttaaagcacaattaaaaaataaataaacaaaggtaatattatatagatgctattcacttgtctaaatgtttttaaaagttaaatttatatttagtttgaagcattcttttcatacctgaaaacatatatttttttaaatggaaatctttttttcacttccctaacaattaaaatatttggcaaaatcaatatcaaactttctaaagtgtgtatggaaatgtaaaggacagctaatgtcttcagatggatttatattacaaaatataagacctattatagaactgtagcatttaagatagtgtagtattggtgagaggttagatagcagtaaatcaatggaacagaatagagattccagaagcagacccatgcttactggtcatcttatttatgacaaagatgacactgtggtgcagtgggaaaataattttttcccccagcaagaactgcaaggtcaattggatagccttatggaaaaaaaaatgaatcttgactctttcatcacaacatacatgaaaatcaattctagatgaattgcaaatctaggtgtaaaggttaaaaacaaaatcttctaaaataggggttggcaaacttttcttgaagtgcccaatattaaatatttcaggctttgcatatcctacaatctctgttgcaattattcaactctcttccatggtagcacaaaataagtcataaacaatatataagcagattagcctgtctgaactccaataaaactttatttataaaaacaggtgacaggctgggtttggattgcaggctatagttttccaatcccttttctagaacatctttttgaagctcaagtaagcaaagatttcttaaactaaaacaaagggtagaaaccaaaaaataagatgtgctatattagattacattaacatttaaaaatgtgtttatcaaaagacactgttaagattatgaaaaggcaatccacacggtgaaagaagatattcaaaatacatatattcaacaaagaatttatatccagtatataaacacacacacacacacacacaccctacagattaataagaacaaagacaatccaacagcaaaaaacaataggaaattatgaaagtttcacaaaagataatatcaaatggccaataaacatgaaaaggttctcggcttaattagttatcagtaaaataaaaaataaaatgtcaatgacatacttctgtgtatccacagatgaaaaagattggcaattccaaatgttgtcaaggatgcagaacaaatgggacttgtaccctgctggtgactgtgtcagtgggtacaactcctttggaaaactgcattatctacttgaggtgatcataggtgtcctttgatctaacaatttcattctttggtagcaacacaaatgtgtccatatgttcatgaaaagacatatacctgaatgtccatagtggcactatccatattgtcacaacctgggaactatccaatgcacagcaacagaaggaaacataaatacatgtgttatattcacactaggaatagcatacagcagtgggaatgacctacaactatacatatggaaagacactgtgatatatttacataatatgcattcatactacacagcaataagaataatctaaagctatatgcaacaacatggatgaatgtcaccttacctccacctcccccaaaaaatattgagtgaaagaagccagaagcaaatgaacacactttgtccctttccctgctttatgtttattttgttctccttttatttctatttaatgtaaatttggtgtttcaaaaataacccacaattcataagcctatactgatacaaataagtgattgaataaattaatcagtgaaggagaagagacacatttgccatgcagaaagctccaaataatttatgtagataacccccatggagctggaacatacctctgccttttaagggcaggctgcacataatgacttccacaatatggacaggaggggagaaaaataactttacagtggagaaggctggcaaacgttacctcagccaggtgattgcggtcgacatcatcactcataagtcatttgacaatatgcagccttggcatgatgtgatgagaatggcactttacatctgtggtcttcctccccaaaacccataaccccagtcccatcatggtaacatcagacatgcccacattgagggacattccacaaaatagctcatctgtactcctcaaaactgtcaaggtcatccaaaacaaggaaagcctgagaacttgtcagagccaagaatatcctaggagacacgaaatctaaatgtagtgcagtatcctggatgggatcctagaacagaaaaaatgatatgaggtaaaaactaaggaaatctgaataaagtatggactttaataatgtatcaatattggttcattaattatgacacaggtaccctactaatgtaatatgttagcaataggggaacttagtacaggatgtactagaactttctgtactatctttgcaagttttctgtaaatctaaaattattccaaaattaaaagtgtatttaaaataataaacaattcatagagtaggcactgtgttacaccgcaactgggaagcgtgctctccaacatcaagttattaacaataacagaatatataggtagaaaacaaggaatagttgcataacccaatagccatttataatgtaggaattattctttgttttttctacaaatttaaatagatttctagtcattaaactttatgaatgtgaattacttctgtttactccaacacattaaggtaggagctttatgaacaattacttagagatattttaagttcaactctttatatatcaaacttcatgcagaagagatgagtgatgaaatagggaatttttttgttagtaattatggactattaaaaattaactttcactccattacactctttcaacaaatataatacaagcatcatagaatgttggaactgaaagggacatttaagagattagttcagctccttaacttcacatgaaataactgagtgccagagaatttgagacttgcccaaggtcataataaatttgtgggagagctggaattcacttattcagttgagtgagcatttacagagtatttattatgtttcaagcactgtgataggtgcaagagatataaaaattagtgagaatttatccttcaggtggaggaggcagggacagggagaggcagaaaaataaatagatgaatacagtacagcgtagaaacaagccagcagacatgaggccagggtgccatgaaatgaaggaacaggttcatttgatacaactcaggcatcacctgagcctttggaagatgggtgggatttacactgatgaggaggccggaacagacattccaagcaaaacagatcacataagccagaggtaaaagagggaaagggaaataatgtgttgtgaagagctccatccagcttccaggaactgcagaatagtgtaagcagggagctgagatggatgaaaccaacaatgctagatcctggagaggattttgtgccatttaatgagctaagtctttatcatgtaagaaatagaaagttattgcaaggttttgaattttagtttggccactcagatggcttagtggaagttagattcgagaaggacaagacattactgggaaccctatcaaagaggttactatagcactcaaaggacggatggtaaacagttggtttagaaaagtggtgataaatatgcagcaggggaggtggagtcaataaatatttaagaaaaatgatttgcgattagttggatgggggtggggtaagtggagtgggtggttgaaggtgttggccgaggagtcttgagctagactcctagtctataccacagatctttggaacttcaaatcacaagaagcacacattagccccgagctacgtttacacatttttccacctccaccctaggaagcagctctgaatatcagcaagtgaaacagttttcgataagcatttaaacaacaacaacaaaactcatatccttttggtcttatcctaggtcaaaaggtaccttcttgccctacacacatataatcaagaggaaccacagaggtgattctttgaagagccaagataatttgcttccaaggcttttgtctttactcctaggctacagagcctgccctaaatttcaggtataccccatagaggccatcatcttgaatctctgccccgacacaccctccattaggccttgactgtgggtgattgtgctgcctataaaagagaatgtatgaagaggatcaagagaaaatataatcagttcaccgttaaaaaagctaaacttcaaatgcctgtagaatattcagttagagaaaatcagttggcagtaggataatcaactctgaaactcaaggaaggcatgcaatttgaaagtcaaaggtcacggtaagagaaaaacatgaacgtggatgccatttttcaaggagagtctctagcataagtggaaaagtgggaagaatgtcaggccaaagatgaaggtcacagggtcaccagcacttgaagtacagctctctagtagaaaattcaatgaagaatttataggttttagaaatctattgcataatatgatgactacagtaacataagcatgtactgtatacaggccaggcgcagtggctcacgcctctaatcccagtactttgggaagtggagacaggcagatcacttgagctcaggagtttgagacctgcctgggtaacctgacaaaaccccatctctaccaaaaaatataaaaattagccgggcatggtggcacttacctgtggttccagctactcgggaagctgaggtggtgggggtcgcttgacccccagaggaggggactgcaatgagcagagatcacgccactgcactccagcctgggagacacagcaagaccctgtcacagaaaaaaaaaaaagaatatactgtatacttgaaaactgctaaaagaatagattttaaatattcccaccacaaaaaaaaaggtaactatgtgagatgatagatatgttaattagcttgattgtggtaataatttcacaatgtgtatgtatacgaaaacatcatgttgtgcagtgtaaataaatacaatttatatttgtcaattcaacctcaataaaactggagaaaaaaattttaaaaaaatcaacagcacagtcagaaatgtatcagagaaactagaagagagttgtatcccagagcacagaagttcaaatagttttcaaaacaaagtgatcaattgtattgaatatagaagaggtgccactataaatagcttttgtaaagatattcattaaatttggtaatgaagaggacaaaggtaactttagtgaagtgatttcactgtagtgcttgtctttagttgcagtaaggtggattgaggagtatgtgagtgaagaagttgagactgcttttccacactgttctttgaaagtgtggatgaaattggaaggagaaaggcaagaaaaagtttaggagcagagccgtgggagactcttgatcttgtctgtttgatttgggatgagatgcttagtatatttgtaggctacagggaaggatgcccccctagaaagctggtgttgacaagagagggcattatgaggcagagtcctggaggaagaaggagaggcccaggccagggtcataggcacacagaatgggggctggcattcaacagtcaaaggatgatagggatatttctttttcaggcccagaaaggaaggaagcaagccatcataaatgaatatgtagacaagtttgtgagaatgtgtgtatgtctctcagagagagtggtgggacagaagggagttgaaagagttcatacttgactgttatttatttacttattcatttttttttcctagtaagaggtaaggtaatctgctgagaataaggttaggtggagttctaggagagcagtgagtatttggatgaagactgaggagagtaggcaaaggaattaccgaggaaaaaaataagaagattaaactaagcgggagggttcttttggcattttgttttttgttttcagacgaggtgtgattctgttacccaggctggagtgcagtggcacaagaatggctcactacagcttggacctcccaggctcaagggatactaccacctcagcttccctagtagctgggaccacaggcacgagtcaccatgcccagctaatttaattttctgtgtgtgtgtgtgtgtgtgtgtgtgtgtgtgtgtgtgtgtgtgtgtgtgtgtgtgtgtgtaaagatggggtctccctctattgcccaggctggtctcaaactcctagtttcaagctgtcctcccagctgggcatcccaaagtgctgggattacaggcatgagccaccatgctgagccatgagtgggagattcttaattgggatcagcaacaatctatagtcttgcataatttttcagttgtactcaactaccactatttagttaaaggcatttattaagtattctttactatgttcttggcattatgcattgcaaacattaccacaaaccacagtaggtaggtacatttattaccccaatttacaggttaagtaacttctccaagtttgcacagctggtaaaaaggcagaacagaggcctgtccgactccaagccatatgttattttccatatgttatacttcctcccaaggagttggagctttaagaattgataagacattttgcttagcctgagaaaactcctaatgcacaagagaagatatgccaataaataatcacaagcaaatgtgaggtattgatatgctccaagagcagagaacaggagcccatcattctgatgaaagcttcagggaagcctcagggggctggcatctgagcactgactaggtctgagtttatattcaccaggtggacaaggagtctggagcatcccagacttggggactgtatgagcaaggacaaggaggtgtgagaaggcaacccagttttgctcaatgcatctgggacatagagtgactgttgggtgaggagtggaagacttggggggagatatgagatcagataataaggggtattttatctactgagaactttatctggtaatcaactggataacatgtaaggttttaaataatgatattagatttgagttttgcaaacatgatcatgttggtaacaggcagggtggaatatagaatagggagatcaataattataataattataagctgtcacttactctggatcaggcactatgtaagtgattttcttagattcagcaatttaatcatagaaaagaaagaatgagccccaggtttctagctctgaggccagtgttctttccactgttttcttatttttcatagttttcttgtttatatctaaacataaatcttctgacactaataatcattcaaatagtgtccctacccaaattcatgtctatgcagaatctcggaatgtgatcttatttggaaatagagtctttgtggatgtaattagttgttaaagtgaggttgctaagagagtgggccctaaatcccatgactggtatccttgtgagaagaggggacacacagaaaggaacatgaaggccaagacagagattgggatgatgcagccacaagccagagaatgccaaggattgccaggacccaccagaagctaggaaggggctaggaagaatttgtccctagagtcttcatagggagcatggctttggtgacaccttaatttggggcttttagcttccataattgtgagagaatagatttgttgtcttaagccaccaactttgtggtagttatggcagccctaggaaactaatacacctttcttgttatatttccagctagggatatattcttatatgtttataactgtgtggattttgagggagaaatcactcatagttgatgatctcatgggcctgccatctttgtctttattgcatttcactgtcatttgcctgatagattaatctcatttggattccctggggcaaatcttgttttatcttcatgttgatgttgctgcccatactcaagtattttgggttacaaaagcagaattatcttttaaccctagcctggcagtaacatgaagacctactttataaccaaaacaatttctatgcttgaaaaaaagtattatataaaagtactcaagcctgctttcaacttgacttttgtactgacctaggggttgacagagtctgcttttattcaagactggaaatatcaggagatgtttgcaaagtacatgataagccagttaagcagttgaacacaaagagagtctttttatatcttatttgaaacccctgagttttgacaacatagaactgtgaaattttagagctagccaaatagaattgacatgcaatgaataggagttaaaatcattttaattttgaccaaaacaatagtattgactttaaccctacatcatttttcacttttgctgccaaccattttcttttgacatgtcacttacatttgttacctacttcacaaatgctcctgggattggttctccttacaattcatttttcataaaggaaagctggacataaatgcatttgaggttttctagggttacctattcagactcttcagtcacagagacaatcttatgcaccctctctctctctctctctctctcccacaagagctttcaggtacatcctgatgataaagagaaagacatgatgacttgagcagttctatgcagagcatcttctccacaccctataccgtggtcccacacagcgcagttcatttcatgcttccccatgaatgagagtattgtaagttctatgtgcatgaagaaataaatgattatcccattctccagaaacacaaatgccgtatcacaaagcatgcaccattttccttttaaaattccttcctgaaaagtgtttgtggttgttgttttgatgaattaatcatattaggacacagaacgcagatcataagctcagtgatgaagaaactcgtaacattcaagtttcaatggaaatgtttcctgctcagaaagtccccttgtccctttgtgtctcctaacctccattttattttatcataacaccaggttatgataaaaccataatacctggttttttatcataacaccaggttatgataaaaccataatacctggttttcttatttattaatgtattcattgtcctcttgtctgtctagactcgtaggctcttacgtgccttatcactgcattatctacagagcctagaatggttcctgttgctaatcaaatgtttttcaatgaatgaatcaatgactacagctagatatcccaggaattataaggagtaagaattcagagaaagaaggagtagtggaagctgtaggtaactgaagacaggttttttagtagagcagtagaagcagggactctggtaggggacctagagagaaaatctttggtaatgtcgggaaggagttagcttcaagtcttcagagacaaaggaaagaggcattcagaggttgggcacaaaacagttatgagtgggagaggatgaatgggcatttcctagagttgtgtccttcaggcagctgtagagagagatggtggagggggttatgtaagctgaacactctcaaagctgacctataaaatatactaagtaaattggactctcagtaaaggaaattgcccaattcctaagcaccattttcagaggcttcacaataagagtattcattctgaaatcctacatttgcgtgtatatacataactccatggaaaatgaccttataatatagtaatgatgtgcaatacagtaacatgctggaaaaaaaatagtgtagactttgaaatgaagtaactaaatcacaatatgcaagacatattcaagcaaatattcagataaagttacctgtcagtgggatgtgtctttgcctgttctctctacctgtgattccacatggctttatataggaaacaagagaggcttatttcacccaaaatatcctaggtatttttttatcctcgatattgccagataaagaaattatagaaagaaggcagagcatatcattgtgttgaaagaaaagtaaggaactctagttatatcaacattacccaatgtcacctggttacattaaaaagttctgaataaacagcttgaggggaaaaagacattttctttttctgagttaatatgtctctgtgctgtagtctgggcatcttttcaactttcctttgttgacttggctgtttttggattggaggcttctttttcttatctgtgtggaggaatgcttttctaactagagcctgatgattttgctgagatgacaaggcttgtgtgggtttaccacagaacacaaaaggccgtgtagcccaaaaagaactgaaatatgttctctaatacccaagggcttaccaaatgtggaggtaacattcacattccaacatgaggagctgccacaccacctctcctggctctattacctctggtggcaatctcatccctcctcgaatcgtcaacccttctggccaagggtcgggtacacattcagccaagtgctgtgatggacactctttcctttggagagagcatgatcaagatgtgaaggagctgcatgtgttactgactgtgcttccaaaccaccactgctgttcagggcattgcatttctcctatatgtaaaaccttccctagattccaaacttgatgagtcaagacctgatagagagaagagaagagaagagagagagcagagagaaccagataagtggatgaaagatgtaagagaagcacagtcattgggagatttctgctgtggaggggagaagacttttattataataatattataaacaatagttactctatgaggtaatgtattcactgcaggtaatagaaaattagactaacattggcttaatgaggtcaggatttattttccccacacaatataaaatctaaaggaagtcaggcctccacagggtcttgcaggactggggctctgtctggcctacttttctcaatgtgtcatcctcatgttcgtcctctcatggtcacaagatgattgctgcacctccaacctgcattccagtcaagtggcaaagtgaccaagaggctactagcaaggcttttcctttttatgggaaaagatcttcttcgaggaattcctacccatatccctttggccagaactgagtcatgtggtaatccttatgtgcaggagagactcagagcttgggaattcactattctagcctccgtggtagagattaccccagaagagagaaagtgatggtaatggattctggattaaccattatgagtcaagcccaaattatcacataatcaaaggaaaataatacatctaagcaccaaactacaaaaagctaaacagcagtttaaaaatgatcaaagattatgcagccagaggcagcaacatcagccaataaaggtaacaccaaccaaaagcgattgaccaacactaaagtgctttagacttgcttggctttcatttagcatctcatgaagtatttcttctcttatatcgttgaagacaaacagaaaaaaaatattttagaattaacacagagtattttttctcctgggatgttagaggaacacatgcctgcctgagtctccctggcactgtgactatgctcctttggtctggggcaaagcttctagtagcaaaggttgaagacaccatggagctgggattgtaactggaaaacatgacaaggatagggagttagtcaagaacaggagcaggggtcaggcacagtggctcatacctgtaatcccagcactttgggaggccgaggcgggtggatcgcctgaggtcaggagtttgagaccagcctgtccaacatagtgataccccatctctactaaaaatgcaaaaaattagctggacatgatggtgggcgcctgtaatcccagatactcgggaggctgagtcaggagaatcccttaaacctgggaggtggaggttgcagtgagccaagatcgcaccattgcactccagcctgggcaacaagagcaaaactccatctcaaaaaaaaaaaacaaaaacaaacaaacacaaaacaaaacaaacaaacagaaaagaacagtagcaggcagaatttgtgtatttttctcatttttccttcctctctggcacctgattaacatttagccttcaagttgaagctaaatcatcaccgcttgcttggagtctattgtacctcctgggtgcacacatcacagagttacatccattcccgcaataaacaattacttagaagccaccatgttccaaattctgccataaaccctgggtttaggacagttcaacctctgctgtctagagtagcactacccaagagacatataataggagccccataggtaatttaaagttttctgttatttacatttaaaaataaacaggtaaaattaattttaataatagatttgatttaaaccagtatatgcaaaatattactattttgacacaattgttatgacatataaaaattattagtgagatatgttatactctttttttcatactgcctccaaaatccagtgtgtattttaacatagcacacctcaatttgaaccaaccacatttcaagtagtcagtagccacatgggtgagtggctgctatgtcagacgatgttgctctagagcttacagactataaataatgatttattataaaacgtgcttaaattctttgtagattctggatgttagccctttgtcagaaggatagattgcaaaaatttgtaacaaaacttcatgttctacacatgcaccccagaacttaaagtaaaataaataagtaaataaataaataaataaacatgctaactatgcctaataaatgtctaatttatgcagctcacatcatttgggaatggggaagcagtctcattgaggaaaggtagtggcttctctagtcagttctccatatgaagtcatttgtctcagtgatttctccattacccagagtctagatctcagccacacgggtttagaaaaacttgatttattcaaagtcctaaagtttatttacttcgcaatactggcctctcacaacagaaatctgagagaccggtgtattagaaatgagaatcctgggccgggcgcggtggctcacgcctgtaatccctgcactttgggaggcagaggcgggcggatcacgaggtcaggagattgagaccatcctggctaacacagtgaaaccccatctctactaaaaatacaaaaaattagccgggcgtggtggcgggcacctgtagtcccagctactcgggaggctgaggcaggagaatggcctgaacccaggaggcgagcttgcagtgagccgagattgtgccactgtactccagcctgggcgacacagcaagactctgtctcaaaaaaaaaaaaaaaaaaaaaaaaagaaatgagaatcctggttcatttgtgatgaaacatgtctgtgcatttgtattatctccacagaccagggtttggctaccctgacctgtgagacaaatgcagccccccacctgtttttgtacagccacaaattcacagtggtttttgcatttttacatttaaaatgaaagaagtcaaaagaagaataaaattttttgatgaaaattgtacaaaattcaaatgtcattgtctataaataaagttttactggaacacagccatactcattcatttaagtattatctataactgcttttgtgctgcaatagcaaagttgaatagttacaacagagaccatatggcccacaaagcctaaaatatttactatcttgcccattacagaaaatgtttgccaaacccatgttatgtatgtgaatcacttgaggagctttagagatgtacaactattcagcactactctcaagtaattcagatttaattagtctctggtgaggcctaagtatcagtatttaaaaaaaaaaaaaattgaatgctgtagccaatctatgtaggaagccaaagtaaccagaaggttgtgtggaaatcatggatgcagaacaaagagaatcaagaaagtaacttgagtacccgtcctcccagtccatgcctgtcagcatacaggccacttgagtcagcatgccaaggcacattcttctgagtcagcactcatccctgttcctattcacctctgtgaccttgatgttcctacatttccaaacttaatcagctcctctattgattggcacattcttcctgtgcattcaccagttaatcctgccttatcagcctgagggccaatctgtctctctaacatgattttgtttatgtctgttctgagtcactatgtgctgctttaataggtttcttaagaccaatctgatttttctgttttgttgttttccaaaatgtttcctggttgcctcagtgcccgtgccttagacaacttacattccaattgctgcttttcttgggtatctgcatttccagcctgacatcaactagtcacttaagtgtttggtggatgggctcattggtagctgaataagtgaacggatgaatgagtggggaagaaaagtggggaaaaaaatacaggaggaattttgtagactatgtattgtgagtatagtgaattttaatgctctagagcttacagactataaataatgatttattataaaatgtgctaacaaaccagaatgtccagattcaaatcctgactctgctactttccctggaaagccccatgggaagatccctttgcctgtattaacaagactttggatatctgtaagatgggaagagttacacatacttcacagaatagtatgcggatgacttatcaaatacagtagcacctactccaatgcctgactcataacagcttctaaatagaaagtttcattcttcttccttctgtttagctaaggcatcctttcacacttaaaagggcctgaattgtttatagttaaaaatagtttgctgtcttatttattatactatacagcagatagcagtattattaaagagaacttggtaaaaatattttattgtttgaacaaatagtttataacaatttttcaaataattctggattctataattctatattaaccttatagtttgatgccatggtactaataatggaatttttacaataacagtatcatatacctattcatttgtagtccatgtctttttttgtataagatgaaattttattttttcttcaaaggctttttaagttttaaggtaggatattacttaatttgaacccatgtcttatattttatatccttaggaaaaacataggccatcctaaaaaccttgtcctttcttatttgttggtttctcaatagctgtaggtattgaaggattaaaagttttcgaccctagcttcacattagaaatcccagaggagatacttttaacctttaaataccaatgccaagccccagtccaaaccatactttctgatggtggagccaaaggcattatctgttttcagtcttccagatgataccaatgtgtagccaaagttgggagctactaatctaaacccaccctccatggtttttgttcatgtgtatgtgtgtgtgtgtgtgtgtgtgttgagacagtcttgctctgtcgcctaggatggagggcagtggcataaacttggctcactgcaacctccgcctctaggttcaagggattcttgtgcctcagcctcctgagtagctgagatcacaggagcccgccaccacacctggctaatccaccctctatgtttaacatatgagatgaaatgaagtacagaggtgaaacgattggctcaaagcccttcagcttaactgaaactgaaactcaggtgttttacctcagaccagtgtttcaggctaatcctaaaccaagaattttaggacatacagttttcttgatacatacaaaaacttcactgtaaggaatatttttcagttaatttaaatataacttatatagagaaaggaaatataacttgttatagaaagagtatcagtgatagaagaattaagtatacttcatgtgttagatgtggtgacttattcatcattaggtatgttttgtgaggtagacattatcatttataaatttcatatattttaaatgaggaaactgatacacaaagagatcaatagacttgtattaggtcacacagctggtgagtggcaaagtcaggaaaggaactcaaaacataggacacttagtcccacctttcttttcccttcctaaaaatagaaccctatatttgtaaaatataatttttgttttgttttccttttggaggccgagtggaaaggacctcttggataggagtggtgaacaaaatgcacttacgtttcacaaaggaccattttataattaacttggatggggcccagtgcgagagaacagaagaatagtattgagatgaggggatcctgcagcgtccaaatagaattagaactagacgccacttgtcaagataaatgtttgacaaaacgggcatgtctctccagaattcattaaaatgttgttttaaatattaacaatttcttaaagcaatgctgttgatgcttaagaagttatactaacaagtttttctttattcttccttggtccagctcttttgtgctctatagaatgactgtaatcacaaaataagctcccaaagtagtgaaagttcctcaatataaatgataaggccactaaagcccagagaagccatatccaacatcacttgagctagaatgcaatgaagatgaatttagtagctaattcaatttgacatcaagttgagctacagattaaatatagaaaaatagccaggcacagaaagacaaacttcgcatgttctcacttatttgtagggactaaaaagtaaaacaattgtactcatggagatagagaataaaaggatagttaccagaggctggaaagggtagtgatgggtgcggttcttcacagagaagtggggatggttaatgggtacaaaaaaatcactagaaataatgaataagacctagtgtttgttagtgcaacagggtgactatggtaaaaaataattttattgtacatttaaaaataactaaaataacatgatcagattgtttgtaacacaaagaataaatgcttaaggggatggatatcccctaaataaataaatgtaggaaaaacttggataaatgtttctattagggaaaaataaagtcatttagaacattaaggacattaaaagaataaagtacacggtattaaacttgaagataaaaaaacagagtttttaggtccaaagaattatattcagtgtttgtttattcaacaaagggtttttgtttgtttgttgttttgttttgttttgtttgtttttagtatgtgccagaaatggtcctgggtctggaggtaacaatggcacacatggggggaaatcatcaataaacagtcaataagtcaataaacaagatcatcgcatctttgtaagtgctctgaagaaaataaacaggatgtggtcttggaaagtggatgagaatggcttcttccgtagagaagctgcgaggcctctcgggagaagcagcatttgaggtaagatctgaaagctgagaaagagccagccacaggaggagctaaatgcctgagacagcagctatgcatatgagagcaatagaaaagaggccaaagtgtgctgtaatgtatgtccatgtactcacacatgcatatccacacgtgtgtgcatgtgcgcactgaatgatgacaaaatgtgaacatcagctagactagtatccagaaatcaggataggtaaattcccttgacatcatattttgaagtgttctaactcccttttctcctacccaatgccctccccctcaccccaagcacacacatggaacttgggaaaacattaaaaatattgacttccagaaaggtacattacatctttatctctagttcaggatgtcatatcaaatgactcctgcctatgcctggttggtggattacttttgtaaattcaactatttggaaaccactagttttcaaaagactaatgtgcagcaaaagaaaatgtctaagcctgttttgtgctgctgtcacagaatacttgagactgggtgacgtatagagaacagaaatttattgtttcacagttgtgaaagctgtgaagcccaagattgaaggaccatgtctagtgagggctttctttctctgtcataatatgttggaaggcatcacgtaccaagagagcccgcaggagagatggaaggggccaaactcatccttcataaggatgccacttctctgataacagcattaatccatgtgagggcagagcccctatgacttaatcaactcctaaggtgctgctgtcaacactattgcattggagattaagttttcaacacatgaactttgggggacacaatcaagccatagcagccagccactatattttcatggaaagaaaacatattgagactcccacaaagtaaacttctttggatgccatgagtgtaaaatcttgatttgagcttcatttcatagccatggtggcaaatcaaattgttaaatatatttgtgagtctataattatggagaaagtcattgtctcataatatattccaaaaatgtttaaatatttgtttgtcctcttcttttttcagtgtctcatagtctttctcttttaccatgcccatttatttcttgacatcaccattcatgaaccttcccaacatggttttaagttcaagcttcttgttttttctgctttggtaggatcttgctataccattctcttgcccttcgaagcacaataaagccaataatagagacatcttcttgtatcagcattttggaatcaatattttcataggtcttttacagttaaatcagctcttggataaagtggaactttaagaaagtctggactttaaaatgactatattctggtaatcacaaagtcataaaacagagcatttcagtgacgatgggtcatgttttttcagtcttaatttagaatttttttcaactgactttgagttgctgttacaattcaacctgcctctggtgttttatatgccttaaaatttgtggctactgtataataaccaggaaagcgtagctacagggttccaattactttggcaaaggagccttattacattgtctccaactaagcacataattaatgtctctatttcaaggctatttcagcaaattcaaaacccagaatctatccatacatatttagggatgcatgggaacacttgtgatgtcttcattgcagcagacagtaataccagaggaatttttggaagaatatggaatactttatcatgggttgcaaatattttaaagatgtggtttgaaattaaacatgttgttctaaaaagtctccatgggaatagaatgtaatagaattacccacctcctgggagagtttttttatgggtgagacattttcagattgttacaacgtctgagcaggcattatatggcaagagagcacataggagatacatatctgtctacagtgcgtagggcatttgcaccttgagtatcctgctggacagttatgtaggtaaaaagcctgtttgtaatcatctgaacttaagcttatctccattttgcaaataaacacaaagtatttttgcacaatcttaatactcactgaattttgcagaaatgcagctaccatatacatgaagagaatattgtggttagttttgttcggaactttaccaagaattggtcaccatttcaaaaaaaaatcacaccattgatggcagcacagcttgtggcatttgagttgccaataaaacatgcccatattattatacatttgcagcagttgcagttgcgaggattctgcatttaggtgccaccatccaacaatttaattatattttgtaatcaagcagatcatgcccaaacatttacctatagaaatacatttttgtcatgaattcctcttcttatttttccccttatattatgggggagttggcattttgtatttaggcaaattattttattcattaatttcttttcagaatactagagggacatttaattatattatcaaaggagagttaggtgagataagatcaagaacaattctgaaatatatcactcctccaagaaaaagggggatgtggtgcctgcgcacacatgtgcccttcaatgcgaagaaagaagcaggaaacggagatgggagaattggccttgatttcagctcttattgagtgtcaggccctgtgcccagcctttcaaatgcatgatctcattttttgtgcatagtgctgagaaatgccatgtgtgctttgaatcctgtagccccagagtgccacactgggagctgactgcttgacattcggagatcagagaatgagaggaaatgagtatatgaatattcttgacattgctggagtgttagaattatttaaaagttctgttaaataagtgacagtctcagagcctgatgtatggtagttaatgaaattttcacaaagaagtattatcataaaattcgaagaaaatcatagtagctgcgcacacaaattcacatgcatatgaatgtcagtgcacgttggtgcattcatgcttcctatttatagctttcgggacacatccgaaagtgataaatgaacattgaaatgctacacatatgtttatatccacttttagctatggggttgtctcaaaatgtggtatctccactgagccaaatcccaggcatttagaaagtacgaaaaatttaaaactttaaagtgaaccaaagaggagagagaaaaaaaaaaaaatcctaaaactgagagatatggcaatcataaacctggcaccaaattactttttaaagtacagtatgaaaaatgaaatgtgtcagaattggttactaatacttctttgttggctaattgtcatttttcaagtgttggctaattgtcatttttaaagactgataaaagaggacctttccgatacacagatatcatggcatttttaagccttgaggttaattttactatatataacatttcaggggtgcaaatgtaaacattataatttcagataagggacagattgctttcttttaaaaatgcccaggtaaagctaaaggttagcacttaatgaggggtgtatgtctgttcatctctttttttattgacccgaatattgctgtaagaagaaataaaacaaagcaagagaccaagttcagaggagagagtacctgtgctgaaaagatggcgttttgcaaccactgcaataaaatgaaaatgactagaattttgaaaacctttttcttaagtttcatttggttgcaagttacagaaacccaaataaaactgatttaagcaaaaaacaaaatgttaggtcacctgactaagaagtccaagggtattgcttgcttcaggcatagctagatacaaggaattgaattttgttaagttgtctatctctcttgccatctcttgactctgctctgtctcatctgaattgacttctgtctaggtagatgcttccgacatgttggtggacagaagcataatatctaaattattctaatccgagcaaaacaaaactttctttttccaaaaattaaaaaaaggggggagtgcgtgtcttattgaaccaacttgggtcacatgccaatgaagcaaatactgtgggctggggcatgaattatgctgattgccaggccaaggttatgtgtctctaagataggagcagagaggtgtcagccccatcagaacctgaaccaaatgcactgataccacaggagatgagattctataccctccaattgctagtggcccaacccaagagggagcagtcagatattgcaaaaatttgtattgcatatattatagtaacataaattttaattttgtacatatccctcttgagatgcaagaatgcatagttagagaataactgaatttcaaaactgaaaaagatcttgtaagttatgtagttgaacattatcaatttaaatatcttttgagaattcactcatctttaaattgagtcttgctaattgcaaaaactggttattgtatagcagtgcaaaatactaggtgggagtaatataacatatgaatcagaattgtattaaaagcatttgttgtatatcccaaagatattttaggagtcactcactgatgtgaactacagggattattaccaaaagtttacacaaaaattgttttaatctgattttccccatcccagctatgttatcacttctaaagtctctattattatcatgactttttactcagtttaaaacgttcattgaaaagtaattctaacttctttttgtatatatatatatatgttcctctgctcactatttctcctaattattacagacaaggacaactggtgtgccctgtttactaggaaaaaacaatcacttcataaatatacacctttcagaaaatgtacacctttaaaagaaatccaaagtgaaccccaaatgtacagtcacacactcaaatccaaattccaatagctcacactaaatagagaagtatttataatagaaatgtatttgtgtttctaataaccaatgagtatatgaatattcatatttgcctattataggcaagtcattattaaatataatttatggaagcagttacaaaatattaaatatattttgaagtaattgccaagtcctttgtacaaaggaagagaaatttgacccaaactaataatctcccattatttgagattttgtcattgtcagtttgagtttacatttgaaaattatgtgactgcctggaatcccactcccaagcctggacaatgatgtaggtgttgtatttcaaaactagccaggaccacagagagctaaaggagctcttttttgcctgcaactggttacctcaattcattagagctgataatgaggccaaggccaaggccagggctatgacctctgtgaatgtcctaagctccctggatatgaggccacagaccatagcactgtccctgtccttaaggagaataagattcgaaggatatggacagagtaatgcaaaacactctccaacattataaggccctctacatagcatgctatccagtgctagtggccagactcttcattccagagttattcacatcataaatgggaattataaaatgataggaatctttgctgacccatgaaagctgatttaaggtttcaacataattagctgtatttgtgatattaagacagtaatattaaattttgcaagaaatactgatacaaaaaattccaaaggtcaaaattgaaatacaaatagatactataatgggattaaagggcaagaacatctaatggtgaatctgttcaatgaatataatgagattattctcaggcagatgagtccctagcttaaacaagaaaatgaactatgcagagcagagatataatattgcaacttctatgaactcactgcctttacgttttgtcaacacacattaattctgatttcttttaggacaatcgaattactatgacaagtatcagcaaagcttcatgaacataaataaatttttatttaatcctaaatttatctgaactagctaatttattcactattcccgttagaacagcatatcaaataaaaactcacaatgcccatgaactataaaattctttaatttatcaaaatattaagtataggccaggtgtgatggctcatgcctgtagtcccagcactttgggaggctgaggtaggcagactgcttgagcccagcctgggaacatggcaaaaacccatctctacaaaacatatgaaaaaattagctgggaatgttggcacgcacctgtcatcccagctattcaggaggctgaggtgggagaaccacctgagcccaggaggtcaaggttgcagtgagcagtgatcactccactgcaccccagcctgggcaacagaataagaccctgccaaaaaaaaaaaaaaaagtgtttagtataaatactgcttgttatagttacattgacaaatacccctaacatgctatcagagctcagccattaagttaatgttatatttaataggttattatagtgatactgtttagccaattgaggttttaattgtgtaagtaggatacattacaaattaagaaactttattggatttttatagaatagtggcttagtgcatgagttataacatagacttatgatgtgaataaacaacaaaataagatcaaattttggccagtattttgagcaggaaaaaatcaacatattaaatcattgggatattatttataattattaaaaactcatgaattcttaactagaattataccttctatattcattattagttatgaattaattcttaaatggctcaaatatgaatatcaccatgtgtaagatgctaaaccagtcactgaggaaaaacaaataaatgtgaaaattgttgacctttttaaggaatttatggcctagaatgtatgcaagatataaaatactaaacaagaagcaatttaaagcactctgtgatacccatgagtgaactggggtgtaaatcctctaatacttaaaaaacagaacacagtcactatgagattgtagctaggtcttcagagattaatatacttcatattagtaacatgtgcttgaaagttcatgagtatgtccagatacttcttatctcaatatttccttggatgtaattactctacttctttgaaatatcttttaagctggtattatggtttgaaggtatcctgcaaagtttatgtgttggaaagttaatccccaacgcaacaatgttgggagggagggcctaatatgaggtgattcagtcatgaaggctctgctcttaaatggtttaaagttgttatgacagaagtgagttagtcatcagaagagtgggtttgttattcaaacgagtttggttctctcacttgcatgtgctctcctcctcttctgccttctgccatgggacaatgcagcaagaaagcactcacaaaacacaggccccttggacttcccagcctccagaactgtaaaaactacatctccattttttataaatcacccagtctcaggtattctgttacagaagcacaaaacagactaagctgttatttccatttcaagcattaggtttcacttagtgtaatacataattcataaatgtgaatattctcagttaggtgcacagaatgggattgatcaagcccccagttcatggtacacagacattaatagtcctgagattggcttcctttttatataatacttcattttaaaaattgtatttgtctaccctatctcctattttcaatcccattttccctatttgtgtatatttaatgtaggactgttcacttaatttttaaatttttatgaatgcatatatatgtatatttatatacatatataagacatataattatgtgtgggatatgtttttaaatttacaaacatttagttatataaatggcaaagagtggtgtatcagccagggttctccagagaaacaaccagtaagatattttatttatatagagagacagagagagaagagagacagagagacagattgctttcaaggaatttgcttgcttacacaactgtggggactgggaagtctgaaatctgtaggcaggccagcagaccggaaactcaggcaggagctgatgctgtagtcctgctgccgaatttctaaaggaactcttggttttgctctttagtccttttggccaattgaatgaggcccatccaccctgtcaaggtaatctcctttgcttaaagtcaactgattgtagatgttaaccacatctacaaaatgccttcactgcaacagctctattattatttgattactgggtactaccatttagccaaactgacacataaaacttgtcctcatacatggcttctggtttcctgttctgcttaagatttcccccacttcttcaagtaactttattttaatttataactatacacctagcttcaacaacagaatacacttgtggacttaggttgtataccatttcaactcaagaaaaagaatctgtattttctacagtccagtctagtaacatttctttgagatcaaacacggaggttccagagtttgaatgtgaaatgaatacgatggaggcactgaaactggttcttggcatcatagtccttaactgtgggactgcctgcagtcctgttcttgaatgagaattataaccagccttccttgagcacattctgcatgccataccttgggccaagagctttttatgcactttaattatttctcacagcaacctcataaaactcttccaaatagtgtaacagagaattaaatgtgtagccctccagatgatactgaagaagcatcaagctactttgaaaaaaatatattttaaattttatttattatatcatatgttctatttactatattttaaggccatttagaataattcagacagaggaaaaaaatttactttgattactagtaccttattgtgtactttaaatctgactcttgataaccagactaataattataagagaaagcctacctttattcccactcctatatcagactgtctgagttacaatttgaatttcaaaggtaatgccacacactttttattgataggaatagtttcagaaggaatggtaccagttcctccttgtacctctggtagaattcggctgtgaatccatctggtcctagactctttttggttggtaagctattattgccacaatttcagagcctgttattggtctattcagagattcaatttcttcctggtttagtcttgggagggtgtatgtgtcgaggaatttatccatttcttctagattttctagtttatttgcgtagaggtgtttgtagtattctctgatggtagtttgtatttctgtgggatcggtggtgatatcccctttatcagtttttattgcatctatttgattcttctctcttttcttctttattagtcttgctagcggtctatcaattttgttgatcctttcaaaaaaccagctcctggattcattaattttttgaagggttttctgtgtctctatttccttcagttctgctctgattttagttattccttgcctcctgctagcttttgaatgtgtttgctcttgcttttctagttcttttaattgtgatgttagggtgtcaattttggatctttcctgatttctcttgtgggcatttagtgctataaatttccctctaaacactgctttgaatgtgtcccagagattctggtatgttgtatctttgttctcattggtttcaaagaacatctttatttctgccttcatttcgttatgtacccagtagtcattcaggagcaggttgttcagtttccatgtagttgagtggttttgagtgagtttcttaatcctgagttctagtttgattgcactgtggtctgagagacagtttgttataatttctgttcttttacatttgctgaggagagctttacttccaactatgtggtcaattttgggataggtgtggtgtggtgctgaaaaaaatgtatattctgttgatttggggtggagagttctggagatgtctattaggtccgcttggtgcagagctgagttcaattcctgggtatccttgttaactttctgtctcgttgatctgtctaatgttgacagtggggtgttaaagtctcccattattattgtgtgggagtctaagtctctttgtaggtcactcagcacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgacgttagctggttattttgctcgttagttgatgcagtttcttcctagcctcgatggtctttacaatttggcatggttttgcagtggctggtaccggttgttcctttctatgtttagtgcttccttcaggagctcttttagggcaggcctggtggtgacaaaatctctcagcatttgcttgtctgtaaagtattttatttctccttcacttatgaagcttagtttggctggatatgaaattctgggttggaaattcttttctttaagaatgttgaatattggtccccactctcttctggcttgtagggtttctgccgagagatccgctgttagtctgatgggcttccctttgagggtaacccgacctttctctctggctgtccttaacattttttccttcatttcaactttggtgaatctgacaattatgtgtcttggagttgctcttctcaaggagtatctttgtggcgttctctgtatttcctgaatctgaatgttggcctgccttgctagattggggaagttctcctggataatatcctgcagagtgttttccaacttggttccattctccgcatcactttcaggtacaccaatcagacgtagatttggtcttttcacatagtcccatatttcttggaggctttgttcgtttctttttattcttttttctctaaacttcccttctcacttcatttcattcatttcatcttccatcactgacctctcattctttatgcagcaaaacaatgggagcaattttaggtccctcaaacatttttacaacaaaataaacaatcctctttttacttaatctgcagataaagttaaccattgactcagctttgtccctcatgtgggcaaagcaaaacccaacctcatatcgttactttaacttagaaagaattctgtttgtgttagttatagtctcattttggtaacatagatcgtaagacataattctgaagatgagctttttgcacatttctgaatcaaagtagttggtttagaaagagccctgtagtctgcatagaggaatcctcttaaggtccaagaactcatgtctcaccaccagttgaaaatagagcagaggcctgaattcagagcccccggccctgaccccaactgcagccgagacaattacactgcattctggtcttactagagctcagcctcatagaacttgttcttgtaaactctgtgctcatataaacatgcacctctgcattgaacttaaggaattataacgtcatcattgtattgccgtgactgcccctatttccttatgattcttccacagccctatcaactcctaggctgcatcactgttaaagtttcctgagataatcaggaagattttctaagagattgcaccaggacatttgttcaggcctctaatatcagaaccttacttgtttcttgaggcaaccatggagttcagtctcagaccaaccacaatcaataattgtcttagacacaatctttgttcctatattcccactgattctccttgttttaaaagaaacaatttcagaagtgaagaggggcatgcaatgccacgtacacgttcattctcaccattttaatttttgcatataaaaacctgcataatagactcaacaaaaatctgggctgcgaacagatagttaatgggagaaaagtcacctcactgcctcattgctaactactaagagccatgcctcccaaagtcttgtatgagaattgccaaacatataaatttctccaaggaccttagttctcacaggcttttctgaaagtttatgcttaatggttttcatttccaaaagtagagcttataccagctagttctgcacaatgtgtccacaccagaatattccctacaggcactggatctgtcctataaattagtctttatcagatttcttctcagaactctggaggtttggcgacattgtataagtactttaattgttatgtagttttgagaaaaagaaaaaatactcctaatatgttcacaaatcatcaccctagaaagtattagacctacttgttgctgtcagatactttttagttcgttggttctttgactaaatacttaatatcatgatcttcctcatctttttaattttcctgaagtggcttttcagatattcccctaagataggttcttctaaactgttataaataatacttttgtttgtgagtaatataagcccaataatcttcctttgaataacttaatagctataaatagatgcatttcaggagataaaataaagcatagcaaattataaaacatagactcttgaatataagcttgaatatataaatatagattgatataaacttgtgcatttatataaacttacatgtcaccattctgacttttttgagaaatgctttacagtatactttttaatgttaaatttttgtgagtacatagttggttgctacatttatagggcatacaaggcatgataatcacatcacctcaagcatttattcattgtgttaaaataatccaattatactcctttcattatttttaaatatccaataaattactgttgactgtagtcaccctgttgtgctatcaaataataggttttatttattctatctaactatatgtttgtacccattaaccatccccactacccccacccctccactgcccttccctagtctctaataaccattgttccattctctatctccttaagttcaattgttttgatttttagatcccacaaataagtgagaacctgtgatgcttgtctttatgtgcctggctcatttcatttaacataatgactctagttccatctatgttgttgcaaatgacagaatctcactcttctttatagcccggtagtactctatagtgtgccatgttctatttatccactcatctgacaatggacacagattgcttccaaatcttggctgttatgaatagtgtgcaataaacatgggagtgcagatatctcttcagtatactgatttcctttcttttgggtccataccagcaatgggttgctgaatcatatggtagctctatttgtagttttttgaggaacctccaactgttctccatagtgattgtactgatttgtattcccactaacagtatacaagggtttttccctttattccacattctcaccagcatttgctattgcctgtcttttggataaaagtgattttaactggagtgagttaatatctcattatagttttgatttgcatttctctaataaccagtgatttgaacacctttttcatatacctgtttgcaatttgtatgtcttcttttgagaaatgtccattcagatttttgcccgttttaaaatcagattattggatttttttctgtagagttgtctgagcttcttacatattctgattattaatcccttgtcagatggatagtttgaaaatattttctcccattctgtgggttgtctcttcactttgttgattgtttcccttgctgtgcagaagctttttaacttgatgtgatcccatttgtccatttttgctttgattgcctgtacttgtaagatattactgaagaaatctttgcccactccaatgtcctggagagtctctccaatgttttcttgtagtagtttcatagtttggggtcttagacttaagcgtttaacggattctgatttgattttcacatatagcaggagacaggggtctattttcattcttctgcatatggaagcttcccagcaccatttattgaagagactatcctttccctaacatatcttcttggcacttctattgaaaaatgagttcactgtagatatatagatatatggatttgtttctgggttctctattctgttccattgatctatgtgtctgtttttatgccattaccatgctgtttgggttactatacctctgtggtacaatttgaagccagctaatgtgattcctccagttttgttctttttgcccagaataacttcagctattctgggtcttttgtgattccatataaattttagaattgttctttctatttctgtgaagaatgtaattagtattttgatagggattgcactgaatctgtagactgctttaagtagcatgaatattttaacagtattgattccccacctatggacatggaatatctttctgttttattgtttcctcttcaatttcctttatcagtgttttataattttcatcgtagaactctttcaattctttggttaattcctaggtgttttattttatttgtagctgttgtaaatgggatcacttccatgatttctttttcagattgtttgctgttggcatataaaagtgcttcatagtgtactttacttcatggtgcccgaaatctgctgagaggcaactggtgacagagacctgaagaaagtggagcccagaaatgtcttggattttgactttatctctttctttgatggtctttcatgatgctaaacaagtcctgtgtgcttagatagaaactgaagcttgtgagaatgttttctcttttacctggggtggattgggatcctcaccatacagcattaatttcttaacgatatatataatcatagaagacaatagaggcatcattccagacaatatttttaaagccatttggcacaagaaataagacaagcaaaaatccaaaaagtgacaaaagctctacccaatgagggggtcagtcccatctaagtaatgcaaaaatgggattggcttgaggaagtaggaatgggaacccagtactgaagttataggccaaatcaaaagatgggaaatctagaagacatatttcttcaaaaagataacataaagtgcttagggtcagttcaacaaaagccttaaggatcaaacctgaagagacaaaaaatagcaacagacgaagtaaggcaataagcagagaatcataatacttacacaacctcaagaggttctcttgatatgacctgctgagaaataaaatattatctgaaaattgcaagactccaagatgttggcccaatattcctattattaaggaattaaatgtgtcttctgcatttcccatattttgatttggcttgtaactgcagtactgagttcccattcctacttcctcaagccaaacccgtttttgctccttgcatggtaaaccactggactgaagctcattaagccttcctttcaaattttatttattaattttcagtttcgtttttctcccatatgagaataagatcgacaaacagctttacagtttgaaaaacttctttctataaacaataaacattcagttttataagcagcctttgtctctgttactatttattatgtatatgttgcatttctcatggacatttgtcaatgagaatttttaatctctgtggtaaggtgttttcttccatttatttatttatttatgcatttatgtgtttatgcatttgtttattttgatgtcaggaagccctacaatttagttgacttatttaatcattcaagagaataatattgaaacagtgaattttgatagcatcatgtctgggttcaattattagctacatcttgctaatctgtataatagtcataccatagggcttagttaattgtaaatactcaataaatttttatttttaacctcaccatgtttacttagtatttattatgaaaataacaatataatagttatttcaaaagtaattgattgatttatgcaataattatctttactttcaagagggttaaattctattaaattataaatgatacatttaattatcatctaaaatcaacagcatcttttactgtttagaaattatttctctacttagtatcaggatctctcctgtcctgatgattattatcattattatttgttttagtgacagagttttgctccatcacccaggctggagtgtggtgatccaatcacagctcactgcagcctcaaacccctgaactcaagggatcctttgcctcagcctcctaagtaactaggactaaaggcatgcactactatccctggctaattttttttaaaaatattttgtagagacagggtctcaatatgttgcccaggctgatcttaaactcctgacctcaagcaatcctcccacctaggcctcctaaagtgtgcgcctccacacctggcctagacccaaagaataaataataatcaattgctctgtgcaagaggttgacacaggatgtggaaaagtgttccaggcagaggaagctgcaagcgcaaatccctacagagcaaaagtacatggttttggggtaactggaagtccagtatggctatgttatagaaagggaagtgagaagaaagtaggtagtgttaaataacttggacttcatcctgacagtattcacttgccaaagaagagttaggaggagacagatgtgatcaaatgtgtttcactggcagcagcatggggagttcactaggggcaggatggggacagaaattgaaggagagagtcaatggcggccttatctgggctagtggcaaaggaaatggagagaagcggactgatttgagtgatacttaggaatatctaagaaagaagaagttgttacgattttgaatattttgcaaacaatcaaacgcacacttaagagaggatacataaaaggagtattcactttgggaatggcaaaaatggagagatgcaatatgaagaaacagagactaagttgatttatttttgtatggtctggaatatttagttaaagtgtctacatcaaccaaaccggaatacaaggagttgttctgtgcaagagggtgcacagagcactgtacaagggtacccattgtcaaaacccatcatgtttttattagctattaattttctcctatgtcttatgttactcatcctgataatccactgtatctatttaaaataaatagaaaggccctttttactttttatttgtgtgtctagtgccccagcactttcaaggagcctttcccaagccaggtggtgaatgaagaataactataaaagtgacaccactgccgggcgcggtggctcatgcctataatcctagcacttgggaggccaagatgggaggattgcctgaggtcaggggttcgagaccagtctgaccaacatagtgaaacccagtctctactaaaaatacaaaaaaaaaactagttcaaccattgtggaagtcagtgtggtgattcctcagggatctagaactagaaataccacttgacccagccatcccattactgggtatatacccaaaggattataaatcatgctgctataaagacacatgcacacgtatgtttattgcagcattattcacaatagcaaagacttggaaccaacccaaatgtccaacaacgatagactggattaagaaaatgtggcacatatacaccatggaatactatgcagccataaaaaaatgatgagttcatgtcctttgtagggacatggatgaaactggaaaccatcattctcagtaaactatcgcaagaacaaaaaaccaaacaccgcatattctcactcataggtgggaattgaacaatgagatcacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtataataataaaaaaaatagccaggcgtggtggcatgtgcctgtaatcccagctactcaggaggctgaggcaggggaattgcttgaaccagggaggtggaggttgcagtgagctgagatcgtgccactgcactccagcctgggtgatggagtgagactccgtctcaaaaaaaaaaaaatgacaccacattttttgagtcatgtctatgttgactaggtaaaaccttgcacacagaacacatgtaaaaattacaatccatgtgggctgaatgctgactgtgttggatggaaatttgcacatagggcacttctctacaattcagtcctaaaaatgtcaagacaaaggagcatttagtgacagtcattctggataacaaagatgcactgctttctaatgcttccctttactttcacatttttctaaagttcacagatgtgccctcgatgtggtctgtgtatttttgtgaactgctggaaaatttcactcacacaccaatggatccaatgaacacaaaatacctcttccagggagcagttgccaataagcagtatttttagaggcacatgtcacagtttctgtttgcttctgttgtgacttttaatgggccctgaatgattaagaaatagcctctgataaaaggcatctcccgactgcttcattatgtactatgggtagtaaatgtttactacacagtgggctcaagctaacatgttattaaaccatgttccggttacatcagcgcccagagaatagcttttcccttgaacatgtttatcatttccttaaatgctccttaacaatgatgtcatattatttatgcatgcttcctcaggaaaatatgttggttgattttatgaattatttggtaaactttgttactcactctaggagactacacctgtttccaataattttctcttacatgttgagtaaaggaattctattgagagaagaagtgagaagtgaaggacacaaatatagatctaaacactagagctaataggacattttattgcatagaattcatgtggtatgttgctgggactagctttcctgtgaggattggagaaccaggatttctgctatctgaccagagtagaaatctattctcctttctcattgtcagagtaatgacagtataaaaatttctcaccctccagcattagcagggaaactttctatttcttctgctgtgattggaaatgaaaaaggaaatgcttgcttttgaaaacacttccagctactataatgttaatactagaaattatgactgcgagtaagaggaggggaaaagtcattcaggtgccattttggctttccatgaacatggctataaaaataaagtgcctctttgggcatgcttagtcattactttggggttaaagttgaagtcagaaaaaaaactctgaaacatagacatgtgtttttcattctgacataaagaattaacaattttccccagctacaactatggagggttagtatcttttaatctgtctgttttctaaaacagcatggtaacattttattttgcctaacctggagatgctaagaataccctgtgtctggttctccttggtacagagtattcgctgtataaactgatgaggttgatttccatgtgtttataaaaaggcaggaaaatgtcttcttgcctaaaactcatgcatggcatcattgcacatggcattgctcaagcacagatctcgcctggtggctccaaaatgaaaggagagtggggagttgccagggtcagagccttcgtgcaaaataagctgccactaactggcattgagcttccataactccctgtgctgggtttgcagtgaaggaaaattgtgttgatggtcagttctgaaagcatatttctggtagaaaagaaaaatagtggagagagattttattctttctacctgttcccagactactctgctcaggcttcctgaatctaaggaagtctaataaattctgaattctagagagtaaattatgaaggttcatttgaatgtcatctgctacccaagttctatacatcccctcttaggaaagaatcataatttattataattatttttctgtttgtggataagtataccataaatgatatacgcaagcatctctttcctactaaaaaagaatgctatattctaccagtagttttcgtaaaagagtaagagactcctctcagaatgaatcttctatactcctatagctctgtcacagtaacagcatgtgtcacaattggcatgtattgaattatttaaggatgattctttctgccccagtagattaagagcctgtggaggccaagttccaggtgtctctcattcttggacttctgttaccggaaagggtcccagttcagacccctaaagagggttcttgaatctcacacaagaaagaatttgggatgagtccatagagtaaagggaatgcaagtttctttgagaaataaacaaaagaatggctactccataggcagagcagtcccaggggctgctggttggctatttatagggttatttcttgattatctgctaaacaaggggtggagtagtcatgagatttctgggggaaagaggtgggcaattcccaggactgaggtttcctcccctttttagaccatatagggtgacttcctgacgttgccatggtatttgtaaacggtcatggggctggagtgtcttttagcatgccaatgcattacaattagcttataatgagcagtgaagatgaccaaaggtcactttcattgccgtctttgttttggtgggttttggctggcttctttattacatcctgttttatccgcagggtctttatgacctgtatcttatgatactagtcctgccgacctcctgtctcatcctgtgactaagaatgcctgacctccttggaatgcagcccagcaaatcttatcctcattttatgcagtccttattcaagagggaaccactctggtttgaatgcctctgacactacaatgcgtgggccagcactctacctgtagtaggtgctccaatcatgtttattgaatgaaatcatattgtacagggagcccatagggaatatcatttatactctgctaaaaagcatttaattttaggatggatttaatggcaaaacctctgtgtactgacatgggacttactgctaaaattgtgtacacaggggacctcggaattgccatgataaaaatcagtgagaaagagctaagtgccacttttgtatgaggaaggtcactcctggccagaaatggagtcagagaggcttattaactttgtgtagaatggagctaggttgattagactggctccaaaggctagctccacttagaagccatagtaagtggcacattaagtgcacccaagctaaatttctcactgtaaagaaacattgcaaaggctttaagaacaagtgacagcaaattacaaaataagcagcaagtcaggatttaccctactacctactgtcataacaattactgggtcaagtgaggggcattttaaaatggaaacactatttttctaatttacgtggattaaaaatgcatatttccctgattgatttataatctattgataattaatttataagatactattacaatatagtatacactgccttgaaaacattccaagtgagattgctttcctggtgaacatgcattagttttaatttttctttgttatgccccacctagaaatgctgtttattcactcataaggaactatgatgtttaatctattggattttgtgttcattgtatctgtttttatcatttacctatgactaaagtgaacagtgagaaatatatatttaaaccaaacaaaacttttaaaatatctttttttcaggggcttatttccagaattctcccagagtgaaagtcgtaccctaagaatatgttaggccacttggggaaacatttattttttatttttttccataaagtctgtattctttgttaaatggaaacatttacttttgaagcctactcaggtatagtttattgcttcgtaagaggaatttgagtttacaaagctttccatcagtttgttagcatgttacacacatctgggaatagaaacttaactgtttttaatccaaatgggcctcttcctttacgtcccacaattaatagaaattactgtctctcacacccacctcatgtaccaccttttaaagtgaaagctttaaaatggttgtccctaggtgtccaagaggtattgattccaggaccccagggactggtttcaggacccctgtggataccaaaatctgcaggtgcttaagtccccgatataaaatagtgtagtattgtatatggccaaagcacattctctcatatactttaaatcatctgtagattacttataatatctaatataatgtaattgctatgtaaatagttgttttactatattttttatttgtattacttttttgttgcaatgttattattttttcaaatattcttgtcctcttgttggttgactctgtggatatggagagtcaactgtaccctgttgtactccttggatcaggcatttaggagcagtggctggactatgagttggttattctgggcttgctgactgtataaagatttggttcatgtcactgtcacccagagcctatggggccaggcaggatcagaggaggaaagagggcaagcaggacttctatgagagcaagagcgtggcccagtgcagagccaggcccaaggccactgatgcacaacattttgaatctaggaacagaaggaaagggaagggtgggaagcagaagacaaggcggtggtcctgtccaccctggaaaatgagtgcctgcctctgagaataggatgaattagccatgctcggtggtgctcctccaccgcagtgcaatgtaatggctcactatccaacctgcagccaggctgcctggcttcaagtcgtcactctggtacttactaattgtgtaaccttagggagattactcaagctcaacaagcacctgtttcttcatctgtaaaatgagggttataaaatcattaccaacctcatagattcctgtgaagattacttagaaaatataaaatactctagctcactcctgtaaagagcaacgcccgacacaggaagttaagcatttttgcatcatatgtcttttgcaactctaactgcacaccactaaactctttaaattctgtatggctttcttctaccactagtatctgctatgctctttgtttctgtgtcaaatccttggcagtaaattaattttttaattcaaatccagtggtttactcatgtcaagcacctaagcctagagacatagtctcagtctttccctttatcatcttgttaattgtcaaagctgatgaggacactaccaatccaggccacagtgacataagaagaattaattcttttcttggttatttttgcatgcatttcctttaaagcagaataccctcacttagagttttaagtaggagacaatttgtcagaagataatgcttatttggagttttaagtaggaaacggtttggtgtaatattcttaattttatatgaatttgtgcatagaatcttatcagctgaattcagaaaacaatgagcaaatatcaggcaaggggaggcatggtaagggagtggagaagtggaccatggtcaggaaatatgggattcagtttgggataattttttttgaagtcctatatgaatgtatggagttctagtgcttggggttttagaagatgcaaagcagaatcagcttttactctcaaggagcctatagagtcaggtgggtgatacataacatgtagatggggactttataacctcagaacctaacacacgcctggcacatagaaactgcaaatcactcactttttatccttagaacacagcaaatgagaaaatgtaataaaaggttaaaatcagatttttataagtatcgtaagacaggtgtaaagttctatgtggtataaacaaggagagatgaaggaaagatgtggaagaccaagcacttgactgggtcttccaagatgtgcagaatatgtggctttgtgggtggagaagacatgagcaaaggcagcaaggtgagaagattcaggaaacattgtgagcagtttagtttgacgaaagggaagtggagagaaatgaagttgaagagtagattggttccaaaccaatcaggattttcaaagctaagcttagatatttgaacgtgattctgcaggcaatgaggatccgaggaaaaccttgtatcagagtagtagcatgatcagatttaagcgtcaggaagtcacatcattaaaatggatcaacagcttaactattgggcagtgagtttagaaatgagactggtgcaagagggatttatttatgagataaaattgatatgactcattttgcacctctaagtgacagacgatggtgccactagcagagccagacagccccaaaagaagatctggcttgatggaaagatgacaagtttaacttggggcacattaagttgttggtgctggcaggacattcaacaccaaaactcatgagagattttcagtggagagatcactcatgtacagaaaataattgaagccttggaattaccaaaggagaaaatgcctgagaacagaggcttaaggccatttccttaaggaacacccccacttgcagagcaagagcacacaaacagtgaatggcaagaaatgaggtgaacactttggaaagctgcagaagtcatagggggagaaggtgtcagaaaggaaagtccagacaagaattttattgtcgcaaataaatatggaacctgagaagagatgctgaatttgatgactaagagaaaactggtgacctttcaggaaagtagaagagtagtaagggtcaaaggcatgctgtgaaagattaaggcatgaacaggtggtgagcaagtagaagcaatgagcatagaagattttctcaagatggttgatagcaaaagcaaagacatcctagaattatcttaattttattatttgcttaaaagtcacaaacttcacttgacaacttaacagaatagtaaaattaaagtaactttgtaagaacggggagactacaacaggctataaactgaaagagagtttccagtgccccataaaggagtaaaattgaaaaataacagtgggtggtcaagaccacaaaacaagtgggaaaatatgggatcaaggatgtaattgacatgttccaattttatgaaatccacatcatatatctagattaacgtaacaattaacatggtctgccaaacagctcagagatggccacgagaattccaacagtgtatgagccattttgtaatccagtcatgtggtcacccatggatgtggcctgtcttcccaaggatgaattaattaccttatctctttattcattgtctttccattcccattgtcttagtaatatcagagaagtagactgagtaatcttttcacaagagcactcctcaaggtggaaaaggaaactagactctcagtagtacattcagcaaagagtagggagaaacagtcctcctaaaacctgccttgcatatgaaagacaggagtcaggtacaactatttcactgacctgagaaatacagaaagatgtttggggtgttgtccagggactgctaggttacatttattgtcaatgtgagtaagaattgtctaagagtaaaatattgaggaagacaaaatgaacatttgcctacttctacaaccaagaagggatatatggaagagttcatctggaaagtaaaatcacattaaaatgctacaaattaatgtagttattgttgttaatattattatcaacactaatagaaatggcataaacataccttcacatttgctactatatattgaattaaaaaatggtagagataaggctaaatttatcctagttcaacaatgattcaattcatatgagaaaactgagcatgatttgttcgttttgaatgccttaaaccaaatattttaatgtgcattactcacaattagattctaaaaatgtaaaacaaacatgatgctacagcactagtacaaaggcagcaaaaatgcattttaaaagcaggaatactacttcagaaaaatgtattaaaattgaacatgagcttgagaaagtaccgctcagtgcaatcatggaaccacaattaaagctgggcaagacatggaaggtttcctgatagccttgttttataattgtagaaactgagggccgagctcagttgctcatgcctgtaatcccagcactttgggaggcggaggtgggtggatcacttgaggccaagactgtgaaactagcctgaccattatggtgaaaccctgtctttactaaaagtaccaaaattaggtgggcgtggtggcgcgtgcctgtaatcccagctactcaggaggctgaggtgggaggatcgcttgagcccaggaagcagaggttgcagtgagccgtgattgcaccattgcactccagcctgggggagagagcaagactctgactcaaaaaaagaaaaaaagaaactgaggcccacacaaaaaaaagaaaaaaagaaactgaggaccaaggtgtccaagagccccattaaatgaatgcttaaagagaaatcaagcaaaatcccttccataaatcagtaggatatgtaacactatgaaagattttatattgatcagttaattttttaaaaaatcgaagctcagtttgaatgaaccttaacttaaaagtaataaaattagcccttttacatcataagaatttgaaaaagttgtgaataagcattcacacatacttatttaaacttgtattaaatgtgaagaaaggctgattaataaaaaggaaatttcattgagaaatcatgttaatgtcatcatggttttaacaggttaacttgttttctctcttgattataaccatacgtctctgatttaataaattttctgagtctgtattaatacagttgtgtgtattgttaagaaattgttagaatttttaaaaacgatttttcacagaaaataagcatactgcaagaagaaaacagcaaggaagggtatttttctgagtactatacatttcagttgtatttgtagtacctatgtgacaatcttaattattggttttataaaagctaagatcaggtaatttgaaatttacataaacattgcccttaatatttaactaaaatataatataaattaaattggaaatgttttatttgatttatcttttacagaagtataaatattacagcatatgagttattttattaacccttgtgttaacaattatttttgagatattttggaacttttaataacagaattactaaatgattctttaataattataaagtatgtattattttaaaataataaatatttaatttaaatttttaagttttaaaaacattttcatattttaaataatttttagtatttgtttaaataatctttgattaattctttaacaaagaattagtgtttttaataacaagataaaattggcattgttttctatttcacagtaatgcttcagtcagatacatacatatgctttgttagacatgttacatgctctgaaaaaagagttaatgactgcgtgcattcattatgaggtagaaaattcttactactattgatcttgttatttcatgatttgaaaatcttaaaagttagtaagatgtgcactagatgtagggaattaatgtttgttttttggttttcttaacagttcgacaattttatttttatttattttaattttttaattattttttaaaatttgtgtgggtacatcgtaggtgtataaatttatggtgtatgtgagatgttttgatacaggaatgcaatgtgagataagcacatcatggagaatggggtatccatcccctcaagcatttatcctttgagttacaagaaatccaactacattctttaagttattataaaataaagaattaagttattattaactatagtcgcccagcaataaagctactaaaaaatcaacatatcgatgaatgaaaataccaggaatttaaaatggaatcatattacataacttgattcatattatttcataatttaaagccctttttgtacaaatcactattaaaatcagtactatttagtgtttcttccaagagtattcaaaagtaagaattatctgatattccataagcaatccaagtcaggaatatctaatgtgaatggttggtaaaactgttggggtcctatagatacatgcccttgctccaggaaaaactcctttctcctatctcctggcttccagtccagtgtcccaggggctctggccgacaggctagcatgagccatcatgcctcttggtatgtctcactggagtaatttctcacctatcatgttttgccatctcagctttgtcccagtgcctcttgagcttctccgaaggtaacctaagcttcctgtttgtctgcctattgcaacagcacctattgccacttccttggcagcctgttgacttggaaatagaaccctacatttggtttctgctcctgacactttctgagcttcctctctggtcttctctgctcccattccttcctctgccttttgctttacagatccccttttaaagtcccttccatctgggtattacactactcctccatttttctccctcttcacatctgggtcattagaatccattgtaccagtgtaggcccattaaggacagatgcttccactctgcagtaagaattgtgtctcagtttatatttttctctgtagacatatgtcagcttctcttgtcatagtgtgtgtacatgcaggttgaacaagtagaggacctcacggttccaatttgaagtccaaaatactatcaccatcagctgtaaatttggggaaactgagggacaaagaggttaaatcacttggatgagtcatccaactggtgagactatgaactgggattcaagctcagagagtcaggatgacgaagtgtgtgctcctaaacacttaccttaatatgagggtaagcaggcagggtgaaatattgaggacactaacaaatctagtcaccctttacctgggtccttctttttctttctttctttctttctttttttttttgtaagttgatttaataggttgtaagtttatctacgaattccaaaaagtaggtgtgttctttaataagcagtgtatttgagtatcttgttttcctatagtgaggagaataaaatatgtaaaagcaggaagacagaggaagcctgggtgaaaggctcagagaatgtggcagcatttttttttctctccttggcatcacatcaaagacagactcacagaaaaagacaggcaaccctcaagatattaatgaaatgtatcatttccctctgtagtgaggacctgcctctgatcaccagtaaagcctcaaagccataacaacacatacggtgtttatgaatttaggattttacagaagtattataagagttgtcattttccaaatagtgttttgtatgttcatcgtgtacttgctggaacattttgtgagtacatgtacaaactgtgtcactggagtttggctgggcttctggagaaaagaagctgatatatggataatggcaaagcatgttgtgacatggatgcaagggcagagaaataaaagacataggtctcaccaacgactatgtagcttcaagagctggtggaatgaggaagacaatgtggggatgttgagacaaagagacataaaagcagtaaaccacaagggacagatggtagaggtgtgtcaggggttgcaactgtattttataaatggtggtagaatatttggcctagtcacccaacattaatgttctaagcaacctgaaatctctccacaaaagaagctttctatgaaattcctatttcatacactccaactgtcccctaaggagtcattctaaagaaggaatacaagagatccatcctgagttctaattctcttctctctaacatgtggacacttatagatattacctttttccttgagctcagctgcagcatgcatataaataagaaacaaatttacttgtctacctcccaaatagtctttcattgaatttcacatattagttcttgttactatggaagacatttggggctaaatattccatcacaaatgaaatgctacagccgtttctctctccttctgaatagtatttgtgacagattagccagctgctcatgaagtttcaagattttttgtttggttttgtttttttttttaatgtattagagttttctctacttctggtaatttctgacattacaagtctctcaaatcatacctctatctcttttgcttctgcttttattgaaaaacaattatttcttgcctggactattttactcctcttctgttgcatttcttggggcctgggtctgtagtaccctctcactgcagtgtcttagtgtcattgccaaagctgccctcagagaactctatgtagtgatttctagtttttctctccaggtccctggccatgcttcttattgcctaatgaaccaggatcaaggagttcgatctctgcattagcctctgatcacagcccctgaacggccctatcttatccttcgtgcatcctctctgtgactctcagaaaggctgtcagtttcctggtcagtcttttccctaataacctagggctcatagcatgctccataatgccctttcttttccctcaagggatctttgaaaatatctctggcatataacaggaggggcctggatctctagtaccttctgtgaccagctgcagagactatcaaatccctgaaatgactgcctaagaatgcaactcccaggccaccccaccctgcaacatcaatttaaattttcctcagaggaaatgttatcatttcttggtcagcatctgccactgtatgtggtcatttgggcgactgcagttctgcaaacttacctctagacataagagatgtttaaaatagacacttagggatttactaactgataaaatcatagaatgatgtgcatgtttttttggaacttttttgtactccctattccttatgtgttatctgctgagctttgttcataagattggtctgcacatggttagcagggactaaaaaccacaaagtataaagatagagacatccacaagatgcttccataaagcatgctttcctagtgctttcgggaacttttgggtgcttctgtctctttgtttttttcttaaataataagttttatcttctgtccattattattgagggtctagcatttatggagaataggacagcaaatcaatctataagctcttttagttttcctactactgctaaaacaaattactacaaacttagtggcttaaaacaacacaaatgtattatcttatagttctggaggccagaaatccaaaataggtcatagggaataaaatcaaggtgaatgcagagctgtattcctcctggaagctataggagagaatgcatttcctctttttccacattccacaaaccacctgtattccttgactcatgaccccatgtcacttagatccctgcttccattgtctcctctgacttggaccctcctgcttcctttttacgaggatcattgtgatcacattgggcccaccttgatcatataggataatcaaccctccccaagggtcttaatcacttctccaaagtccctttgccatataaggcaacatatttataggttccagggattagaatgtgattctatttgggagacctccccaacccccacttaattgtaaatttgaaactacgtgtaatacttttcacatattgcattgaaaataaacatgttaatatttttattaagacaagaaagttgttttttaagatcacaacaagcagttacttggaattttcatgaaagaatatttaccacatagtcttaatacatcttggtggctagataccaaattgtggtttgctgacttctttacactgattatatgtatcattaaaaatggatgagacctaaaactgccagactccatccaatacaaaaatacaagtatttgtaggaaactcttagaattttcacatgtaagaatatgtcacatttctgaaaaaaattctacccagtgacaccatttcttactatgcctatgtgttttttcagcgttagtatttgaacataaacacttttccctataaaagcctataagccaatagcagctgcagaagggagacctgcaagttgttggcaggctctggggctcactcgggttcctgacccaggcctttctgagtctttcagatgcttcacacttccctgcacatcctacttctgtgacacccccgaagttgcacttatggtccaagctaaatgctacctcaggagctcagaaataaagaacattggagtgaaaaaaaattccgaattatgcttgtaaaccaaatatatatggatagtgtgaattgtgcagacaacacattcaaatacatttcatatggtgaagtctagccaacctcaaatctattagtctgatctacttcatccactacatttgtgtaagattacccttctttcatagtaaacacatatgtaaaatattttaatgtgtttttgttagattcattttaatgtttccaaactgtttctattaatattaataagtaccattttatatgttttctcctatatttcttgttttcatccaggactactagattccagtaagaataaaattaaacattagaggtttgtcttccatattgtttaagaaaattagtttccctttttaaataattactaatatttgaagattatgaatcataaattaatcacaagtgccatacctattattttagaagcaattgagcaatataaatggtcttcagttttaccagttcttgatctgtagtaaattccagcggtggtggggtctgtgaaataatgaagaaaaaaattattttaaaaaaagagaggaaaaatgatacctaaattagaaaatcgttggttttatttcttgtatcaaaatatctgataattttaacattcattatgtgttcttttaagaactgatgctcatcagttttctcatcagtttttctgtttttcacttggcatttattgatattttctattgcctgagtaatttaagagcctgcaaaattaacctgcctttcaatttgcacatgtacttattatggtaaaatcaatattttcatcctaggattggtcatgtactttgcagcctaatgataaggagaaaaataacctcagaagagtgaagctgtgctggccagcaatggagatttgatagggaagaaaggtgtcatatcacctggatatagccaactaacagcttgatatatatgattccaagccaaaacctacatttagtctctctctctttctttctctgtctctgtgtgtgtgtgtgtgtgtgtctctctctctcatctttatactatagattataaaatttggatacgtaaatagtcatcccacttatttctaacacaattctgtgataataatgccttttcagtgtgtagctttcattgttttcaaagcacctttatagcccttctctcctttgatctttacaacaacccagagaagtgggcaggagagacagtaatcttcccattttgacacatgaagaaatctcttcaagcttcactgtctttgaggacctctgggtaatgatgtcatctgtcctgaaactgccagatgacttttgctctagaagaaggctagggagaaaaaaacaaaacaaaacaacaacaacaacaaaaaaacgaacatttaggctgggagactgggctgtcttttcccccttcacccctaaaaatctactttgcaaagagagcaacatccactcaccatccccaacactttctgttccccttccctgatttctattttttccacagcacttactactttgggttgtgctgcactgtatttcatttatttacttactgtacttgttgtctggcttccccaccagaatgtaagatccttgaaagtaagtatttttgtttgttttatacatatctccccagcaacaagaacagtgccactggtagaaggcataagaaaatgccagaatgagtcactgagtgcagactggaactgggaacaggaacagttagctggtggtccacagggaaggttctctccttttccttggtgacagtgagaagtcttatttgcaagaggaagagagcatgacttagaataacagtttggctttaggtgggacctatactatgcaacatgtggaacttggagggccttggagaagctgagcttgggagcaggctcacttgcctggggaagggaagtctctcagcccattctttagccacctagcaatagttgttagtcagtcctgtttgtctacccacactagcacatgggaggcactgtatttgtcaaatgaatgaatgatgaatgaatgaaaccagtcatttatatattgaagtaaatcagtgtcatggaatgttttatgtttaaatgaagagagaaaactttaatcagattaaatataggaaggatatttgggatctagaaggccaacccagttgttcaatcacagttgcctccatgggggtcaaccttaagcgttgtgcctgcaagcaatcacacttctctggtggaaaagccattctgattctggggccctttttccaccatttcccttcatccacagcaaggagcttcagctctggagactgtaatttgcacaaagcaattcagggtataaaagcaaaactacacacttgcaaggtaaagataccaattcattcgactctaaccatcaaaagatacatatacacatatatgacatgaggaatactttagtcaccagttacccttcctgcaagattagtcattagatcccatgataggccttgttaatgccatggagagaaaagagataattataatgagttaaatttagaaacaacagtcattttttgtggattagaaatagtgaaagtcagtgtctttctatcagtctttcacatcaaaagctacaggaaaatcataagaaataatgaatagaagaaatatgtactatttctaattgaaaaatgtcttttatttcagctcccttgtatggctacctgcttaaatatattcatgcttatgtttaatgtctcctataggttcctgctataatcttcttttttttaattgttcttgggttttaaaaaaatgtttgtttgacaaataataattatacattttcatgtgatagatagtgatgtttcaatccatataatgtataatgatcagaacagggtaatttgcatatctatcatctctaatatttatcatttccttgtgttagaaacattcagtatatttcttctagctatttgaaacaatataatacattattgttaactgtagtccttccacagtggtataaaacattataactgattcctcctatttagccataatttttatatcctttgacaaatctctccctatccctcccttccccctaccctcccaagcctccagtttcctctgttctactttatacttccaagagatcaactttttttagcttctgcacatgggtgagaacatgtggtgtttaactttatgttcctggcttatttcacataacgtaatgtcctccagttccatctatgttgctatgaatgataggaattcattctttttatggctgaatagtattccattgtgtatgtatgccacattttcttgatccattcatctgttgtggtacacctcagttgatgctgtatcttggctattgtgaatagtgtggcaataaacatgggggtgcagaagtctttttgatacaatgactttctttcctttggataagttcccagtagtggcattgctggattatatagtcattctatttgtggttttatgagaaacctccatactgttctctagagtggctgtactagtttatgttcccaacaagaggtataatatacagttcccttttctccacaccctcaccaccatttgttattttttgtcttttttataatagccatcctaactggggtaagaagataccacattgtggttttgatttgcattttcctgatgattagtgatgtcaagcatttttaaatacatttgttggccatttgtatatcttccttttataaatgtctgttcagataatttgaccattttttactcatattatttgggtttttgctgttgatatgtttgagttccttgtatattctagatattaatcccctattgaatgagtagcttacaaatattttcttccattctataagttgtctttttgctctgttgatgtttcctttgctgtgcagaagctttttagttttatataatcccagttgtttatttttgcttttgtttcctgtgctttcgaggtcttgatcataaaatattttcccagtccaatgtcctgaactgtttctcatatgttttctcctagtaattttatcatttcaggtcctacatttaggtctttgatccattttgagtggatttttatatagggtaagaggtggaagtctagttttattcttctgcatacggatatccagttttcccagcagcatttattgacaagactgtcctttctcaaatgagtgttctaggaacctttattaaaaatcagttggctgtagatatgtgaattaattgttgggttctttattctgttccattcttctgtgtgtctgtttttatgttagtactatgctgttgtagttcctgcaggtttgtagtatatattgaggactggtagtgtggtaccaccatctttgttctttttgctcaggattgctttggctactcagagtcctttgtggctctattcaaattgtaagtgtttttttctatttctgtgaataatgtcattggtattttgataggaattgcattgaatctgtagattgcattgggtagaattgtcatttcaacaatattaattcttctaatccatgaccataggatctttccatttgtttgtatcctcttcaattcctttcattagtgttttgtagggttccttatagaggactttcaccttcttggttaaatttattgctaggtattttacttttttgtagctattgtaaatgagattgccttcttgatttctttttgttagttcattcatgtacagaaatgctactcatttttgtatattaattctgtatcctgcaactttactgaattcgtttatcagtactaagagttttttggtagagcctttaatttttctttacataaggtcacgtcacctacagagacaatctgacttcttcttttcctctttaaaaaaaatctttgtactacctacctctatttgtcaaaatgactttttctcctttataatgtggatgcctctttattttgtttggtctaattgctctggctagtacttccagtactatgttgaataaaagtggtgagagtgggcagccttcctattctagttcttagaggaaaaccttcagcttttccccattcagtaagatgttagttgtggtggtctttgttttaatacaacctacaaaataaaatacatttatgtacatatctacatatatacacacacattaaacataatgtgtatgtatacatatatagatatatttatatttatatagacctaaatacatctgcatagatatatgacacgttcatgataaaccagtttgactgtggtgtggcccacacacctttgcttgcctgtttctcctcccacagtactgtggctctccagagaggctctcatatataccctgctccaagagccccaatatgtgtcctgttctgcagcaggaccgcttatggagatgctcttcatcaactaggtagtgctcatttctgtatgttcttgaaatctggaaaacctcaagacagaaaatgaatttatttttaaagtggaatttaatgcagcaattagacagatgagaaatatttttggcccaaggcatttttgttcacaccttataaaggagcatttttggttctgcttacaaatgactttaccacagtgttgaaagtgtctctctctctcctcttctcttctctctctctcctgcttaaaaatgactttaccatggtattaaaggtctctctctctgtctctctcaattctttcattcatttattcaatatatacttaatatattctatgtgcaaggcacagtgcgaataactctcgaagatgttttacactcataagacatgtgcccaaaatgctacagcattaatttgccacatgtattatttggacaattcagtagatgccatagaggttctaggagaaggaatgtttctggaccaaggatcagaataacattcagggaggaggtggcaagcatacaaaaggtggaatgaatagatgtttgagacaaagtaaattttcaagtttacataaaaaagaacgtttttctaagagagtagtgggaaagtggaactaaagacttgtagcaaacaagttgtgggtaattccaaatgtgggctgaggggccttagatttctgtattgataggtaaagagagccacaccaataacagacaaacagagagccaaatcatgagtgaattcccattcacaattgcttcaaagagaataaaatacctaggaatccaacatacaagggatgtgaaggacctcttcaaggagaactacaaaccactgctcaacaaaatgaaagaggacacaaacaaatggaagaacattccatgctcatggataggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagacaatcctaagccaaaagaacaaagctggaggcatcacactacctaacttcaaactatactacaaggctacagtaaccaaaacagcatggtactggtaccaaaacagagatatagaccaatggaacagaacagagtcctcagaaataataccacacatgtacaaccatctgatctttgacaaacctgacaaaaacaaggaatggggaaaggattccctatttaataaatggtgctgggaaaactggctagccatatgtagaaagctgaaactggatcccttccttacaccttatacaaaaattaattcaagatggattaaagacttaaatgttagacctaaaaaccataaaaaccctagaagaaaacctcggcaataccgttcaggacatagccatgggcaaggatctcatgtctaaaacaccaaaagcaatggcaacaaaagccaaaattgacaaatgtgatctaattaaactaaagagcttctgcacagcaaggaaactaccatcagagtgaacaggcaacctacagaataggagaaaatttttgcaatctactcatctgacaaagggctaatatccagaatctacaaagaactcaaacaaatttacaagaaaaaaacaaccccaccaaaaagtgggcaaaagatatgaacagacatttctcaaaagaagacatttatgcagccaacagacacatgaaaaaaatgcttatcatcactggccttcagagaaatgcaaatcaaaaccatgagataccatctcacaccagttagaatggcgatcattaaaaagtcaggaaacaacaggtgctggagaggacgtggagaaataggaacatttttacacggttggtgagactgtaaactagttctaccattgtggaagacagtgtggcgattcctcaaggatctacaactagaaataccatttcacccagccatcccattactgggtatatacccaaaggattataaatcatgctgctataaagacacatgcacacatatgtttattgcggaactattcacaatagcaaagacttggaaccaacccaaatgtccatcaatgatagactggattaagaaaatgtagcacatatacaccatggaatactatgcagccataaaaaaggatgagttcatgtcctttctggggagctggatgaagctggaaaccatcattctcagcagactatcgcaaggacaaaaaaacaaacatcgcatgttctcactcataggtgagaaatgaccaatgagaacacttggacacaggaagcggaacatcacacaccggggcctgtcgtgggatgcagggaggggggagggaaagcagtaggagatatacctaatgtaaatgaccagttagtgggtgcagcacaccaacatggcacatgtatacatatgtaacaaacctgcacattgtgcacatgtaccctagaacttaaagtataatttaaaaaaaaaataaaataaaattaacagaaaaaaaaagaatgtctttaagagacggacattgttgcagagcccttttactagggttaaactggagtacagagaacattagagtggggctttagtgaggtgtgtgggcctgatttcagggagtatgtaaaggctgggaaacatgaattgtaaggcagagatgttgggggctaacagagagggagggggtcaaaggtaaccaaggtgtcaatcctagatgtctggtagaatagtgtagcatttaatggaatcagaacatcaggatgaaggcagtattaattgcctacaggtgataaaagttgtccacagaaaatatccagcaggtagcaggaaagacagacagaattgggatttgggaaagagtctggactaaagatgcatatttgagaattgctcatggagagatgagaattgatgagatgtggcaatggataagatgtttggaagagtgagaggaaagagaaatgatgagatgtggcaatggataagatgtttggaagaatgagaggaaagaaaattaatgagagcagaatcctttttgtttttacctaaattttaatgatgagccctagcttttactgtcctccctgttttagctgactctgtataccctcagtagttctcaactgagggcaatattttttttaagtatgagaaggagagggtgtgataccactggcatccctgggtagaggccagggaagccactaagcatcgtgtcatgcacgggacagccccacaacaaaggattctctggcccaaaatgtcaacagtgccaaggttagaaacactgctctgtgtttgccaaaagaaaatcccttcagtgtcttgtttagtcaagcaaactgtctcctaaatttggttatctcctacaagaaatggaaagcagaaatcctttcagaaccaaatacgctctcccacaagggtctctaattcttcctgcacacttctctgtagaagaaagactaaatattcaagaatgacaatttgggagcagattattttttataaaaccaagcaaacactcatcttatttttcaagtaattccaactgaacacatatatggtaaaagccactgggaggaaaacgaggaaagggctcccacatgctcatatctcttctggatgttcacagacatatatgttaagtaaacagcatacccatgtacttgagcagcccaggtctgcctttgaaccttctttcctgcttgccatggacagcattgatctacatgggctgtgttgtgcttgtacttcattgcacagtttccaaatgtttctgcacgtggaaataatattttatttttgcaacattccttaagggatgtctagttgattcattgtgataaaattggaacaataagtacatgtgaaagaatctaaatattcatgaactgttcgacaggccacttaacttctctgtgtggcattttaggacagtgcttaagggaggaaattctgtgctattctgtccagaacatctctttctctgtttcctcatccataaagtgaggatgataatgtgcccatctcatagggttattcgggaggtagagtaagctaaattattagccacatccccaaagttctggaaccatcataacaacattattcagcattgcttgcttagcatttcaccaaaccaaactcttcatattttatcatattgtatactttgaagtgacgtgtattaccccacacggatatactgatttcttcccttgtcaatgacacaaaaataatcatgaaatatttcttacctgaaaaatgtagcatttttactgggatgacattttgtaaatatgtgtgggtatctttagaatgcccccagaccaaaaatattgatagagttttaacattaattaactttataaatagtgagatcaaagaaattttgcttcttctttgcttggttgatttctaaaatgttttcactggaattaagttaatgtttaaattaaatatgagaaaacaacaaatatttaaagataaaagttgcatgggtttttttcagtatttattttagaaaaacctgaaagttcatccataggaaagtagaaaaattatgacatatttatatgatggaataactatacaacagtgaaaagcaatgacatttttatatttgttgatatctatagatctcaaaaatataaggttggatgaaagaagcaatatacaaaagaatacataaagttatactacttgtgtaaatttagtaagagacattatgcaatactataaatggactatggatagcaattgtatctggtaaagaaggtagaggaataggatggggaagaaaagggagacctcatctttatgaaaaatgtatttcttttacaaatccaaatgaatacataagaagcaaaatgacaaaatgtgaacatttgtgaattttgggggtggatacatgagtgtttgttatattattctctgtacttttctgcatttttaagacttaaaaaagaaaaaaaagactttcattaaattgggcttggatatagaaaaaaagaactgaattgactgcaaagtaacaactctaaaattaggataatttgccaagacctgtactgctcaaaagcaattctcattcccattccagtaagaggtttagtgttggatattatggatattcatctgactctgaaatatgtgcctatatagaataaatgattttactgtttgagtagagactctaaagataatacactgaaagatgcttgcaaaatataggaattgattttgataatttgcaagacctgattacaggtagtctgacacttgtcagggtttacccaaaatagttctattgaacataagctacccttggataagaagactgaagcacaattaaattctatcctttttgctcaaggaaactttaggattggccctttgctgcaagactctgttggccttccttcttttacgtggaaatagaattcttatactccttagaaaaccaaagcaaggcctgtaatctttcttaacatgcatgtgtaacttccattaacacgtatcccagataatattccagcactgctatttttgttgtatggctctcagatggaatgtagaaaaacagccaggaatgattttcttttggttccaggtcccatgcactttatttcattttccagctgcccttcctccacaaaactgaaattgagccaggtttgttttctggctctaaatttgatcataaattgtataaatttataaagtaaattttataaatgttttacttagtcgacctccatttcaagtatgtgaaacccccaaactcaggaatatgttcaagtggtaacttttttttctttacaagcagggtacaacatgaattttctccagacactgtaagcatagacccagctcaaggatggtcaatgtgtataatggtttctttcctccccatcactaaccatagtggctattgctcgtatattaaagtggtctttcctgccaatcttagaagcaacctcaggattttcatcaacattacacgctcaattaatctgaattaatacccaagaagaaacctatttactcttgctgcagatgtactccagaatgtatggaattactttctgcttcataatctggctaattaaatattgcatcaattatattggtcgaggccatttttccctttcagtttctaatagtagagtaccatcagatgtctaggaagcaaaattgactaaaattttgtgattcttagatcacaaaataaggaatatattttttcatcaatgaaatttcactcactatttttatcatgagtagagtaaatttatcaaccatgttatttattataatacatggagtgaattattattatgtttcagacattgtgccaagtgtcatacatgtatttcctcattttatctttgcaacaacttcatggagtaggttttataattatacagataagaacactgaggtgtagagagattaaggaatttgtccagtaaaacctgaaagtggcacatttctgtttcaaatccatatacctcccaagctctttaaccattacgctacactcagtactcactttctaattatttactccattttactattgtaactctttggtttatttacatctattgtgtcttcataatggaatgactatataatagtatatcactgtgctgcttctcagttccacattcacacatcacactggtagcttgaaatgagccatagacagggaatttatgccacagaagttggcaaatgctacaaattagggttttgttttgttttattgagacccagttgttaaacatttaccagaatgccactgaccacattggtggtgttcttgttatttttgtttgttatttttgcagtttgttttgccctcattagcttcctcactaataatataattttgagtagaagttaagattttggtggatgaatctaatcagagagtgagaagaatgatgagcttcattagattatctagtcaagctgcaaattacttattcaaaaaagcctgtattttaagaacagaaatatttattagatggcagatagaaaagtagaaaatggggtttctgagaataaactgatgattatgtgaccctcagataagtatctaaaattttttattgtatttattagagcaaaactggagaagaatttacaaatttggtgctctctctctgtgtgtgtatatatatatatttgagacagggtcactcaatcacccaggctcatcatacagtggcatgattgtagctcactgcaggctcaaattcctgagctcaagcaattctcccacctcagcctcccaagtagctgggactacacatgtgcgccaccacactctgctaatttttttttttctgtagagacagggtctcactgttttgcccaagctggtcttgaattcctgtgcttcagcaatcctcttgcctcaaacttacattcattttttatgtaaacactttgatatattttataatctccagctttctgcaatgtctgggatcactgtctatacaaggtaatttattgtttcaatttctaaaggaaagtggtgagattttgagagcagagctgggcctgttttatccttttatttccattctctgtcccaccctctgtcttttgataatgcatagcaatttgtaaatactgataaataactggaattcatctagccataagattcatagctggtgttctctttttaacttaatatattgtatttcctgcaagtctgatagaatatggaactgggtggaaaatttgcatatttctgttctcatgtggaattgctaaataatattctagttcaccttttatataaaccttcaaatgaaccacttagcacctcctggagaccactattacatcaaattttcaaattaataaaattacgtcattattcatttgttcattcattcaacaaatttttgatgaagtaaaataatagtataagcataacaactgctatttattgaacacttaatatgctccaggttctaatatacatactttactggctgtatcctacacaaaacacacaacaacatcatgaggtagctgttaatattattcctacttaaaatatgaagaaactattatttggaaagttgaagttacttgtccagatctgaatccagataattgtttcttaattctgagctcttcattgtctagtaccttgcctttgtatgtaacacctgtactaggtgttacgtggaatgtcagagaaacttgtaatattgttgtgaatattgacctttcagtctcattggagaaaatatacatggtaatgattacattgaaatggtgagtatgtattcatttagccacaaaaatccatcaaatgtaaaaggcataaatgaaggactttcttctcagtaatactgggtttccattgctatactgcttccttttgccagcataagatattcatatatcatggaaaaatagatcagagaagtcatgttatatgttttttaaagatgtaatatgttaaacatatatatgtttaaacatgttatatatacatgttatatatatgttgaagcatgttatatatgtttaaacatgttataggttttttaccttaaatatttggaaagtacactatacattgaattaatctggctaaatagaaacctgatagtatatgttatggacaccaagttattttttttttggattcttcatccttttttttattattatactttaagttttagggtacatgtgcacaacgtgcaggtttgttacatatgtatacatgtgtcatgttggtgtgctgcacccactaactcttcatttaacattaggtatagctcctaatgctatccctcccccctccccccaccccacaacaggccccgacaccaggttatttgatagctctttcacggtttcttcaaacaccaccctctgtcaccaactctctaaataggatatcaatgtccgagacttcagtagctcttttcctatggacaccagtattgattgaatacttcctttgcttcttgtgcagtgtgctagaaagttgtccccaaagtagaataaaatagatctccatactccctgaaaaaaataatattttgtaaaaggaaatcagtaaatgagattcagtaatcactcacagatattccctaccatctttgctgtgtctaatgtatataaaacataacttaaaaacatagcttaacaacactgctctcaaattatatcactttaattttcatgaattatgtttatatattttgtatcatataacctaaagaaacaccaacacttaaaatagttacagaccacaaatttgtgagaaatttcacttcacaccattttaaatagttggtattctccttataaatgttattatatattttattctctagacgtctgttagaatatggagctgaggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaagaatatggagctgagtgtgaaatttgcatatttttgttctcacctaggattgccaaataatgttttagttcactttttacataggactgagtccaagtatataaaatgatttttttcatggttaattttaactattttatggcctttcgagagcagtaggttttaggtatttttctggactgtgtatttgactaacaaccatacagttcttgtgtgaaaattatttagaaatacactttcttgcagatactacttccatttgcttggaaattgtcttggtatactggtgttattatttttattttctctgaagagatttcatatcattttatacattacaagcatttttgttttatcatattgagcatattctaatagctgctttaaaatatttgccttataattccaaaatttgtgtcatctttggattggcatctgttggttatttctcccttaaaagtagatcgtgttttcctggctgtttgtcaaataattttgaattctatcctggacactgcagggattatgttgtggggactctggattctattacattactctaaaggttgttgatgtttttgctttaaaagacaattatcttggttagactcaaactgtgaaccatctcccctgcagttattggtagctcagttcaccattcagagtacttttgttttgttttttatttattttaagtttttgattgacaaattataaatgtatatttttatggggtacaacatgatgttttgatatatgtatataatatggaatgattaagtaagctaattaacatatctattacctcacgtaattttttatggtgagaacacttgaaatttactttcagtaatctcaaaatatataatacaacacattattagctctagtcaccatgttgtgccatagatctcaaaaacttatttctcatatcagtgcatgggtggttcggtggtagaattctcatctgccaaaaatttatttctcctgtctaactgaaactttgttcccttcgaccgatatctctctatttcccttccctcccaacctctggtaactaccaatctactctgtgtttttatgagtttgactgtttaactcatccaaataacagaattatctttttttaaggctgagtagcattccattgtgtatatataccacattttctttatccattcattcactgctggatacttaggttgtttctatatcttgacaattgtgagtaatgctgcagtgaacataggagtgcaggtctctctttgacatactgatttcaaatcctttggatatgtacccagaagtaggatacctggctcatgtggtaattttatttttagtattttaaagatcctccataatggtttttcataatgcttctattgtgtcctgtgcttgcatacttaaaagaatagcaagagacttgagcggaatttatacacaaaacttggagtcctctttctcaggctctctcctttatgaagttccccagctcactctccagtggctctttcctcatgttgctccagctaccctcagtataaaactgtgaagatctgaaactcaacccataccagtcacttactccaagtattgactccccttcaaaatcttcctacttttgttcactctccaagccccccggctagttgtttttctgtattttgaccagttgttatttgcaagaggttcaattaggagcttactcttcaagattacaaatggaaactcctatactgattttatagagaaaaacattttactatttgccagaaacaccttgcaataatataggaatgtatgaagtttatgatccacggactaggcagtggacagtcttctgtgagcagcagctctgataatgtatgcatattatggcaccagcacacacagttattttgatactgttaagcttatggatggttgttttacatgaagtctacggttatgttttacatttgcccctggtcctcaccttcactgagatgctcacttaaagcactaaagtatccagactattgagaattaattctgctctcaagtaactacggagctttaccaccatgttctgagtaattcattacaatacgtaatatagaattgccaagaaagtccaacttaaatctcacctactgcctcagtcactgccatgactgcaagctaaatcctacacctcttcatagtctccctttctaaccacactgcatattgctcactgcttgtaaaactatcataatttctattagttttgcattaccactattttgactatgaacccttaatggtgaagacaagctatgtgcctcctattaacatattgaatcaaaaacttctacctagcttgaaaacaccttcttgaactgcatgcatcccattcttccaacttgttttactgctgtaattatggacttgttcctttccttattacgtcataggtatagcatgtcactctccatgcagacctttgttgcaaaatgcttaggatattgatgacaactggagtggataatttagaaaataaatttaaaaaaatgcttaggatattgaaagaaatacctctaaatttctacattctttctcatgcatattcctcctaaaacgaactgttaaagagtatagtgccatatttcttacatgctctttctattccccataatctcttagccctttttctgccaatgttataccggattattcctttatatattcctatatatattccttatatttcatataagcatgaaaatgttctttctctcatttggatatgtaatcctaattaaacaaagtcccagcattttcttaaaagatatggagctcatctgtcgacttgtaccaatatcagattaattactgtaattattaagaaacatttgaggaatgttgacattcaaatcaactatagcataaaacatgtaccaaaaagatgatgacgttaaataacttttagaagactatgaatcttggttgtcaaggggtccttaattgctatcacattgtctgttgcttaatgcacataaagtataaaagtaactttaatcaaaactaactcaagaatagaacaaataagaaatataataggattagtaaattctattaactggacattcacacacatcacgaagcaagggttcaggagagatcaggctaaagaggtttctggtggaggagggtcaactctaatgaaaacattggaagtcgatgggatgtggaagcatcatctgttgaaatgacttccacaatgagagagaaacatctttctctcttaataaatcattacgtctccactgtccattgcactttggcccctgtctttttacgatagctggcaagtattcactgtgcctgtagggctagacagcaataggaatgataaaaagaagagttgacaactatgattcattgaatgcatactgcatgcatacatggtgctcatttgtattggccagacaatttgtaaaaccgttatagtaatcctcatttttcagaagaagaacctgattctcaggtcacaatgtagtttatctaagatcatactggtggaagtggcataactgggattataattcacacccatctgactcttaaatttaagctagtggctgaactaatttacactcctaccaacagtgtaaaagtgtttctatttctccacatcctctccagcatctgttgtttcctgactttttaatgatcgccattctaactgtcatgagatggtatctcattgcagttttgatttgcatttctctaatgactagtgatgctgacctttttttcatatgtttgttggcagtataaatgtcttcttttgagaagtgtctgtttatatcttttgcccactttttgatggggctctttgtgtttttcttgtaaatttgtttaagttatttgtagattctggatattagccctttgttagatggatagattgcaaaaattttctcccattctgtaggttgcctgtttgctctgatgatagtttctttgctgtgcagaagctctttttaattagatcccatttgtcaatattggctttcgttgccattgctttcggtattttagtcatgaagtctttgcccatgcctatgtcctgaatggtattgcctgggttttcctctagggtttttatggttttaggtcttacatttaagtctttaatccatcttgagttaatttttgtataaggtttaaggaaggggttcagtttcagttttctgcatatggctagccagtcttcccaaaactgttcattaaatagggaatcctttccccatttcttgtttttgtcaggtttgtcaaagatcagatgattgtagatgtgtggcattatttctgaggcctctgttctgttctgttggtctatatatctgttttggtatcagtaccatgctgttttggttaccataggcttgtagtgtagtttgaagtcaggtagcatgatgcctccagctttgttctttttgcttaggattgtcttggctatatgggctctgttttggttccatatgaaatttagtgtagttttttccaattctgtgaagaaagccaatggtagcttgatggggatagcattgaatctataagttactttgggcagtatggccattttcacgatattgattcttcctatccatgagcatggtagaagacagtgtggaaattcctcaaggatctagaaccagaaataccatttgacccagcaatcccattactgggtatatacccaaaggattataaatcattctactataaagacacatccacacatatgcagcactgttcacaatagcaaagacttggaaccagcccaaatgcccatcaatgatagactggataaagaaaatgtggcacttatacaccatggaatactatgcagcataaaaaagaatgagttcatgtcctttcagggacatggatgaagctggaaaccatcattctcagcaaacttgctctcactcgtatgtgggagttgaacaatgagaacacatggacacagggaggggaacatcacacaccagggcctgtcagtgggctgggggctatgggaaggatagcattaggaggaatacctaatgtagatgacggtttgatgggtgcaggaaaccaccacggcacacgtatacctatgtaacaaacctgcatgttctgtgttctgcacatatatcccagaacttaaagtataataataaaaaaaattaagctagtaaccactgcaagacacagtgctttttggagggaatgagctcatcaaataaggacataccttgtaagctctctctggaaagattcaagttatagatgtaaaaaagctttgaaagccagagagtgctacaaagatgcaaggcattgttcctgtttatttacttttctttgtttttccccttttctgtagtcacctttggtaaataggagaatcatctttaaaatgtgcagttctcttcaggttattctctagatccattctataatgaaacatattcttcagtaacctaagacagtataaaatagtagaattactataagataaacccctaacctgtataattcaaactgtacatatcaccctttattttctattaatctaaacttttgtaatgcatacccaaacttaaggatcaactagtaagcctgactcaagtcttcaccttcaagtattgcataaaagcaaaattataccaatgaaaataaaaggcctccataaaaatcctgcaaagtacacaattttaaaaagtaaaacaaattgtaaagtaatcagtcctataggaatgacatccctaacctttccctaaattacatgaaggttgtgacatttcgtggccactggtacagctaaatataaacggattattctgtgcctgctccctgtgcttttgctgactgacacaacaattaaggaaacaagtttccttcgtaaattatagctccatgcagctttgagtaagcagaaagtgtacattagaaatatttttagcttgacgtgaaactttccaaaggctcctaattaagcagttaagtccaagaaactataattgcaactgccaaaataactgggaaatcataccttggatgggatcaatcttaaactaaaactattgtttggaaaatcttatgaaaagactttattattctttaacatcctctttaatagaagggtacttctaatattgcccactttctgagaaattcaggtgcactgtttatttgcagagtatgtatacagtgagtgtgtaaacaaatactagcaaaaagaatgaccgtaagcattggtcatttgtcactagaaaataaacctccagagtcttgtcctaatgaacactaagatagagcatcaccaacccatgggtcagatatggattctcaccatggattcagctatcagaaacagtagaagagatctttttagaacaccatctcacttataccttgatccaaaagctatttaacctccatagatgtgtcacattttcaaaagaatggtagcagagttttatgcagactatttctatacaactcagatatcagatattgttatatgaaggtaatgattattatattttaaacactttcagatgaaaacatcagttgcattcatgggaatgttcagagtcagagcatatatgaatttaaaataacagtcatctagctcctgttgtcataacaaagtcatgttacggtcactgatgcagttaccttgataaatctgtgaaggtgtttagaggattttatattcatgtaattttaaataaataagcatattaaagtggtgtttatctcactattatttttatttgaatttcgttatgttattattttgattcagtttaatcccaaattagaaatgttggtagcagattaagaggcacaaagtgggctgtcagtaaaacttttttgacagctgcatttatggaatgcttatcatgggcaccaggtaatgcatgcatttactcactgaatccccactgctaatgttatagccatttctactcagatgaggagactgagggtcagagaggttaggaagcctgttcagggtgacacaatacaaagtgtcataaattgggtttgtactcaaccactctgcttattaacatcagcagtatgttaatgggtgaacgattgttaagtgtcccaagaatgaatgcaaactactccagcttagaggaaatcatcaaacaacagaatatagtgtcaaaaaatgagacttaaaactaaacaaacacatcacatttgtttcatatatatatagtttcagaataggtcccctggaacactctcatcctatactaatggcatcaccatttctcaaagagttgtggagctatccttgggaactgattttagaatcaattaataagccactgtcttacacaatgtagcctaatggcttcatagtctcaccactcttcttctaaaattgaagtggggcctggcacagtggctcacacctgtaatcccaacattgaggtgggaggattgcttgacctcaggagtttgagaccagcctaggaaacatagtgagacctcatctctacaggggaaaaaaaaaaaaaatagccaggcaaggtagcacatgccctgtagtcccagctacttgggaggctgaggcagaagggtcacttgagcccaggaggtcaaggctatagtgagccaccattgtgccactgcacttcagcttgggtaacagagcaaggctctttctaaaaaaaggactgccctgactgcttatgtaccttccttcccaaacttggctctgaatgacatttggctgttaaaagtgtcaaattcatcctcaaatggtgaaaatgtgccaattgtcaaagtagttaaaaggtcctattgcaatttactttaatcaattccaaaaatgttttgagtaatgaaggcattattataaatgtgtaatccattaagttggaagatctgatgaggatcctattcatttggataaataagttatttaaaaagacccccaaaacaggcctcattcctttaaagtccatatgtgaaacttctgccttgctccacattctgtgctaggggatatatgggttgaaatagaaagtaaagtggatagttactgatgctttttttatcctagaaagttgtaaggttgacattgtctcttaaaaaaataataataataaaataaattaaaaaaaaattcccttgcactccaataaagttgttgttttctttttttctttgagatggagtttcactcttattgcccaggctggagtgtaatggcacggtttcagctcatgcaatctccgccttgtgggttcaagcaattctcctgcctcagcctcctgagtagctggattacaggcatgtgccaccacgcccagctaattttgtatttttagtaaagacggtttctccttgttgttcaggctggtctcgaactcctggcctcaggtgatctgtccaccttggtctcccaaagtgctgggattacaggtgtgagccactgcatccaacagagtctttatatggttgtggtggtgattgggggtggacaacagcgatttaccagaagtggaagagtaaaggatttaattgagaattggccttaggcaaagcttaaaagtcaaaacttggtctttcaaaaccccgttagatctccccagagcctctatttcctctcccaatgagctttgctcctcctccaatcatccttccatcccctgtatttcaatgcttgctgtcagaaaagtactagctaatggcagcttgccattatgtatatgaccaaccacttgtatttgcattagacaatgaaactttcagagaaggaaaaagcagactaagacatagaggaaagcttctatcctctgcacccactcttcttcatggagacttccaaaccaaaccatctctgacacttagagtggtagcaccttccttagatcgggaaagccaaatagcttagaagattacattaaatttactggtataatcaaaataatatatcacaagccatgaatatctgaagagacccttgaatttctggcattgtatctccatccagaaaagctaaaaaaaaaaactcccaatgaaaagcatccaattttaaaggaaatacctgaaattagtctagttcatgtccccaggaggcaaggacaccagagctgtggtatttcctaagcacttgaaaggccaacagtgacctcctcatgtaaatatctttatgataaactctcaggacagccatttttttttttcttacttaaagttccgggatacatgggcagaacatgcaggtttgttacataggtatacgtgtgccatggtggtttgctgcatctatcaacccatcatttgggttttaagacctgcatgcattagctgtttgtcctgatgctctccctctcctcatccccctacccccgacaggcccaggtatgtgttgttccccttaatagtgataaagtttacgcatgacaagaatgtaacattgatcaacattaacactgactaatgctggttcattaataacaaatatatttagttaacaagattaaaattaaagttttcttgtgcaatttggaatgaagagagggggaccctgacctagttttgtaactcaaataactttacccatccctaaaagtctatctaacccaaagaaaaatgacagacaacttataaaaacatcacttcagccttcagacatctgattgacaagattaaacatatccacatgactccactccactatgaagccatgttgtgggaggttattgaatcgtgggggcgattacccccatgctgttctgtgatagtgagtgagttctcacgagatctaatggtcttataaaaggcttctcccgctttgctcagcacttctccttgctgctgccatgtgaagaaggacgtgtttgcttccccttctgccataattgcaggtttcttaaggtcccctcagccatgctaaactgtgagtcaaataagcccgcttcctttataaatgacccagtctcaggtatgtctttattaacagtatgagaacagactaatataatgccatatttgactttctgtttctgagttgcttcacttaatagcctccagttccatctgtgttgtggcaaatgatttcgttctttttaatggctgagtagcgtatgtacacatacacacacacacacacacacacacacacatatgcacacgcacatgcacaccagattttccttatgcagtcatcctttgatggacatttaaattgattacatatattttattgtgaataatgttgcaataaacatacaagtgcaggtatctttttgctatcacaatttcttttcctttgggtagataccaagtagtgggattgctggattgaatgctagctctatttttagttctttgagaaatctccatagtgttttccatagaggttgtactaatttacattcccaccaacagtatgtaagcattcccttttctctgcatccttgccaacatctgttattttttgtatttttaatgatagaaagatatttctgattcctcaaaaggcactgtttttaaataggtttgagaagtccagttgagtcataaactggtgccatgtggtttcatgttgtcatgtgaaaatttgatgatctgcaagaactacatgcccatcagacagattcagggaaaagggggcaagcagacagaaataaaaaattccagcaatttaaaacttaaacaatgtatcaatgtttctttccacatagccctctatgtttatggagagagaggtcctcttcaagaggattcatcaacaatgaaagagtctttgaaacattgatcctgtcaggtcttgatcctatcgggtcttgactctctactcatgaatcttttctctctctactcagtggtggatttatttctagtaattcataaatggctcccagagtcaccaacttgttggaatttataatacacaccccaaaataaatcttaaacattctactatttaacatttttctgcatcaaatatattccttatctaaatatattgggtctacagagaatgttttttgaagacgtcaacttatgctggtttcctccttgcacacttagtcaatttatgaatttttaagacaagaaattttataatattagggtcttcttttacccaagataaaaaatgcttatttagaagaataagtttgtatgagttctaggaaggcacattgtcaggtaatagatataaggctggctctgtcttacatcagccaatttcatggagaacagaattgctgtccagtacaaatgaaatatgagtcaaagtctggacttgagtttgaatctaaagtagtttacttatctgagatggcttgcacagttggcacgatctataatggcattcatttcagagttgctcaaagtcggctttctatgtaaaagagaggcagagctatggctttttagctcttgctctaagattcagatctattaaattatttttattgagcgcctactacacacacagcagcagcactctgtcaatttcattgtaactcctggaaaagacatctctggtatgactcttgtccccggatctcctgtgggaataataatctttcacacttacttagttcctggagatgctgtgataattgacaagtgaatgtttgtgaagtacttgaaatcctcagatgaacctgttatgtaaacatggaagaatgctgcctttccaggtcacagccatagctggagcttctctaaacaaccaggttttcctggttggatgctacttgcctaagactgttattttgagatagctggtgtgtgctttattaatatgtatccctgactcttggcccagtggaagacaaagatatgatgaccaaattatattttacatgggctaaatatctcctaatctctcatttcttttgaatggagtgcctcaaatcttggtgatgattcattatacatttataaaaagagtgagagaaaaagaaaacttgctttttgactaacagatactcctcgtgttcaggaagattcttgcaaggatattaaaaccctcaaaataatagtctgcttagaagtaggttcacatataataaaagggagaaatttctcaagttctatcaaatttcaaaataatttaagaaatcatcacattaaaacaatgtattatcagattaaggatggtattgttataaccttttcaagtagttcaaacattagaaagctattcatatgaaggttttttaatggactcagtgaacatcttgcaaatttattttgtaagctgctgaaaatccctactagtttaacttgtcaacatacatctgaaattattagttcaacgacactttctacaaaatacaattttgtgtctcttgtaatgtgtgtcaacagttatctgtattaattagcactcatcagtcaggaactgagctcatttccagctattaatctgggaccagctcaacaaagactcccattatctaagcaagcccagctattggtccttcaatctaaatgtcatagttttctgggtaaagctttattcccacttgtttttttaatacctaaactattattgtcatggcttgcaatttaccaaaaagatcattttctgaagaaggcatgtagaaggcaaaacacaaattttacccaaagtagcttttagacattttcagtctgtgatatatattcaactgatttgagtcccatcaacttctctccaccctctacattcatttacataaaatctaagttattctgtaaacactttaggggcaaattaatactttaagaaattacctatacttattaataaagttaagaatagttattatttgtttggtaaaattttattttacagagttgtttttcttgaaaataattgagatactttttccacaacaagatttttatatgtagatatcaataaatttgttatatgtagattgatatcaataaatttcaccttattaatctagatacgtataatgtaaaaataggtagctagagatggagatagttcactgcatatataactacacatacacatactattagtagttactatcctttctgtttctcatttttcttcagtaaaattaattaataaacagcaaggttctctgtggccttcctaacagtgtttaaaatgaactctttagcaatattaaagagaacacaaacaatttaagtatgagtaaatgggacatatttcatgatatttatataaacatgaatgtctacctaccccagtgatgtgctggaagttgctcatacaagcttgtgagagctggatgttaaattttctggattttagaaaggaaatcaatacatcaaagatatatctactcttccatgtttattgcagcattattcacagtagccaaaatatagaatcaacctatgtgcccatcaatggatgaatggatttttttttaatttggtatatatacacaatggaatattattcagccataaaaataatgaaatcctgtcatttgcaacaacatggatggaactggaggccattatgttaagtgaaataagccagccacagaaagacaaatatcacatgctctcactcatatatcggagcaaaaaaaagtggatctcgtgaagatagagagtagattggtagttaccagagaccagagagggcagtggagagaaggagatgaaggggaaatatatatatatatatatataaatggcacttaatggtaaagatgttaaattttatatgtatactttacctcaataaaaaaaagataaaataattttttaggaattttatgagcccatttttaaacacacacgtcaaacaattatataaacataattaaataaattacattaaaaacaataaatactccagactcatcactctctaattattgtattgcctatgttcttgggattatatattatctctacatgatgaaatattatatcatagagagctaccattacagacttcttcccaacttcacagtcagtgacatctctttttaaagcttacaatagcagaagtatttataccatggaaaatggcaaatgctgtgcattagcatttatttttcctggagaattgattattaaataattagtagcacaccaccaatttatcctagcaaaattcttaggtaaataattatgttgatcctttatatcaatttatccctccctcctgatagactttagtcaaagcgaagaaagtacatcttatgtccccttcttccaatagacagttatccaatagacagttgaataagacatatgtatttctcttaaattctgtaaaaagtgctttgagattttgtgattctaagccctctttctaaatttgaacttcaggtgggatcctagacaatactgaacatttctttccttttgggaggctgcgggggagacagtatctccttctgttgcccaggctggattgcggtggtgccatcgcagctcactgaaactgtcgcctcccagcttcaagcaattctcctgtctcaaccacccgagaagctgggactacaggcacgtgccactacgcctggctaatttttgtgttgttattagagacaggatttcgccatgttggccaaagtggtctcgaactcctggcctcaagtaatctgcccacctctttttgaatgtaggccagcaaataatttttgttttgcacccttctgtggggcagccctggctgatgtgcagccatgttgagtgattgtcctgcatccaacagcaggaatgaagcttaacaggcactgaagggaagtgaagcaaccctggggaaggagaggattcagtataaatgtaacacaccaaagtaattcatcagtagtaccctttccaacaatagcccaagtctttacagttccatttccattcatttttattttgtagcaaattatcatgtttcttataaacatttagagaaatgtatagttggattattattatgcacactgaaacttaaaggtatatttatgactttctgcacacctcctaggtggaataaatatgccattttttgtaaaccacttctaacagggaccatgacagaccaaatcatgccagtgccctactctgtagtgaagtatctgtgcaatgaggttacaatgacctaataaacggatataccatgagaacgcttaagaacctgcatgcaacattacctttgagatttaaatgagttcttctctgaaaatataatgcagatctttccaacttagtagaaaagcatgcttttagtttgcttagtagaaaagtagtaacattagaaaaggggggaaatagatgtatgaatataaataaatttttttttaaaatttggttgtattgaactttcaaattagccaactaatggtacatataaaataattataatcacactttacttagacagcattaaatatgggatgatcagagtattatctgtgatcgcaaaactgttaacagattatgtagctttattagaaaaaaaatttctttttactattaatatgtgttcatttatgtaaaaaattcaatattactatgaaattctgctgaaatttttaaaaataatccaaaaaagtttacgatgtctatcattaagtcttaaaagagagaataagtgtgaggatatgttaaaggattcttttattatacttcagtcctttgaggcattgtgctttctattcatcttttttataatgtcaaaacatgaaaaaatcatatctaaatgacttgttaaggagttagtaacaacctctctctttctttgtacacacacacacacacacacacacacacaccatggtttgtgtgtgtgtgtgtgtgtgtgtgtgcgtgcgtagattagagcaagcagattaactttataacgctggttgagaagtgtcatttatgagttcacaattttccaattctaattacatagccttgtggaaggaaagacataattatcatttctagtgtccctggcctcactgagcaaatggctcttgatattgacattttgtaccatggataatgatactttcccttcatttagtggaacaagaagtgctatacaagcactcactcatcaatgaccattgttttatcatcaattatcacacattagaaaagaaacagcaccaagcctcacccaatataaattattatgttctcaccaagcctcaccagtattaaacattcaaatttagttcaggctttggataggaagataagaaactatgccatggtggaccaaatttttttaaaccagttctagcattttaaacacgataaattaaaactatttgaaatttaaacgtttatatctaaggaacatgaaagccctggctaaaattaactagatacttaaaaaaaaaaaagttcatcatctagttacactaaatacattattttactaaaatgctaggttaaaagaaggaattattaaaataaatggcaatacaaataaagaaaggtactttgtgtttttgtctatatcagtatgcatacatacatgcacaaaaaataacttaagcaaaagtaagtagatcttaattttatacaccacagtccattatatttgtagacaaagctagaatacaaaaattttattgtttggtcaagtatttttatttatactgacaagacaccaaggaaatgatgttcatatggtttaatgtagtttggaaaggcactcgtgaaattttggctaatattagacttgggggagaaagcactattatggaaaccaagggcttggaagtaaatggtctatgagtcagaagcatattatgctgtagaaataatgagtgctaccagctgagatataaaattcaccatgcagatttcaccctccggtatagagattttaaattagattttagctaaaggcctattttctgaaaatcttaactaaaattgttgcctgaaatttgtcagtatatctgaatttatcttaagacttaattaaccaagaagttgaatatgggatcctgtataaaaccattgtaattcacatccatacctctcaaaagaagcaaaaatgagaagttttgtttcctatgaattgaggaaagtatacactcttactgtgtaaattttgaatgaacattttaaaatatctttattaggcacagctgcatacaaatggtatttctattttggctctgttagcaattctgttgtttctatcattgactttttccatctttcttcaagcattctggaaagagtccttctaagaaatcaacacacataaaactggtttagattacagcctacctggcatgtatttctttgctcaattttttcattgcagtaatcttgaagttgacaatgacataagcctcttaccttaaaaggttcaaagattccctacatgaattttagtttcttagataagagtttttttttcataattggaaaatgtataatttgataagaatttaataataaaataggccaataattttaccaaatccttgatagcaatatatatgtatgtatacatacacacacacacacacacacatatatacacacacacacacacacacacacgtgtgtgtatttaaataaagatgctttccagcagggtagacaagttgggcaaaggaaatatggtatgagctctttcctttatgactcctctgccccattgaatccttataaaaatattagactagtgatggaaatttgtcaacagttacagaataagaaaatacgttaaatctgaatatatggtactgaatacggctaataattctttaaaaaattatctaatgacaaagaaatatttgtgcattaattaaaattgattgatgaaagtgcccaggatctagaccgttgcattgtggaggtccccatgtccagcagatctactccatggccaactctggtgatgtagctgcacacaccccaggttgtgctacggtagaagaaccccagaccctgcccctcccccgtggggctggagatgcagaatgctggggatatgcctgagggttatggactcacatgcttaagcagaacaaagaagtacatatcaggcccagaataggggaagatactctgtcacaaagtggcaagcccagcacaggctgtgaaggctcttaactcccactagggaaatatcacaggcccatagcactcatgcggccatgcaggggccaacaatctgtgcatgactgcctttcccaacagaaagatatatgactagaagaaaaaaaggactattcaaactattcttaataaacttttttcaaagaaataaagcacttattctctaggtttctaatgttttaagttacagtatactaaacaaatcttcattttattcttttttttcatttccctaggcatttataactggcaatgagagaatttttaatgtttatattaaaaaattttaaaggacacagatcaatcataattttttccattgattattaagatcactttgcacagtttcaattttcaggcattttcatggtcccattttactgtgcaaagactgactatatgcttctaatgtcggtatattttacaggaagggcagtttacatacaaaacaagtttacaggatgaagccttttcaattgcctcagtaatgaccttgatattctgtctttgtgattaagcataaaactaaaagaccttagaatgtaagtgagcatctatccagtgaaataatttgtgttttttgcatatttacaagtcagggaagacaaaacaatggcagctttgttgacccagtatgttgatttgtgacctgaaatactggaaattttctcagtagatgttacatcacatactgattattagcagttatttactgatagctcaatacgtatgcaagagaggagacacaagtgcatggcatggaccctactctcaaagagttcacagttgaattgaagaataaaagtatgttcactaatttacacagtaaacatttcttgaatgcctactatgtgctgggcattgggcaaactcttggtattcatgagaaagcaaaatgcacaaataactctgcctcatagaacttgcattcctcaatagtgagtaagaaaaatatatttgagtgaaaaatggtgtagaacaaaaaggagaacaaatagggcttaagaggttgcgagaagtcattagagaaagcagaatttgagctgaatcatagctagtagaactatatatggagtacaccttagaataaacttattctaaatttttcccatggcatttaactttaaaatacatttttgctttgaaaaaattcatttataaatatagagaaaaatttcacagatgctgagctatgctttaaaattgtttctatatttctatgaaaatatatgtgtggcatgtctctacatccatagaaatttatttcaaaagttcgtttgcatttgcacgctgagatcagatgttcctgtgtttctgtcacttcatactcttttttccaagaaaagagactgttttgctgacacatataaatttttggaggattagaccattttcctattgtggaacatgtatacatatttatatatatttatatttttccaatataaatattggaaaacatttttctgaaaatagtaaccttcgaaatgtgattttttttaacattgttgctctccaaccctcatatttatattttcagtttagtacattttttctttatatttaatttttccattattttattttaaacattctggttttatatcccgtttatttgtctttctaagaataactttcttatatatagcattctctgttgtctaacgcttccattccaagatgttctccagttctgtatcttgattgtggtggtggttataaatctatgcatgtaataaaatttcataaaattatgcacacacattcaaaagagcataaaaactggtgaaatttaattaatatctatagtttagttaatttcattgtgtcaatgctggtttcttggttttgatgaagtgttatagttatgtaagatgttgccatggcagaagctggatgaaatctacacagaagctttcgatgctagttttgcaatttttacgagtctatacatatttcaaaataaaaagttttttaagaatattctctagttttcatccttattcagattagacctgtttatgccatataaatgtaaaggctttatatactcaaagagcatataacttcctctttcaaaaactccaaggctctctgatatgacacagacagttttattataatagagttgtattataatatttgaagttttattataatagagttctataataataaacttttccttttaactacatatgcctattccataatgccttgagaaaaaattccagtcaatggcattgaacacatctattgatagaaattatatttttttaagcatgggtggcaaaagttatttaatgaatcatcttccaatgtgcagaaatagttgacaaataatgtacccttgttttccccatatttttcgtatttttttcaatttgcctatatcatacatcactttttccaatatatgattttatctttgcttctcctaaaatgccatttctctatttttctcaaatttaactctgtattttttcttgtgtcttgtgcctgcttccctcacttattccagactttttttttcttttggagccagggtctcactctgtctgtcgcccaggctgaagtgcagtggagcaatcacagctcatggcagcctcgacctccccaggctcaggtgatccttccatttcagcctcccagatagctgggactacaggcatgcaccaccactccgggataattttttcatgtgtgtatttttagtagagacagggttttgccctgtttctcaggctggtctctaactcctgggctcaagtgatctgcctgccttggccttccaaaatgctaggattacaggtgtgagccactgtgcctgacctgttcctgatttttaaatacctggttgtcctcttcttttgtcatttctttattattatgtaatcctattcaccaaaaaaaaaaaagctttttccccttttgttgtctccatcctcaaaaagtgattattgatctcttctttatgtaagatactaggcaggaccccaaagggaagacaatgccctctcctgaaaagccaaggcccagtgaagagatgagagacaggtccaatgaaacaaatacaaatggtatgaataaaaatacaaatgatgtgaggctcctgatgctaagtgtcacaagcacgatgacacttctccagccctatttccatttctactctaaattaattttgtcttcttttgaagtctcacctgcaaggtagcagaccgtaaaaaatacctaaccctctgaactacttaaactctattccaattcggttatttcaacaggaccttttcaacatgctcagtctttcttggtggcggaaagattttaaagccctagaatacaggaattggagtcgtgacttcaccctttattaagtgtgtggctttggcttacttaatctttcctaggcttcagtttcctcatctgtaaaataatgggagtaatgatatagaaatgttctgaggattctgtgagacaattcgtggaaaacacttagtaacataccaaaaaattagtcagcacagtgtatattatttttcttctttttttaattatcaaggtcagtgacttttagagaatcaatgtattcattttctactacaagaactttaatcaatagtatctattttccttgtaaaaatctgttccagagatactttccccttccaaagcattactgtatttcatacactttgaggtatgaatataactcctatgatctttatttctgtttattcttggtcttaatgtattcctggctcatcactgtccttttaaggcatgtgtgtgtgtgtgtgtatgtgtgtgtgtgtgtgtgtatgttttaggggaatagaggaagggaaaggaaaagaagtcagactctactctgagtagttttccctttgattgttatgttttgtccatttcatagacattagtaattatatatacaatattagaagctttatctgaagtgttctgtggatattagggttgagagctcatattttttaagatagcaatgtaagtattgctatccagtcctctaaaatattcccagactgataggattagaagagtggccaccaggcaatttgaaacccttcaaggacgtgatgagaatgaagaagtccagccaaacagggaaacagcatgtgcctcatgaattttcttttttgttaataatgactcaagaagaaaacaggtggttgtaactatgcagaccaagcagcaaaattccaaatacagaaaataaacctcagagattcctttaaaggattatttaaacacaaacaaattcctaggggacagtaacaaaattgaaatatgtagaagaaagaccagtgtggtgtgtatggaattagagaatgagttgtgagtgtgaccctcagaatcccgggagcacataggcttccagagatgaaatggccaaagaaagaattcaccagaatgtccctaagtaaaggtctccagaaaaaagtttccttggaaattcagttcagattcctcctgaccttctgcaaaagattctccttagtgtgtgtctggatatcttcctcagaaatgacttgattgtaaacagagagaaaaggaaattaatggagcttaagctttagggcctctcacttgagcttcatgggaccctgtaccaaattgtctgttgtaattttgaattcttcttctggagaaggctcccaaaatgatatatgtttcgggccccataaaacctggatacatatgtaactaacctgcacaatgtgcacatgtaccctaaaacttaaagtataataaaaaaaaaaaacctggatccacccccagctgtcaagtataaaaactcctttaaaccaactagagtaagtcatctctcctgaggtctctagctttttctttctacccttctcactgtgtctgctcctttttcctgccctctgccagttttctcagcctactcatgacttcccggccctactaaatctttagtacatgtggttctggctggcagtggtgctaagtctggctcagactctatgtgaactttcaaaccaaactcccacaggcaagttaactgactcctgtccttctgccccaattccaaattccttggagagggacctgtctgtctagcacaagctggttgtcacctggatccagtcagctgtagctgggctaactggggagggtcctgtcatgggcccatagaactgcttcttggaaagtgagaggggaaattctctaaggaggagtaagtgaggaggccataaatgtcatgtctactgtatttaaaaaggaagttgactaagtgttttcaatctgccaaagatacactaagagctgaagagggaggggcactagcaaataacttgcttcctcattatgattcccgtagtgttccaaagccactgctttcctgctgtctctttttttagtactttttaaatccctcagtaagttgctttcaaaagattttttctaattaacagaatatgtcataagctcattctagtattctaccacccttataatcaagttttgtccagtgagtccattaggctaggggaaaaaacctagccaatgtcttcctacttttttatttatttatttatttttgagacagggtctcgctctgtcacctaggctggagtccagtggtgcaatattggctcattgcagcctcaacctcctgagctcaagcaatcctcccacctcaccctcccgaataactgggactacaggcactcagcaccatgcctggctaagtttttaattttttgtacagatgaagtctcactgtgttgcccagattcatcttgaactcctggactcaagcaatccttctgcctcatcatcccaaagtgcaggaattataggtacaaaccactgcaccgggccaccaatgtcttttaaatatctaaaaatttataattgtttgtttttctccttgcactgttattcataggaatgttgccaaaaaagagaaattgtattattttccagagaaaataggctaaaaactggaagcagcttatggcagactaaatgactcagttgctactgtgtgtataaacgtaccctgtaaagtgtagaggatgcatttctcagcaacaggtgtgccttaaatgtgttagatgggaacataggaaaagtatggccccaggcttctaggaaaaaaacagccttttcctgcccatactaaatagccacttagagactagagtttttccagacccttacatgttaatcctttttaacaagttaccagatagctgaacacaaactgggtcaagcaagtctgtttctcagaaggcaagatgtcccatcctaacaccataaatcacactcactttagaaatacgtttttctttgatccaaatgtcttttcttaataactcattcctaagatttccattttcagattcctgtttttgcataagattgcatgaaatattttttgccattacacacagtgcattttattgaaaggactctaaagggcttagggaaaggaaaatttccctaaactgcaaagaaagtcagctaatcattctgaaacataataaaaactagtttttaaaaatagctcatgataggtaatggggagtaggtagacccaaacaagattggtcagtttctacctggacaataaagtaaggcattaatttccttcagatataggtatttctgtagcagatattttttagaatttttttaaaagttgtgtaagggtgttttatttatcagaaaaaataaatgtattttgaactgtttgaaatgtaatccaaaaattacagctgaaaacatcaattatttaaatttatgttacacaaataattgtaagtcttgtgtactggaagtaaacaataaaagtatgaattttcttttgaccacccctttcccctaccaggggaataatggctccatggcagaggcagtttgtacctcagtccatatacatccccttcttattggcattgcagagggattgcagcctccccgcggcaagtagctcaataaccaaatattgaaactgtctgagtctgtaccctgctgcccatgtcataaattcttgtatcttaaggtatcaattttttatatgctttacttttacttatgctttttattcctatgccctttcccttgtactctacacctacctgaaatgcagcatgcatgccagccatgcctatatcccatgaacactacctccaatgctacctgactctctacccttccacttttctttttattatcattaaagtaataatgggccattagtactactcaagacacaaagccaaggagtttacaaaaactaaattactaagtactgtcctagcagccttcctaacttaatgccagttccaaaacggcaaactctttgcccagaagcaatgtttgttcactgagaaaatctgggtcagtacatggccttagttaagccacttgttttttctttatctcattttcccccactgtggaattagcctggttattggcaaaacactctgatatttttattaaatattaaaatgttagcagtagccaaagcttgagtgaatttgattttatgaagccatgcagaattatttggagatgctagtttctctcaataataacatcactacataatttaatttcatacacacacacacagggtcctaaaagtcttagcacaattttaggcttgactaatttagaaatataagtgctacaaacttaaaaaaaaaactccacataatttgaaagtttaactagacttctttctcatttgtttacttttgtgaattttgaataataaaattttagttttgattgtttttgtttaaacatttgctactttcagtcagaaaaactgacatgtatttcaaggatatgggaaaactagcattgtaagaattacagagctcttcacatctgagtcaatatttgtacattgctttaaatatagttcatgtctttcatccaggaaacacttgttgagaaccttctacctgtaaggcctacattacatcagttacatttcttcatttaatccttactgcatctttggagttagatatcataatcctcacttggaaaatgaggaacttgaagtctaaaggagtgaagtgactttaccatgatacttagaaattgtatgtggaaatcaggacctcaatccaaaatcctccaggtctgcatctcaagttctttccacactcttgcattatcactctccttgttgatgttctgcgtatagactctatttcattcaagtgtggatatatctaaaagtcctcatgaaaatgtatattgaaaggcagtctgggccaaaatacagaaaattcataaaccaagtacctcatagatataatctcctttatccagcataattaaaggaactaagcagaattagtggattcactacagaatatcgaacctatctcaggtcatataatggtcctgtcaccattcttctctctgtaagattcagtgcattatctctttgacaggctaatccctaggatgagctcttttgatcataagggatcctgaacaggatgttttgccatccagaaaaccagcaccactgagacgccagctggagacatgtcacgaaaacttggccctaattccaaagccaacagtgtgttgaaattagggcatatcatttgcttagttcctgactgcatactttacaactgacaactgaagattactaataatgtcttctactcatgtgtacccctcatccaggaggaatccaagtcattttatcagtgtgtagcagccatttaagtctctgattatagagtgcttttaagtcctcagaatctttattgtggagcagcgcttttctgcagagaaggattctccattaaagatctaaaccttataagcacttcctggaaccatactgcctgtgtcaacttgcctggtagacagacaaacattttattgaacatatactatatcttgagagctttacattatgtaatctcaattaaccccacagtactttcaaaatagctgttattaaacccattttttaaacaggaatactaagacttaagtaaaagtaaaatagataacttgcccagaggtcacataatataaaatagcagaggcaaggttgaaatcatgtttgtctgattctggagtcttcatgtttgcaactttattatgtcccctcagaatttccccatcatgcttattctagtttcctccgccatctccctttttttttttttttttttttgaaacggtctcactctggttgcccaggctgaagtgcagcggtgtgatctcggcccactgcagcctcaacctcccaggctcaggtgatcctctgacctcagcttcctaagtagttgggactacagatgcacaccaccatgcctggctaattttttgtatttagtagagatgggggtttcacaatgttgcccaggctggtctcaaactcctaaactcaagcaatccactcacctccacctcccaaagtactgtgattacagacatgagcgactgcatctggcccagccatctccatctttatcctcctttataagaatcttaggcttatccaaacaagctaaaagagatgatacagttgtgcgtttatagttagacacatagatctgtctccaaaccacacttaagtcaaaccctttagttcatttcagtccctgctatacatccacatcaacaattagttaatttaaaagcatgaaaacagtttcagaatttagactgtgacctaatctaaccatattgcctaaggaccttgaacctcataacctccgtcattaacattctcaacaccattaaagatgtaattagaatatctcctttaatttggaaaactacatgaacttcttaattttaaccacctcccctttatctgcatgagctcaaattatttgctggcaaaatgtatttaatttttttttctgtcaagcccttatgaatttaattgattaagctctgtcactgccacaactgatataggcatatattggatatttgagaggctcacctattagtttaatagttcagtgataagtatatgtgtatacatagaattgaaggaagatagtttgaaattatgtatgggaatcagcatttgctctatggaaggaaataagttactgaattgtaatctaactaaatatatcacaaaaaatttgcttagcttttgctttctcagagtttctcacagttttctttatactcctctttaaaaaagtaattgtaagaaaatactttggttttgtttaatttgagaattatttaagttagaatacttgatacctgaagctcagagtctctcttgccagcctgttaacaactttctttggtcttaaggtgccttaaaagaaacacagaatgttgtagaacaaggagaattataaatccacattggtgaaaccaacctgcattagtgctgtgtgtgtttagggcatacttgaagaaaaatacagataaatggaagcatattccaaacagagccaacaagaaggagaagggatttttaaaacttcacaaagaggtatagttgaaggaactcaagatgtttaacccaaagaaaagaaattgcagaggtaatagagcagctgtttccaaataactggagattctggctgagtatggtggctcatgcctgtaatcccaacactttgggaggctgaggtgggagggtcacttgaggacaggagttaaagaccagcctgagcaacatggcaaaaccccttctcttaaaaaaaaaaaattaaccaagtacagtgggacatgcctgtggtcctagctactgggaaggtcgaggcaggaggattgcttgagcctcaacacacaagacttcagagaggtatgatcagccactgcactccaggctgggcaagagtgagactctaaaaataatactaataatactaatactactactactactactactaataataataataataattggagagtcttgtggtggaaaagcaatttagacctgttatttgagattccaaggaacagaccagggccaatccgtcagtcacatagagttacatggactgcatgtaacttcatgggagtcctccaccaggacttccagacaaggaggtaaatgtgggctgaaattttgccatgctcctatggccaagcactgtggcttggattaggctgtggtatgcagagtttcttttaaaaaaattgatctgtttagaagagatgcctttttgtaatgtgcccaaaagcactgtgtgtgttatgtagactctgatttcatgttcacagaattaaaacatttctaattagtcatttcttttcatgagataaaatcagcttcctcaaaaactagtggccttttgggtctctaagccccaagaaattggatgacgacttaatagaaatttcattctaatcatgatacacacaggcctattaaccagagggagtctgggagtggcccagacctgagcctcaattctggcactggcagtggttgttcaaagagtggacctagctgcaatggaaggaaatgaattcaggagactgccatattgcattcagtgagtgttatgattggcaaccggtgactctgcagttgcagctggcatcaagaaccaggcaaaggtgacagtcaggtagagcacaatcatgggaaagagagcaaccagtaagctctatgaacagagctaaatggatggcagtctacatggtagctgagctcccataacgagatggtgttctgaggagatctgcggaaggtgaggcagcccccacttcctaaggaaggtaatgaaaatagggattcaagtacaagaaacaaggttgagggactggggataaagtggggatggttaatgggtacaaaaatatagagatagaatgaataaggtctagtatttcacagcacaacagaacaataatttactgtaaacttaaagataactattataaaagagtgggactgtaatgttcctaacacaaagaaatgataaatgcttgagataatggatacccaattaccctgatttgattattacacattgtatgcctgtatcaaaacatcacctgtaccccacaaatatatacacatattatatgtgcccataataatttttaaaaattaaaaagaaagaaacaatgtcaagagccactttctggtcaagacttagtctctgataagagaaaaacacccaataagaattagtgcttacctatagtgcaggatttgtgatgaggctgtctccccagttgtcaaaccggaattccttctatcccggacatgtggggatctgagcttggggccgatggacactacaggcgagggtcattgacttacttgagagcaggaaaccaggcgatttggaaaatgaaaatattaggttagcatttagacaaaatggtcctttaggtatgttctaacccttacatattctgattctgtagtaatagatggacttttttgaactttagtttttccattttctcatttactttggttaaatacatgagtgtcttttcccctgtaggcttcctcgctcatctttgacaagcatcgcctttgtaaagacagaacattttgacacagcctttttgatattcagtcacgtcaagatgtaaaaatgtttttacattgaaaaggatgaaacttttgctttgttaaagaagtactttttaatgacaaaaaaaaatgggggtggtgttttcgagtaatgtgcctaagggatgttttcactcctatgccttccttcaggatattccccacagggggagcgaggcccagtgtcgggtcaaagctggacatggggtgcaccacaacttcagggcagcccacaaagccagggtgcgatgagggtcaaagagaatttggataatttttgtgcaaagaacttggtatttaaagaagttaaaaatataatggtttgctctttaaggcatatcaaaatattcccttgccaaaattgctgcattgaaaagtccacaccactaaaatggccctgtcaaaatttcacctgcacatgctcatactgtaaagtacagctatttctgaagtgctggtgttttgattattattctgtttgactattatttaaaaatgttaaaatttagaatcatggtataattattacattgtataatcagatacctggatttttgtcatgactgcaatgacatcaggataaataaccctgctccttggctccttggctccttgggtgatgtatttgtcttttgtcttttgggttttttgttttgttttgttttgttttggagacaagctctctctctgtcacctaggctggagtgcagtggcatgatctgcagctcactgcagcctcaacctcccaggctcagatgatcttcccacctcagcctcttgagtagctgaggctaatttttgtatttttttgtagacatggggtttcgccatgttgtccaggctgctctcggactcctgggatcaaatgatcggcctgcctcagcctctgaaagtgctggaattacaagtgtgagccactgcacccagccgggtggcatattttatgtctcttccatactgatgtgccctataatcttggctaaaaaaaatacaataaattcggcatctttattaaatagcatccaaatacttaaagccactcattttttaaactgttttattataatctgattgttctaaaaaattacttatttgaatgcctatattatttatttgaatgcccctatacctaacatgtaaccaggtagaaattttaattatacagtgtactaataatccagtaatgcagatttcttatgtatgtcatcatgataactataatttatactatatatgtggtacataggcttttaaaagtcaaatattcactagaagaggatgatggttatttctctgctgcttcagttttcttgtgttaaatttttcctttcatgttttaaccatttgggactaaaatcttgaaaagaataggttttttagcttccaggtagataccctgagaatacacacacataggtccaggattggagtgactgatgcttttcatacagtaatagtccctgttgagcatcctctatgccccagtcctgcgtactctgcccactgcctcaatattatcaccacgagcttttgagaaaagaacaagcatcctcattttatagaagactgaaccaaaagaggtcttcttcattaaattattttttttagtttggaagaagagatcatttaaatatatatcactgttatggtttgacttttaattttttggttcaccatgtgacatattctgattttgattctgcaaaacctagtaggaaattctgggaaacaaatgaagtagattgctagtttttcccttctcttgttattttctactctttgtaatgcatttacatattaatgtagtaaatgctgtgatgatatggctgccaactctttcatcatttaatctgttaaataaacaaacgtgctttggaatcaatcactaaagaaatagctactcactaaagttagagatttattttactttgagtataataactcgcttgtagttgtaacaagcaaacttaaaccaaaatattctaaattatacttgtcatattaatccaaaaagaacaatatttaacctaaatgtaaactaaaagccaacatgttgatccactaattacagaataataaaagccagactaaaatcaaagaaactgccccaggttccttgtaatgtactctgactctgtacataaagttacctctcccaccttctcccacccctctgagtattagtccaaggatacatctctccatctatcaaaatctgagattgagcaggcattcatctgtaacctcatattttttcctcagacagatcgttgaaaagataaatgttctaactgggagaaatggagaaaattttgctctttcctccctcttccaggataggaggcttccctaaagaacaagaaacaaaaacaaagaaagaaagagcagcaaaacaaataaacaaacctaggtgtccaggaaattatgcatgtttcttgacagagtttcttcagtctttgaaatggacagatggatgaatagatggaagagaaaatgattttatgtaatagctttatccaaacatgttcacatgtacctctctcccttccctttacttcctaaagaagtgcttttagcatgtgtctgagtcatgacctaatgtaatatgtgttgttattaacctgctgacatttttaaattctaattttaagttaaatcaatcatagtgatctctgttataatgtcacttttgctaatttgccttccagtatatttgtcataagagcataaggaggtctactctgtagaaaatggaccaacaagggtgtgttgcacatgaggacgtggtttgtcttgtgagtctcagcaaaaaacaaaatgttaggacctactgctctgaaatagcaatcatggctggtacttgctgaataatttctaaatgccagaaattgtttcaagatctttacatggattatttcatttaaacctctcaaaagctctgttaggcaggtatcgttattcctattttataccctaatgtgcttaagtaattcagccaaggtcacacaactggtaattcttagagccaggatttgaacccagaccatccagcacaggcctacactttgctgatttacaacgaggaaaaattttcatttcgcgaattgtacaaaaatagggggatctacattcaaagcaacttcattattcaatgaagagtattgttcaatactctcccatctctggagagtattcaaattatgaatactgtcaaccaaaaaaccttgaaattgatgtccgtattttacattaaattatttttatagagaattcattcatacagatattggagaacctaaacaatccctgtgaactttccagatagctcttctactaaaaatcagaaagctatgcatgatttttctgctctaaaagtgtccagaaatgagagtgctcacatttttgtagcggcccactaaagcattttatacacttagagaatctcctttcttttaaatctaagccttcctaggattaatatatcttgcattttcttttcaatcaatgagattttgttttcattctctataaatactttatattcagataatttttctaatcacctcttctctctgttattaatattgctgaagctaaaataaaatgtaccaattgaatatgatatttgagtttaatgtttttatttgtatttacttattggaatgagacatgctcttcaccttgggtaatttaaaaaccattattatagtttaaggttctgtgttacatctgtcgccaatatggtgtgcccttcctgaagtatactatcaattttgtaaaacaacctcaaatcccagtaagtaaagcagttctgcaggtacttgtacaatctgggtgagattttatttgaccccatcaaaaatctttctctaatacaatcctccaaccttttatggacaggaaaagaacagaaatgcttacatgatatttctgcttccagatatcagatgtgatttattactgagtaaggcaactggcacaatggctttaactggcttagaagagcctaactgtactttctccttaatcatgttagtggcaatcttagtatttaattacatttccagagcatctcaataggagtagtgtttttcgtacattaaaaataatctagaaaaaactgttttcttgtttcccagacaaatgagatgagctagtttctcagaccagaaacattctaagataataatttaatatatatgcttatattttaaaattcttctcttatgtgcatataaacgtatatcttttgcaaaactttaatgacagtcagcaagtatgttgataattacgagttgagaaaaggctgtataaaccattacactcagtgatatataaactctggaatgtatttttgattaaagctcctcactttacttagatataagtaaagatttatatctttacttgtattttatttatatttatatttctaaaatccagctgatattatatttaatgttttaattatgatatcctttaagcattaaaaaccatagtttttaagctaaatgagaatgcccttctcaaacctgaaaggacaaatatttttgtcctttgccatattgagagtaggaaaataaaggaatatcagggttttagttttctggaaaatacattatgaataattttacctaattagataagctagacatggttatgtataatttcttagaaaaattttacaaagtgaattcattcatctacctagaagagataaatatgcactaaatttcttagatcagataaggtaacaaagttgtagaaatggggataaatagagtttgggacctggatggtctatctacataaatatttattgcaaatggtttaacaatcatacaatgagattttgcaggaaaatttattttcactttaatcactgaaataactaagaccaaaacagaaaaacctattattcctcaaatccaatgggaagaattaatgagaagaaaaagagccaaaaggccttttgtcaaataaataatgataccataaataataataataacagctacattttactgagtgcctgccataaacctggcactgtgcttggtacctaacattgtcctcattcctcacagcacacaagaaactgagtgtcacactctacttgaagggcagaacaagatttcggtccctagcccatgtgcttcattgagttacacacttctctgaaatacttgtatttaaaagtaagcacaaaagcgtaaaatgattacatctgtacaaaatggaaaaacacatttctcaaaaacatatagcagggtttatattgtagccaattattattttctttaaataacattgtacacattttttccaataatgttaccgttaatgaaaatactttggggatgtggttctggaattgcctgaaaatcctacagcatattccctttgattgtctaaactggtggactatatttgtctggggagattgatttcatttttaaaagcagcctgaaggcatttaaaaccttgttttatgcataaagtgatgattaaagtagttaatacaatattgctcaaaactcttttacagaaagtccattatgacaacctcatcacagtgaactcagccacagccacacaatcccttggctttgttttatgcagaatctctcagatgcatcattattcctctatagcgatcaatttaattgagcattttatccaataatatgaattctccaagaatgtcatttgtatcacaggaataaatcaacattcatttcacttagattttcacaagtaaacttttctccatgttggagtttccagtgcagactctaattgtttatttccaggttttattggaaacaacatatttcatcaccagttaccagttttctcagatacacattattttgtcgaaagaacacaacaaatgtcaagttgtcactgtttgttaatcagtcataatgtgtgaaacatcttggcagaaacttctttcattcttgctttgttttaaatgaaaatgttttgttatgtaattttaattactcaatcatcatcttcccagtaaatctattttttagtagcccaaatctatgtccatttcactatttctattggtcccttgggttcttcatgtatttttatttgaatttttgcatcagaaatattaattgaaataaatttaacatataatgaataatattatcatcactaatgtacctgctatcaataaacaaatattaattttttgttatgattattttagtgttttgaaaaatatttcaggtaaaatttcatgtgctatcttcccttcctcagtttacatttctatatttttattactgtttacatggtaacccatatatataatgtatagagttgtttgtgttacttttcttttttatagaaattatgtcacatgatataatattttctgtaattgctttttcacttaacctagtcaattggctttttggtatcttaggggagatgtctttttaatacagaaaacaacatttatagttagttatttgtctctaaattattatcctgtttaaaagagttttaattataaagcctagtttttcataagattttagagtaaatttacaaatttaaaaccagtaatttcgtggataaattaatatatcagctttaattattcttgaattaatattccattggtttatgcatttaatagggttaaaattccctatatatttgaaaatatctaaagaaaaattaagcaagctctcttaaacatttttaatgaaaaccacaaattggatatatctgtttctagcacttcaaacacccaggaagcagactctcaaatactcataaaaacaataaaatcttcctaagcactcaaacactgcttgtaaacaataagcctaagtggatagttctaataaatcagattgccttgagcatctaaatattgatttaaaattaaggtaaatctttttaagtatttcaattaaaatctcatcttttatgtcagattcctttaaatgcctctctttaaaaagcagatagcacaagttaaaattaacaaaaaagatataaatcattattacacttggatttcatacaaaagtattatactaagcatttgtttcatgtctttttccatctccatcatgtgtcatactatcaagagttaaaattgtttatcacagaagcaaaataaccatctcaaactggctgtttagttagagatcaagtttacagagtacagaattaggaccttggtatgtttgcagatttggattatggcgagagatttgagactaaaacacaggaacctgagtgtactttcttacatggcagagccagtgatcactgggatgggaccttcctcacactaccatctgctgcggtgtcaagtagtcttttgcagagaaatggtttttcatggtctgtcccgtatgcatcccttaattatcactctcacccatttttttttaattttgttttactttaatttctgggatacatgtacagaatgtgcaggtttgttacataggtatacatgtgccatggtgttttgctgcacctatcaacctgtcatctaggttttaagccccgcatgcattaggcatttgtcctaatgctatccctctccttgccccgacccccccgacaggccctggtgtgtgttgttcccttccctgtgtccatgtgttctcattgttcaactcccacttatgaaggagaacatgtagtatttggttttctgttcctgtgttagtttgctgaggataatagcttccagcttcatccatgtccctgcaaaggacaagatctcactctattttatggctgcatagtatctcatggtgtatatgtaccacatttttttttatccagtctatcattgatgggcatttgggttggttccatgtctttgctattgtaaatagtgctgcaataaacatacatgtgcatgtatctttatagtagaatgttttataatcctttgggtatatacccagtaatgggattgctgggtcaaatgttatttctggttctagatccttgaagaattgccacactgtcttccacaatagttgaactaatttacactcccaccaacagtgtaaaagcgttcctatttctccacatcctctccagcatctgttgtttcctgactttttaatgattgccattctaactggaatgagatggtatcttgttgttttgatttgcatttctctaacggccagtgatgatgagcttttgttcatatgttcattggccgcagatctcatacagaactttttaccacagactccttgaatttttaccttctgactttttctgatggaactgaggcaaataaaatacaatacagttaagtttcagttaagtatcttctgtagacgttattaaaaatccataggccgggtacagtggctcatgcctgtgatcccagcactttgggaggccgaggcaggtggatgacttgaggtcgggagttccagaccagcctgacctacatggtgaaaccccgtctctactaaatacaaaaaattagcggggcatggtggcatatgcctgtaatcccagctacttgggaggctgaggcaggagaatcgcctgaacctgggaggcagaggttgcagtgagccgagattgcgccactgcactccagcctgggcaacaagagtgaaactccatctcaaaaagaaaaagaaaaagaaaatccatagatgcctttgctttcatatatcttctatcattgtcccagcttgtgtaacattatgaactcacgacctttgacaggattatcattttcttttttggtactctgattgtcacaaccccaggaggctttttttccccccttacagaaccattcccagacatctttgaaagcattctcacttcctggtaacaattacatagttcaaatacaactttgttttctctaccccatgacagggaatcaattactcttcaaggagtcctggctgggtacttttatggaatatagagaccaaaatctgggcattaggggtgcaggtcaaattgttactcatgagaaagaaatggtgacattttcccagcctacttaatgactgagctgggagagatattttttcaagttcatgtgaacttcatgaagttcattttacctttaaattagattttattaaggcttgttaaaaacttttttgttctaatataaaatgtcttttctcatttgtttccctttcagactatcgttctttcaccattctgaatatgccattttattagttgctatattaaattatgtgattaaattatgagaatgtctaacctttgtataattagatgtgatttgctaagatcgtgtatccctctcagctgccgctgagtctttttctttatataaatcataatgttatagtcatattttggataagcattatgttttcaagaaacattatatttctttctatgttatatataatttttgactataagagacaatgctgtaaacaaatatccttatgtatgtctctatcactatctgccagtttctctggggtctaaatccagaagtataatttttaggttataggttctgctcacttttaattttactagatattgacaaatcacctttcaaactgggctgacaatttgcactccctccaagagtggtgagagatatgagatttccaatttctccttattcttaccaatacttgatactgtcaaatgttttaattttttgccacttctgataagaaatcactcctcttcattgttttacttttcactcccttcattacaaatgagattgagcatcttttcatgtttttatttcctgtgtagaatttctgtttaatgaatttcttgtccatatccttgcccatttctgtttttgtgtctttttcttttcctaaatgatgtttcatattctaaatatttaccatgtatgttaatatacatcttctcttagacactttacttctaccattgtggtaccttttattgtagagacgtatgtgtctacatagacaatttaacagtttgtttaatcgtcttgtgttttgtgtcttatgatacaaaaaatactttcttgccctaatgtaatgaggttatgctcctaaattttcgagatgtctcaagttcttttttcacattcaggtctttaaatcatttggaggggtttttttgtgtgtgattttttttaaagtctaatttattttgtattcctttccagtggccactgttccaatatcatgtttagtccattttcctattttctttgctggtttttaataccaagatcaatatatgctcgagtagcctcctaagctgaatattcttttgcacagatctgcttttcttctatccctgtagccaccaatattcttgattactacttatttataacatctggtagaacaactctctacttcctgatttctttttcttaattgttatgtctaatcttggatctttactctccatatgataatcaaatcactttttcagtctgccctttccccagggaaaactgtttatggtttgtttggaaaatgacagaatttatagaaaaattcgaaagaacttatctccaaaaaatattgtgtcttcatcttttcaagggacaaaataatataactaggtggcttataaacaacagaaatttatttctcacagttttaaactctgggaagttcaagatcaaggtgacagcagattcagtgtctggcaaacgcctgctttctggctcatagatgaaaccatctagctatgtcctcacatggtggaaggggcgaggggtctccttatgcctgttttataagagcactagtcccattcatgaggcttgacctccatgacataattacctcctaaaggcccaacctccaaatatcattaccttgagacttcaggttttgacatacgaatttgaaggggacacaattattcagaccatagcacttgctatccatgcacttgtgtggccaaattccggtcttctgtgagtaacaatgaaggttacagacatatgtgtgtatctgttatatttatgcctgagaatcttaacccttttgttgcccctgtgaatagtgtcttattattctatttcattttctactttgctattgtggctgcagagtaacactactgatttttatgttttggtcttatatcctggcaaccttgctgaattacctaattagctttactaggttttatattatcttggatattatatataaataatgtcaacttttttctctaccgtgctaaaactcagtttcttgtcttattgcttttactagaatgtccagtacagcgttaagtggtaggattgatagcccttaaggccaaataccaagagcaaaaacatgaacagttggattgatccaagattgatggagcagagaggattaaagatgtcgacaagattctgtatacaactggacagtgctgatatgatgatggtaattatgatgatagccaacttttaatgagtgattgtcactacattacagaaacagggctaaatattttatatttgtattgtacttaaaccttaggaaagccatagaggaaggaaactcttattatcactatcttagggataagaaaatcagtcctagcaaagtttagtggcttgctcatggccacacagctatcagttgatgaacacagagcactaatccaagctgcaggttcaatcccttagaatcctcaatggtagaccatcaactagttctttagctctatgaagaacagaattagaggtaatggatttcaatttggccataaatggttttaagcccattttcacttcttcttcaagtatgtctctgattattttctctggagttttttaaaacagatagaaacccatgttttttagatttcacttaataaacaattattgcacaccaatcatgtgacaagcatgataagatagtcaaagatattatctatcaacatttcttcaaagagatttcagtgtactaaagcagatgaatgaggatgtgaccaactataatttcaagcagaattttaaaagtgttacaagtaaaagtacaagcaaaatgctaccttggataaaagtcagggaatagattatattacttttttattttattttattttatttttgagactgtctcactctgttgcccaggctggagtgcagtggcatgatctcggctcactgcagtctccacctcctgggttcaagtgattttcctgcctcagcctcccaggtagctgggattgcagatgcatgccaccacgcttaactaatttttgtattttcagtagagatggggtttcgccatgttggctagcttatctcaaactcctgacatcaggtgatctgcccgcctcgacctcccaaagtgctgggattacaagcgtgagccaccacacccggctgtatgtagattaccttttgagactgttttcagtggtgattctgcaattcagtcattatttttaggatttttgattgtttattcactgattaaaaaaataaaaggatggaaatgagtaaatttatctggacacttgcccatgcacttgattttttaaatgaacagaataaagaaagcaaaaagacagtatactttcccattaagtaataattttgtaaaatatgtgatgccacttcaaaggccaaaatatcccaatttaaattttaaaagacctgtgctatcacagatatatttaatctctgaattttagtcctgctgtacaaagagagcatcatgttaaaagtagatgtgggtggttctaagattcatttgcataattgttagtaatgcagagcagggtacgggcatcaactaggaaatactctttataaaaggcctgaacttgcacaagcaaatcttggggaaacttcctctgaatacataagataccataaaaataaaaataaaaatgtccctaaatgcagtggaatgagtgagagaatccatcagcaggtgatgtgttcagggaaagtccaagacatgatattgtataaagttaagagaatcagatttaaatgctcaaaattttggtccttttactttgcttttctttaacttttgggtattcatttttctaaaaatcaacattttaaaattcacttttgagggtttgggagtcattatgtacatggatggacatattgcttttattttcttccctttgatcagcacacatcatatacattctaggaacggtttaactcatgtctctgcattctgctgggttggtgctgattatgaggtgattttccaaagaatacatggaagtttgacaagagtgtacgcgtgcatcatcataagagctttatggtctttaattttggaagcaactttttttcatgtgggaaaaatagatcaatatcccattttatcttcaacttgatttagataattttaatgtgactaacaagttatgactcacgcatgtgttggtctgtaattaatcacaggcctaagatccatcagaagcccactcttctgtgagatttccaatagttgtgaaccttatgttcaccaatcttcttgctttattcttaagaggtgtcaagtaatcattgtctgatgagagcaactgaaaataagaacagtacccatgctctgcactctcaaaatgtttaacaacgtgattttccctcttacactgtttctatctatttatttataataacattactttgtagagtagtagttgatgcctcctgttctcaaaagaacaatgttgttgttgttgttgttgttgttgttttctgggtgtgctgtctttgtaaaacaaagtgagaaattataacatgaaaaatcctgataagactactttttctgctgagctcatgctctattaaaaaaaatccctgaaacatccattgttggatttttatagattcctcttggaaattcagagccaaaaacttttaaaaggtttaagaaaagaaataaaaagaagaggaagtccaacatgaagcaaatacacttgggatggagctgactcaggaagacaggagtcaaaaaaatagagcatttgcaaggaacagtgagagataacatcagaaagacagcattgtatatacacaggagccaggggtgcagaagaactgaacagaaaagttcccattgctacctgccggaaaatcttatgctgaagctcattacacagcagccaatgagtaagaataagaggagaccaggcggccacctgggctgccacaaaatataaggaaatagagagaacaaagaatacaaaaagtaggaacctaaaataaggcagattaagaagagtgaggtggtacttcaaatgccaaagaagtacaagtaccattgaataagtacaagttgctgctgaaaggatgtcattaatacaattaaatgcaactctatatgacatagtgatcattatggttattgcttgtaagaatcaatattcttaaggacatatatgatagtcttctttagtttctcagaatttatatgatgagattaatctctgccacatcaagtagatcttcaaagatataactcaatttaaaaacctgatacatatcaaacaactgaggtttgaattatttgaccaaaaaattttacatcatgattagaatgatgttcttgcctgaagatactcccttgtcaatctaggatataacccagagcctacaaatcctggtaaaaactacttttcacagctcatgctatattaaaaatccctgaagcattcattgttggtttttatagactcttgaaaattcagagccaaaaccttttaaagggtttaggaaaagaaatataaagaaaaaagaaggaaaagtccaatatgaagcaaatacacttgggaaagaaagaagtcatcataatagagcattcacaagcaacagtgagagatgagagatagcatcagaaagagtattgtgtatgcatagagggtccgtcctcagagatacatcctcactttccttttgatgtgttcaagtgaatctctgaaaccatgtatagtgttgagtctatagcaatagaaatcattataaaaattcaaagaataaaatactttttttttttttgagacagagtcttgctttgtcagtcaggctggagagcggtgagacaatcttggctcactgcaacttcagcctcctgggcttaatcaatcctcttacctcagcctcctgagtagctgggaccacagatgcacaccaccatttttgcctaattttttgtattttaggtagagacagggtttcaccatgtttcccaggctggtcctgaactcctgagctcaagcgattcatccaccttggcctcccaaattgctgggattacaggcgtgagccaccttgcctggcaagataatttaaatttttaaaatgtaggtcatggctaactaatcataataattattatactccactcttcctacacacaagtcacttctctcagcctcagttaccctatctttaaaatgaaatattaataatggcaaattcataggatagttatgaagattaatatgagacaataagcataaagtatcagaacaactagacaatttgctaaataagaaatgattcaacaaaaattagcttgtattatttttaatttgtcagcttcataagtgcagggacgatttcaattttgactacctttatatatacagccagcttcatacatcagtgcattagtaaataacagaaacttattatttcttgactaaataaattatgacatggtaagaaattgttcctgccctcaggatgaacacaatcaactgaaaaagataaaaaattcgacatttacaaaagaatgtactttggtaggctgaagcaggaggatcacttgagcccaggattccaagtccagcttaggcaacatagtgagacactctctctaaaaagaattttaaatttttaaaaagaatgtactaaatattataaaatgggaaatttgaagcactatgagaaggacttacctttctaacaatatgaaggaatatgtactctgaaaatcctttttataacatcacttacaaaaatacatagttgagctgacaaaaaaataagagagccccttaaaggcctgaattaaagagcgattttgaattcagagagaaaatagttgacatctgccatgtgcttctgccattgcctagtggctgagagcttagatcacacatgcacaagggaaaggaagcagagccttctagctggtaagagggtcccaagtaaagcaaaaactgcttaagggcaattgctgcaaaaaaataataaaattgggtgagggaaccacctcagaaagggagagactaaaaaaattaatctatttcaaccttggatctcactggagggaggaaaaacatctcctagctcttatatgagtgtcaacttgagttcacattatctgtgtgttcccccaaacctaagttcacacctcacataagcaaaagaaaatcatatctgggagaataacctttaccccaagactccaagaattctaacaaatgaatacccaaagagcatgagctagcatgagtgagggtcagcaaaagaaacaaatgacagactcagaccatcaaagattgcagatagtgtgtcaggcagtttcagaatgtaaaatagacaagtaaaatcttcaatgaataaaagagcattccataaatatgagtggggagcaagggaacattagagatacacaggcatcatacctgaaagaagaatgaatataactcatggaaattattatgtgtatgtatgtgtgtgtgcctgtttagtaaacattagcatcttagacacaactgaagagagaactagtaaagtaaaatatagacatgaagaaattacccagaatgcaatataaaggggaaaaggatgaaaaatatgaaagagaagttaaaaggtacatttaatcagaattccagaaagaatacagaattataaagaaaaggaaatattttagaatatgattattaagaaatttccagaattgaagagaaacagcagttatccagttcaagcagccaaatttattccaaagtggagtaataaaaagaaatccatacacactatagacaaactgtagaacacagaatagtctcattagaagccagagaaaataagcagacaacataagaaagaatgacaattagactgacaattcttagcaataacggaatatagaagactgaaataattattttaaagttctgagagaaaaattactgacaggtgtaattgtatgtctttcaagcacaaaagcaaaacaactttgtttttggtcattccaaaaaataaatattaaaaactggaactaaataatttattacccagaaaccctcacatgtgtattttcctaaaaggtctacttcaataaaaaggcaaattgccccagaaaggatgtcttatctaaagacaaaaaagaatgatgagtattattatgtaattatgagcaaatagatggaaaaagctaattgttacagtgttaaaaactactgtaaaacaattgcaaataaattttaagaggattatcagaataaaaatgttctaagaaagaaggaaaattttcttaaaggaagatgtattagtccatttttatgctgcagataaagacatacctgagactagaaagaaaaagatgtttagtggacttacagttccacatggctgggaaggcctcacaatcatggtgaatggcaaggagaagcaagtcacatcttacttggatggcagcaggcaaagagagaacttgtgcagggaaactcaccattttgaaaaccatcaggtctcatgagacttattcaccatcacaagaacagcacaggaaagacccacccccataattcaatcacctcccaccatgacacgtgggaattgtgggagttacaattcaagatgagatttgggtgaggacacagccaaaccatatcagaagatctgagatacaagaaagtatgatgaatagataaatctaaacaaatgttgactacaaataattgaaaataatatttaatttgcacattaaataatacaattaaaaagcaagacaacagcatatcagttgttgatagtggtggtgattaaagttgtgttcagaggtccttgtattattccaaaagtgggtaaatatactgattaaatttaaactttattgagttatgtatgcatattaggaattagagtaagcactaaaattatagagtccaagactgcaattccaaaactagcagacagaaaaactaagaagaggaaaaaaaacctaattagcttgaaaagacgaaaaggagaaaatttttaaaagcacaaatatactgttaaccaagtgagtgaaaattggctaaatacttgaattaaaagacaaagaatgacagataatacattttaactaacaatattatgtttataagcagcccacttaaaaatataacacattaatattaaaaataaaattgtgagaaaaataactaccaagaaaacaaaccaaagggagctgatatagctttaaaatcagatgaaataaagtttaagaccatgaaaaacattgtcagagataaagacggttaatacataaagtaaaacgttaaaatttggcagaactacaagaagaaactagcagatcccgtctgctaagaagtagaaggtaagttaatgcatcctaggcagtacaaggaaggtttttcggaaatgatgaaacctgtattgggactcaaagatgcggaagttggcaaaataaatagggtagaattgataaaggaaacaagtttacaaaagcagagaacatagcatttttgagaaactgcaagtactttaatatgacgctgtgcacagagggcctgtaataatgaggagtaaatgaagaactagcatactagttttatgcactgttagactttatcttgaaaaatgcagaaaatcactgaagaaccttaagcggacaagagtcatagtcaaattttactttgagaccagtaattctggtggtgctgagcataatggcttagaagggatccagactgcatttgcgatgaaccatacatgtttctggtctcagaattgggggaccataaagtagtgacaacgactgtaaaaccaaatgtcagtccacatgacctgggccttactgctctttgtaatgcccagataataaatttccagttccactaagtgttagtgaatacccatcacttggccaaatataggggtgtcttacttttctgccatgttgcattcctgagtagtccttcattcacattttttaattcatttaatatttattgtgcaaactactacttccaagcatacttttataggcactggggatacagcagtgcgcagaagaaaaaattccctatcttcatggagcccacagtctgtatgtacatctatgtgtctgtgtctctgtgtgtttgtatatgtataggaagatacagacaataaacattccacataagtaagttatataggacattaaagattagtaaatactatggaaaaataaaagagagtaagggagatggacagtgcctgagcaaagaaaagattacaatttttaggtgtcatgagggaaccttgctaaggaaatatctgaactaggacttgaatgcagtaaggaaaaaaccatgcaaatatcgaatgaacagtattccaggcagcagcaacaataaagttaaagaccctggagtgtgattgtgcttggtgtgttgaagaacatcaaggaagtcactgtggctggaacagaatgaggcagaggggaagcagattagataggaccttggagcctcggaagccactgggaagctttgatcagagagctactcaacagcatataactgatgcatttatagtgtgtattaggaatagcctgaaatgtattcaagtaaagacttacattctcccttcaccttccaccctcctttcttgccatctctgattattgaaggtataaaatgaagcagtaccaccaaggccatggtaagagaaacaaactcaccttgactcagcatctactatgtgccaagcgccatgctagaaactatagttttatctcaattcagcagcaaaatcagtctatcaggtttcagtggcacaaagaagagaacacagaaatattttagtcaattaccaaatggtaagctacaattttttaaataagtcccccctgcataaagaaaagataaatttttaagttgatggatttctgaattactctgatttgatcattagacattatatgaatatatcaaaatattgcatgtacctagaaaacatgtacatccactatgtatcaataataaatttttaaaagcccccaagccttcttggacatttgctaagggcagtgtggctgtttgcagccctatatgcagaaacctccatgaatatgtagggtacaaggcagagagaactgaattcagtcagagctgaatggtgcttggaaggtgcccagcctcccaagaagatgtctatttaccctcagcgagcagtcacagtgccctctgcccaggagggcaggattagctttgaagcagggttgtttgtttctctttttagaaaagctctgttgaaacataattgatatatttaaaattgcatatatttaatatatacattttgatgggtttggacatatgtacatatttgtgataccatcaccataatcagcatactaagcatattcatcacctgtcaaaattaccttgtgttcttttgtggttttgttttgctttgtgataagagcaagtaacatgagctctatcctcttaacatactttaaagggtacgatgccatattgttaactataggtactatattgtacagcagatctctagaacttactcatctggtatgactgaaactgtatatagggtttttcatttctgtggcaactctatacatgaaagagctgtttgtgggggaagttattaggttgcattaaaacaagtcattgagaatagcagtggggttgtggtgtgtggcagtggctgctgctatgggaggttgtgtgcctagtggtcatgaattgtgccaccactggcaccatttgagaatggatggaatagtaggacacaccaggatcaaaaccatcttgccgaggttcttattcttgatcgaaatagatttgtatttcataaattatcagataaaaacctttgtgtcttaactaaaagtaaagtggaggtcccagtgacaagctttgcaaaagccccacatcacataagcatatcatatcagaagacagtagaaagaattgtgaacatcaagattgacaccaaacatctggcccttgtaaagagaacatgtagccctcccaagggagttccagtaattggaatggaatgaactctatccaagtatctgcaaaactcctaaatcagattaacaaattattgtccactgttgtggaagaattttgggaaatgggaaaggtgctggaagactagagacagacaaattttattgttgattctactatgttaggcaatttcaagagccaacaagcttcatattgatcaaaagcaatattccagaatggatttaataggtgggtatatgagtactttgaaaagcaagtgtccttgggatcctgtctgtgctcaccaataacaaatcacattactcttactttaattccttgtttgacagatttactatgtccataatgctagtattgcacagttaaattcagatttcagtaaagtagttgacaaaatctaacatgaaagtcttcagaaaatgttcatttattcaattctacacttgagtatgtgtaaatggttggatgtgtaaatggttggatgaacatactcaaaaagtgtcaattcagatattctagagaattatcaatatatgaatgaagatatgtggataaaggatccttcatacccagatcacctatgattttaatactcttacctgattactatcactattaaccatggctaaaaagcctagaaaaaggtgacaaattaaagtgacttaaagaaaacaccatataactaaaattgcctgctccatatgccccccaaaatggttacataatctacagtcatgtaatgaatgcctcaaaaataatggagttgcataatttatgcaccgatgttagaattcagtgccacctaaggtgcaactctaccatcttgtttaatccttcctaaaataaagaaatatataaacatatactgattttagatgctgaattttaaaacaaaaatataatcgctattatcaggcaagactattctagaatcccctatcatccattctctatttacctcaaaaatctgatagtaatctaggcaggaaggcttgaatgtccacacatttggatataggctttcagaggctctcagatcttggattatagtaattattgctatgttaacaacactgtgaatactacactttatggtcaatttaaaggaaacttagggtcatttttactgtgtgtaatggtatgtctttctcattagatttagagcctaatccccatgtaagaggctactctcatttgcattagctatatatacaccatcacagaatgatggacaaagatttctctctcccctcaaaaaggaaaaccattaacatttactgggtgcttgctaaaagagcatcattttaggatctctaagtactttaattaaaacatagaaccttccttcaggaaggtaagaactcatctccatcagcagcatcactttatgcacaactgaaagttcctgttcttaggctcttactgctctaggttatcttagactgctctagtagatctaaaataggtcaagtttgatcagataatttgtagtgcctcaattggtcagagcccttgacatacataggtcttctctagttttgaggaggaacattgctaactcacatttgtgatgaaagttcacccagatccctctagcaaactatgccggtggcttcactacagatgtacctctctggcagattcggagatttcaagcaaatgtatcaaaccctaatgtgctatgacaggaggatttcctccaccaatcataagtagaaatgcctgggagctattattcaacaggaaacaaagctccttcatctgaaaagcaatttgcagaccgacactcctgctacagcaatttttatcatgagtttgtactttgaatggaacctaccttaaaaaaaaaaaaagacaatgtatcttatatcctggatgttccagattttgaaacagaacattcatagcagaaagtatcagttttcggaagctcttctgctctgaattaaaatatcagagttgggttttttttcctgtttaaacaagaaaaaagtatactgcccataacaaattatattgtttatcagtcatataagctcttaaagcagaaccatatgaatacagtccctgtaaagttatagtaggaaaaaatagacatatggacatcctgggggaagaggcggccatgttcattttccatttgcctaccccagaacattccatattgtgtaaaatttttccatgcatgtgcatctccaaaaatgaaaataaaaattataaaacagctttgtgagcatgctgccagcagaagagtagggtagagctggatgcataatcaacctttttgatgtaaggactgctggcaagcagtgtgggccagcagagcacatgggaagctgaggagcagccatagatacactggagacttctctgtcccaggctgcattgagatgtatgcatcaggctattgtggtttttttttaatactaattctagatatttttttctttgtaaaataaggctatcaaaaagaggagcgcagaatgtttctgccagtttgtaagtgtgtgacaatgggcaggaaacctggctgtcttcaacagaaagggagtaggaaccaccaggagaatggaagagatgcttttgcagggagcgtgagagaaaattttgacacacatcttccccagcctaatctgcaatgcaatgctttagggagagccaggcaccatgttaaaatctggttaaactaaatattgtactgttttctttccttggtaaacactgacttggtaagaaaaaatgatatcctttgtatatgaatttgttctcctggtaataataatgaatttagacctatttttccacaccatttttgctgcccaggcagatattatcaagccagctcactaagtttaagtgagtaatccacgaacattcatttatttaataaactttaattaagcatctactctatgccaggcacagtgcttggtacaatcacaatagaaatattgcctctactccaagctcctgcttattgaaactataccagggaggcttagctttcccaggttatcctgggaccctaaacccacagctcctagcagggattctcatcctttctgatgttctaatactatataattaggtatataattgggtgttgtgaaccaccctcactcctaaaagtatgattagagtttgtttgtcctatacattaaaatgaaaataatttggtgtagaactttatagtagacttcaggataactaaaaacgttctcaaacactgaaatctaaacaaccattctgcaagagcagcttttctgggcccttttaacatttatcatctctattgactcaaatgagtcaaagcaattattctgacacttgaaattttacctttaacgtttcctgggaaacatagcttatactcacctctacacttcttgtgggttcatttaaagaggaagtaatctggaaaagagccatgaataacagaattacccagtaccttgatgttttctcatttctctgccggcattcagcccaacagctgtcactgtacctctacaggaacttagttcttgtatggcaacttgagtggcattgagctctgatagaaggtcataacatctttgttagaaataatatgcaaatttttccaagaggttatgtctcaagtttctattctaaaagcaagaaaagtcacaaaacaaatttctttgtagatcaaatactaagaggtgaagaaaattaatttccctctggcttttgtcttggttgacaattcttctgggataaggttgattatttttatgattcctcatggagactgtcagctctgcctgattaactgaaaactagcataaaaagattgtataatgaacattattcatataaaattattccttttagaggctaaataagaaaatttgccttacatagagggaaatttggcactctatgttggttgtcttactttgattaccaaaaatcactttttgagtcctgtatgataactcccatattttagagtagcaattgatctcataggaagtaaataacatagccacacaactattatgtggtcagacaaggatttgagtgcagtaattattagctgggagtgtccatgagcacgtgtgcacacacacacacaagcctcagctccacacgttctgattcagtaggtttaaggtggagccccagtaatcccagactttgggaggccgagatgggcggatcacgaggtcaggagatcgagaccatcctggctaacacggtgaaaccccatctctactaaaaaaaaaaaaaaaaaaaaaaaaattagctgggcgtggtggcgggcgcctgtagtcccagctacttgggaggctgaggcaggagaatggcgtgaacccaggaggcggagcttgcagtgagcagagatcgcaccactgcacaccagcctgggtgacagagcgagactcggtctcaaaaaaaaaaaaaagaaaaaaaactccataggtgattcgtgtgctcctcccagttaggaaccactacccaatatgctacttcaactacagaagggctgtgaaatgacaagaatgctccccaaaacatctgattaacaattcaaaaacatgccatggagaacacgattttttaaaataggactttttgaaggaaaagaagaaagggtgcagttatatggattctttaagaaaaaacaaaaccaaggagaaccagggttaggaggaacgttaagtaacactttgaattagtcattaccgtgtacagtgtaatgaactcaatttctgagttgttgaaccactgaggaatatgtataatatatattcaacatatatattatttagagtcaacatatattatatatatatactatatatattcaacatatatataaaacttacccataataggcctaatgcatttatttaatgtttatgtatattaaaagtgttagtctttttaaagaatggaaaaaggactttagaggcttttctcttacatccaaagtaatataaattcaagggatttataaagtattacagatcagaaaggctttgtgtctattccagaaaatgaagttacttactagaaatttcagtgagatctttactagatggattggacaaattataagatagttggacactgtagaaggattttttttattttaaaacaatgtgcctaagtcacaaaacttaatagtctcaaaatagacaatggattgagttccaaaagtttatttcttagcaagtctattaaattataacaaagttatgtacaaattataataaagtacccaatgagcctttgtaaaggaggtcacaatgtagttgaaatgtcatatactttccttgaaaaatacttgaaaataatacttctatagttatttaacagtatttaaaccaagtctttaattgagtagccatagtagatataaaagcacgttggaaatggcagacaaaaagcaagttttaactttgcatgttgactgtaccttaaaagtaccctatgtggattatttacctagtaaattgtattaatgatcatctccattaaatgtttagaggaagattattgaagaaaaacaaaaagtaatatctacttgtaaaaaaaaaaaatacctacttgtagtgggtctcgaatttcaattaccaagaaactgaagagtttatgtaaaatgcagattccatgctgtaattgcggagattcagagtcagaaggtcagatattggaaattttatatttctaacaatacacagtaagaagcactaaaaactcgtccataactgtactgctttttgcttgtcccagtataaattttaataacacccactcccagtctcagtatacttatttggatgataaattatggtcaacagaggtttagagtatgcagaattctctgaagtcttccaagttggaaaaagtgccgctcctagaattggtaggactccctgccaccctgtagtcactggtacctttgctgtgtggtggtcacagagccatctctcaaaaactcatagaaaatgcaagtattgttgaaaccactccaaaagaggtctcctttggtgttctcttactagggaattctgagtcctggttttttgtttgtttgttggttggttggttggttggttggttttttgtttttttcttgtagtaaattcttatctaccatgttctcatattatagtcatcttaggaggtcattccgagcaacatgaaaagcaagaagaagagccccaacatagaaaacagaacgtatttgggtaacgatgggaagagcagagtactccaggcatagaaggagaaagaaggtaaaagtgcagattggaccactttggggcccaggataatgggggaaaaaattggaattacatggcttctgtgatggaaattattggaaaaaaaatttattaaaaaatgagggtctagcagggcaaggtggcttacgtctgtaatcccagcactttgggaggccgaggcgggtagatcacttgaggtcaggagtttgagaccagcctgccaatatggtgaaaccccacctctactaaaagtacaaaaaaattagccgggcatggtggcacacgcttgtaatcccagcttcttgggaggctgaagcaggaggatcgcttgaacctgggagacagctgttgcggggagccgagattgtaccaccgcattccagcatgggcaacagagtcagactccctctcaagaagacaagcaaaaaaatgagggtcactcagagatgaaacttttcttaactttttcttggttaactaagataacacatatgaaaatacttggtaaacaaacaaacgaacaaacaaaaatagaaccaagagaagaaatagcgaaagaaaaggcaaaaaggaggagagggagtacgcaagctgtggctccattaggacaggccctagaagtaaggaagggaggaccacagcctaaaatcatggctttgttggggatgggggccagtggaagggaaatatttctgaaactaattttaagagtaagtgaactccctagaaaatatttttgtcttataattgatactgtgcttcttctaaaaaatgaggtagtatctattctctctacacttcccaaatcctgtcagtcctgttcatactaccaaaacagaccaaggcaggaatggttttcttgaatattttgttcatcttccatgacagatgtagaacttcaagtactaaaagtttgctgtttaattaatattcaggcaaaatacattttctatctgttaatgaacaatggcacctgaggggaaaatgtctgtatacatgagggggaaacgtttgtgtaatgagattttttttttaattttactttaagttccaggatacatgtgcagaacattcaggtttgttacataggtatatgtgtgccatggtggtttgctgcatctatcaacccgtcagtgaggttttaagccctgcatgcattagctttttgtcctgatgctcttcctcccctcgccactccccacccccggctataggccccagagtgtgttgttcccctctctgtgtccctgtgttctcattgttcaactcccacttaggagtgagaacatgtggtgtttggttttctgttcctgtgttagtttgctgagaatgatggcttccagcttcatctatgtctctgcaaaggacatgatctcattcctttttatggctgcatagtattccatggtatatgtgtaccacatttttttgtccagtctataattgatgaacatttgggctggttccatgtcttagctattgtgaatagtgctgcaataaacgtaagtgtgcatgtatctttataatagaatgatttatatttctttgggtatatacccagtaatgggattgctgggtcaaatgttatttctggttctagatccttgaggaattgccacactgtattccataatggttgaactaatttatactcccaccaacagtgtaaaagggttcctatttctccacagcttctccagcatctgttgtttcttgatttttttaaataatcaccattctgactggtatgagatggtatctcatgtggttgtgatctgcatttctctaatgatcagtgatgttgagcttttcttcatatgtttgttggccgcataaatgccttcttttgagaactgtctgttcatgtcctttgcccagtttttgatagggttctttgtttttttcttgtgaatttgtttaagttccttataaattctgtatattagacctttgtcagatgggtagattgcaaaaattttttcccattatgtaggttgcccgcactctgatgatagtttcttttgctctgtagaagactgagacattattaaacagataatttcatggcctgatatttcatttacattttaacaaaaagattttctcctgatattccatgtttttctcaaaattcatttctaataaccatatactattccaacttgtacatgtaccaatatttcccagcaaccatcatcctttcttgttacatttgagattctttttctctcaaatattgctgtgcattggctttttccttctctcagatcgtttactaatgatagaattatgagagtgcgattatggggtcaaacaatatgagtagttttgaggtgcatgatacatatttccaaactacttgaaaatagatttatacacacattctgcactgtgtaaaatttttatctcaaatttaattattttgataataaaatatatttttcttaatttactttggtttacttattaggtcaaacatatttacccatattttctctttctttgacgttttcgtcttttctttttttatttttccatagattataggggtacaggtggtgtttgattacatgaatgagttctttagtggtgatttctgagattttggtgtacccatcaccagagcagtatacacttcaccctctgtgtagtcttttatccctcacccccttcccacccttcaccccaagtccccaaagtccactgtatcattctttctctttttttttttctgagacagagtctcactctgtcacccaggctggagtgcagtggcatgatctcagctcactgcaacctctgcctcccaggttcaagtgattctcctgcctcagtctcctgagtatctgggtgtgcaccaccacgccctgctaccttttgtatttttagtagagatggggtttcaccatgttggtcaagctggtctcgaacccctgacctcgtgatccacccgccttggcctcccaaactgctgggattacaggcgtcagccactgcgcctggcctattgcaccattcttatgcatttgtgtcctcatagctttgctcccacatatcagtgagaacatatgatgattggttttccattcctgagttacttcacttagaataatagcctccaatctcatccagatcactgtgaatgccgtgaattcattccttcttatgtctgagtacatatatatatatcccatctcatatatatatatatctcatcctatatatataaagaaactttatatatataaaaagaaactgtggtatatatatgatgaaatatatatatataaactgtggtatatatatgatatatatatcatatatatgatttattttatatatattccatcatatatatatatatactccatcatatatatatatatttatatatataccacagtttctttattccctgttgattgatgggcatttgggttggttccacaattttgcagttgcgaattgtgctgctataaacatgcatgtgcaagtatctttttcgcataatgactcctttttcactgggtagatacccagtagtggggttgctggatcaaatagtagttctgcttttagttctttaaggaatatccacactgctttccatagtgttgtactagtttatattctcaccagcagtgtagaagtgttccctcatcactgcatccacgccaacacctactgttttttttatttttttatggccattcttgcaggaataaggtggtatcacatggtggttttgatttgcatcccctgattattagcgattttgagcatttgttcatatgtttgttggccatttgtatatcttcttttgagaattgtctattcatgtccttagcccatttttttaattatgctttaagttctagggtacatgtgcacaacatgcaggtttgttacatatgtatacgtgtgccatgttggtgtgctgcacccattaactcatcatttaccttaggtatatctcctaacgctgtccctcccccctcccccctcccccgaccccacaacagggcctggtgtgtgatgttccccttcccttagcccattttttgatgggatttatttttcttgctgatttatttgagtttgttgtagattctggatattagtcctttgtcacatatatagattgtgaagattttcttccgttctgtggattgtcagtttattctgcttactgttccttttgtcatgcaaaagctcttttaattaagtccccgctatttatctctgtttttattgcatttgcttttggcttcttggtcatgaaatccttgccgaagccaatgtctagaaggggttttccaatgttatcttctagattttatagagtttcaggtcctagatttaagtccttaatccatcttgaattgatttttgtataaggtgagagataaggatccaatttcattctcctaaatgtggcttgccaattatcccagcaccatttgttgaatagggtgtcctttccccactttatgtttttgtttgctttgtcaaagatcagttagctgtaagtatctgggtttatttctagattctgtattctgtcccattggtctatgtgcctattttataccggtaccatgctgtcttggtgactatggccttatagtatagtttgaaatcaggtaatgtgatgcctccagatttgttctttttgcttagtcttgcttgggctatgtgggctcttttctggttccatatgaattttatcattgttttttctaattctgtgaagaatgatggtggtattttgatggaaattgcattgaatttatagattgcttttagcagtatggttgttttcacaatattgattctacccatccatgagcatggaatatgttttcatttgtgtgtatcatctatgatttctttcagcagtattttgtagttttccttgtagaggtctttcacctcctcggttaggtatattcataactatgtttttgcagctattgtaaaaggggttgtgttcttgatttgattttcagcttggtcgctgttggtatacagaagagctactgatttgtggacattagttttgtatctggaaactttgctgaattcttttatcagttctaggaactttctggagaagtctttagggttctcaaggtaaacaatcataccatcagcaaacagtgacagtttgacttcctctttaatgatttggatgttctttatttctttctcttgtctgatcgctctggctaggacttccagtactatgttgaagaggagtggtgagagtgggcatccttgtcttgttccagttctaagagggaatgctttcaacttttccccattcagtattatgttggctctgggtttgtcatacatgacttttattaaattgaagtatgtcctgtatgtgccagttttgttgagagttttaatcataaagaggtgctggatttgtcaaatgcttttactgcatctattgagatgatcatgtgattttggtttttaattctgtttatgtggtgtatcacatttattgacttgtatatgttaaactatccctgcatccctggtatgaaacccatttgatcatggtggattatctttttgatatgttgttagattcggttagctagtattttgttgatgatcttagcatctatgtgcatcagggatgtgggtctgtagttttcttttttggttatgtcctttcctgatttgggtattagggtgatactggcttcatagaatgatgtagggaggattccctctttatcttatgaaatagtgtcaacaggattggtaccaattatttgagtgtcgggtagaaatctgctgtgaatccatctggtcctggacttttttgttggtaatttttacattattatttcaatatcactgcttgttattggtctgtttagggtagctaattcttcctgctttaagctaggagggttgtatctttgcaggaatgtatccatctcttctaggttttctactttatgcacgtaaaggtgtttatagtaaccttgaaagatctttcgtatttctgtggtgtcagttttaatatctcccatttcatttcttattgagcttatttggattctctctcttctcttcttggttaatcttgctaatggtctatcaatttgatttatcttttcaaataaccagctttttgtttcatttatcttttgtaattttttgtttcaaattcatttagttctgctctgatttttgttatttcctttcttctgctaagtttgggtttggtttgttcttgtttctctagttccttgaggtgtgacgttagattgtcagtttgtgctcttaccatctttttgatgtaggcctttaggactatgaactttcctattaccactgcctttgctgtatcccagaggttttgataggttgtgtcactactgtcgttcaattcaaagatttttttaacttctgtcttgatttcatttttgacccagtggtcactcaggaccaggttattcaatttccatgtatttgcatggttttgaaggttccttttggagttgacttccagttttattccactgtggtctgaaagagtgcttgatataatttcaattttcttaaatttattgaggcttgtttgtggcctatgatatggtctatcttggagaaagttccatgcactgttgaatagaatgtgtattctgcagttgttggatggaatgttctgtatatatctgttaagtccatttgttccaaggtatagtttaaatccattatttctttgttgactttctttcttgatgacctgtctagtgctgtcagtggagtattgaagtctcccactattactgtgttactatatatctcatttcttagggctattagtaattgttttataaatttgcaagctctagtgttaagtccatatatgtttaggactgtgatatttttctgttggacaaggccttttaccattatataatgtccctctttgtcttttttaactgctgttgctttaaagtttgttttgtctgatacaagaatagctttaaatgtgttttgtctgatacaagaatagcttgcttttggtgtccatttgcatgaaatgcctttttccacccctttcctttaagtttaatggtacttatgtgttagatgagtgtcttaaaggcagcagatagttggttggtgaattcttatccatgctgcagttctgtatcttttaagtggagcatttaggccacttacattcaatgttagtattgaaatgtgaggtaccattccattcatcatgctatttgttgcctgtgtaccttggttttttgtttggttttttaaattgtatttttgttttataggtcctgtgagatttatgctttaaagaggttctgttttgatgtgtttccaggatttgtttcaagatttagagctccttttagcagttcttgtagtggtggctagtagtggtggattctctcagcatttgtttttctgaaaaagacgatctttccttcatatatgaagcttagtttcactggatacaaaattcttggctgataattgttttgtttgaagaagctgaagattgggccccaatcccttctagcttgtaggatttctgcttagaaatctgctgttaatctaataggttttcctttataggttacctggtgcttttgtctcacagtttttaagatactttccttcattttaataatcttcatttagataacctgatgacaatgtgcctaggcaatgatctttttgtgatgaatttccagggtgttctttgtgcttcttgtatttgtatgtctagttttctagcaaggctggggaagttttcctcaattattcccccaaatatgtttcccaaatgtttagatttatcttctccctcaggaatgctaattatttttaggtttggtcatttaacataatcccagacttcttggaggctttgcttatattttcttattctattatctttgtctttgttggattgggttaattcaaacgccttatcttcaagctctgaatttctttattctacttgttcaattctattgctgagactttccagggcattttgcatttctataagtgcatccgatgcttccggaagttttgattttttttatttatgctatttatttcattgaatatttctcccttcacttctcatatcatttgttggatttcctttcactgggcttcacctgtctctagtgcctgcctgattagcttaataaataacctcctgaattcttttacaggtaaatcagggattcttcttggttcgggtccgttgctggtgagctagtgtgattttgcgggggcatgttaaagagccttgttttgtcatattaccagtgttggttttctggttccttctcatttgggtaggctctgtcagagggaaggtctagggctgaaggttgttgttctgattattttgtcccgtggggtgttcccttgatgtagtactctcccccttttccagtggatgtggcttcctgagagccaagctgtagtgattgttatctctcttctgggtctagtcacctcactcctggctggtactgggggttgtcggcacaggttccaggctagtactgtgggttgtctgcatggagttctatgatgtgaaccatctatgggactctcaactatggataccagcacctgttccagtagaggtgtcaggggggtgaaatggactctatgctcgttcttaactttggtggtttaatgctctatctttatgctgcttggcctcctgccaggaggtggcactttccagagagcatcatctgtggcagtatggagaggaaccagtggtggacagggccgtagaactcccaaaagtatataccctttgtgttcagttacctgggtgggtagggaaagaccatcaggtgggggcagggctaagcatgtctgagttcagactctccttgggcaggtcttactgtggctgctgtgggggatgggggtgaggtttccaggttaatagagttatgtaggtaggaggattatggctgccactgctgagtcatgcagattgtcagggaagtgggggaaagcctgctgtcacagtcctcacccagcttccacacaatctgaagggccggtctcaatcccaccatgcccctgctagcagcactgagtctgtttccaggcagcgggcaagcagggctgagaacttgccccaggctacctgcctcctagccgcaaaagaaagtaggacattagttcttcccctgcctgtggagtctgcacgctggatttgcaccctcccctgagttctgatcaggaggcttcttgaccagttcaaattgttacaaacttcagctggagatttccttttccctgtggtgctttccctctgcctctggcctccttcctgaagggtccccatggtgccaggcagtgatggcctgcttggggacccagcaagctcccagggcctttcccgctgcttcctctaaccctgtatttcacttggctgtctaaattgactcagcttcaggtaaggtcagaatcttcacctgcaaactaggcctttagtttccccagtggggatgtgtgttcaggggcggaggatctccctttcccacttccacatttgggcacacacggtatttggggtgtcttccaggtcctgcaggagcaatccacttccttcagagggtctgtgggtcctttcgagtttcctgatttattcctgcagttgttctggggcaaaaattcaagatataagcctccacacactgcttcatccatcagagttggggctgcagtctagttctgcctctcatttgccatgatggattattttctttctgaagttttctgattatgttatttatttactagttggggtcatgtttttcttaaagattataagaatcttgtagtcaatgactgtcacattggtgaccgtgctttttttccatctagattatatggtgccttttagattttagtgtattcctttgaatcacgtaagaatttcaaatgtttattactttaactgtgttatcttgtgcatgcttataaaagtctacccccggagaggagggagaggatcagaaaaaatactgttggatactaggcttagtacttgggtgatgaaataatcagtaaaacaaacccccatgacacaagtttacctatataacaaatctgcacatgtacccctgaacctaaggtaaaaattcaaataaataaataataaaagtccatcttcaaattgattttctataactaatcatttatatttttatttagactgtttggaggtttattatttacaactagctccaatatatatggaatgtatttttggttaatgctgtgatacaaagacttcacattattttctctttataaatagccacttgtcctacaatttattaatccttcctttctctactatgaaaattgtggctatttatcttactataagtaaaaggagcttggtgtttatttcctcctaggctatctccttttcttccttgacattcctatcaatcatatgacatgacagaccatcttaactattataccttatatttttattaaaaataagctttcaacacagtttatgacaagtcagtataaatgattttactttacttggagaagagattctgaccaatcttcatcggcaaaataggttagctgaggtttctaagcaatcccactaaagactttttataaaagtgagtttgggtacttttttttaatgagaaggaggtcacttaaaagatgtaatgttccaaatccacatcattaagagaataaaaacttagtggtgcctttttctgttaattatttctaaccactatcatgctgtgacatcagtggagatacaggcttttcttttcttaagaaattagcacatacaatgaaccatgacaataattatcataacccttgaaattttaatatataggaacattgccacagtgttatttttagacagatctcctaaattgctttctactagtctttcaatgacatataccttgaaaatttggaacatttaaaaagagctcaaatacacagaaatagaaaatgaaagagtggttaccataggtggagagagggagaacatggggagatgtacaccaaaggatacaaaaagcagatatgtaggatgaacaagtctagagatccaatgtacaacatgagaactaaaggtaataaaattgcgttgtgtttggaatttttgttaaacaaatagatttagctgctcttgtcacaaaaaaagtaattatgcgagataatagatatgttaatcttcttcactatagtaactcttttgctatctatatgtatcctataacatcattttgtaaaactcaaatataaacaataaaatttgtaatttgtaattttgatctttattttccccagacatttaaaaatatgtcaaagaatatacttcatccacaggcagatttttcatatccatttaactatgtctccagagagcacttattaacagaagctaaacatatggaccttctaaaattaagaaaacctttttggaacttgaaaagacttttgaatagggctagaagcaacaagccatagtgaattattcaacaccaggatatcaaagaaatggaggaagtaatttcgtgctgtagaagcaaagttctgtaaattgatatgtgatgatattcaggatagtttaatttggtagcctggaagagaatcaaatgaattgaagaaattcttataaatatttctttcttcttttttaaaattaaagatatctgctaatttgaatatgccacctgtgctttactccaatgttcaaatttctttttataaattgcaaaaaatgcatctaattttacaaatattcctcactctctacaattaaaaatatatgcatataatttaatattcttatgaaatcaaatatctaaaatagaaaaatcctaacacagaccttactttatgatcatctttgtgatattctaaatcctcagttattttaaaattgaaacaacggggaagttttcaaataaaagatcttatttcacttgaaagaaaaatgtaggtgtaaggggaaaagttataggtaataagatttaatggctgtgagaaatagacaaaaactgatagtgttctctagagaaaatagctttggggcagacagaagagagatgaggtgtgatactgagtgaagttttaaaaataaagaaaacagaagcagtaatagcagagaaagaacaagaattaaagagaaaatttaatcagaggataacgtgtgaagagtccccaaactattttcttgatcaatatgacgggaaattaagcgttaaatttttccaaagtgagaataatgatctttgaccaacattagcttgtttccatggttagaggctaggataaggtaatgtttgtagtggtttaggtggggagacagcctgcattgaggctctggtccagagctggggcctcaagaaccatgaagagagctaagcagttcaagaggatgttttctagaactcttgaaacctaatggaaacccaaagactggaagcaacaatgttcaaagataagaccctcactcatcatgtgcctatttggaggtttcttagcttcctaatatagaagacagaattcaaagcagatacctaaaggaatatctgggagatttctaaattaatagactgactgtatctaaggcagaaaataaaatgtttcaaactgttaatcacaggcaattttacattaagtgagattaaagattttggacatcctcccagccaaaatttagacatcaacccacttttactggataaaacaaaatgtgataatcagtgagaacagttccaggttgttccttgctcttgaatgtgactgactttctttaatgtggagttatatatccattgataaaatgaagtcatccctttatcaaaatatatgcatccctttatcaaatgcaactcagttattttttttacttgaattgcacggttacaaacacattactaccaccagtttgtgaatacacctaaattgcaggaatactatttaaccataatgataatctgattattatttataatattaagttctgggattcattatgattttatttctcacaaatttccaaggaaattccaaattgctaagtttagagctggacaggacctttaagttgaattcttttaaccttctcatcttatagttgaggaaataaaatgatacagtttacatttgttcagtgttaacacagtgaggggtagaaaaggaaacatttgccagtgcatataatgcttatattgaatattataagaattgcattttttctactgctgcctatggaccattctcttacctatcattcttcacccgattagccattagtgtgtacacattcataaacctaaaccttttcaattatagtaactcttatagaatggaaaggtaggggggtgtgtgtgtgtgtgtgtgtgtgtgtgtgtgtgtgtgtgtgtggctgataaattattgacttctgtgtactattctttacccatactttatcacttcttacctggacctccttctcttctaactcaaatacccttgcactctaaattttgttgctgtgtctctggataactacataaagaagaaaccgaaagaggataaaagtgaacataggtatcaatttatatataaagagggaagcatgaatctgacttggtactcactctatgagcagcacggaaacaggtatagggatttatcagcttcatatcagctgaccaccacaagaacccataaatggaagatacatgttgttttagacacttgcaagggaggataagtgaaagagaggcctgagcaaagaagctcacacacagggcctgtgcctatgactccagatgaagcccaggtcaggctgtgaacagctctgttagctatactaaccaagaagtttttaactgtatcccaagggcaatggaaagccgatgaaggctttacagcaagaaaatgacaagacgagatttatgttttggaagaatcctcctggcttaaatgtacggaatggagaaagagtggtgcaaaggacagaatgtttatgacacccaaccccaaatttatgttgaaatcctaactcccaatgtgatggtattaagagattgggcctttggaaggtaattaagccattagggtggagccctgatgaatgttattaatgtccttatgaaaagaggccagagagctagctagcctctctttccgccatgtgaggttacaataagaagttggtagtctgcaacccggaagggggcctcaccagaaccccaccattctgacaccctgatcttagattttcatcctctagaactgtgagaagtaaatttccatcatttgcaagccaccagtttatggtggtttgttaagtagcccaaactgacttaagacaagtgggaaggggctgagtagtaagaccaatgcctagaatagtgcttggcaaataggagatgacaaatgaataactgttgagtatgtatgacagcagaaaatccaattatgatgctgttgagaaatccaggcaggagaaggcatcactggggccagcatggtagctgtcagtgagtgtgcattaggattaagtgtttaatgcaagtgtgcagaactaagaacatcctatgtttttatggtgtgtccaaatccggagtaaagacaaagttttttattttgtttgccaagatagcattttccttttagcagtttttcttctttaaagatattgtactctttcaccactaaagttgcattacctctgaactggcagttttgctgatggcttctgtggtctggaggcttgcccatttattttctgatttcccctttggcagtgcacatttctgctctcattcttcactgcaagcttcaaatatataagcgttctagttactaacaaccaagagacaaagagattgggggataaaagtacaagagcaagcagattcatacctgatgagttattggagtgtttcccttaatcaatgccattgtcatcccaaatgttggcagatcaagcttggataggatccagtatactcactgtcactgaaaatagttaattacttggagggcattatgtgtggtggtagcacagggctatgtacatataggtaaatcaaaaaaaaacttaatgggcatattaattcataactttttcgtagtaagcatcgatggattagatctgtttactgaatttatagatacttccactagagaataaagcttttcaccttcttgttaatccagggtcctccttgcttagtgtcagagctgtttgtgatttaccagcactgacaactactgttttcctttttggttcatttatcagagaggtttctagccttgtgtaatgcaaaatgctcaggctttgttaccatactaatttgggtttaaattcaagtcatgggatattttagcttggtgaccatgggcaaattgtcaaatttttctgaatctggcattctcctagtataataatcacaatcccaaagaagtgcttgatgagtttcatttgattatttattttcttttaagtctagcacaatgttagacacataaaaggaatgaatcttcatgaccgttgtatcaaataaaaaagttctccaatgctatctttgttgtatttaaaaacattagataggcagaaatatttttaaatagatgctcagagataatcacaatggtgttatttgaattctatattattacttggaagactttattaacttcctttaaaaggacatggggacctttcagagagtggaaggtgggagatgggagaggatcaggagaaataattaatgggtactagtcttaatacttgggttatgaaataatctgtacaacaatcccccatgacacaaatttacctatgtaacaaacctgcacatgtacccctgaacttaaaatgaaagtttttttaatggtgcatacttctgcattctcatttatgatatatacattaagcctaatttaatttagataaaaataataactcaaaatatttgggataatagcttgaaattttaggtgtatctttccaatttctattttttcaccacaagtagatttcagtaagattttaatcaatggcagtgttgatgctaaacaagactagggaactctcaagttagcccttgtgataaaattacagaaattcagacctaaaatacatcttcaaggccactagatcatcatgagagtttacggtagtaagtggcaccatgtcaacgtaactactccctagagcagtggttcccatttgtattctgaggaccaatgggagactttgagttgtggcatggggtgtgtgagtcctgggtccactcttaactgtagaaaatcagtattatgtatcctacatatgtatgcagctgcttttcaaaagtatacagacactattgtgattagaaaaatacaaattcattccaaggcattaccacatttcagtagtgttttgttatgggttttcttaaccaacagttgtgtaaagtctatctgttctcatgtgaaatctgtagacattttaaacagtgtaggggaaggaaatatcttctcttcccatcttagagtcacggctgaggcccctgtaagaaaagacagattaacaaggaaagcttacagattcgtttaatgtaagttttcatgacatgagagccttcataaagaaatgaaacaggtaaagttgtgtatttttatgcttaggtttgataaagagtggacagtcctgagaaatatgattggaggacaaaagggaatgacctaatggtaacaaactgggggaacttaacaaggcgtgtttgttcagattcttctctgggtctgtgtgtcatcaaagataaggatgttcctttcctccaggtgtagggagggcacctctggaatgaggaacttaggatctgcttcaggggatatgagggagggaaaggtaagagtaaccttgctgcttaggctgttttgtcaaataccaaggtgacatgctttggggtagaatgtcctgaacccccaccaatggagtccttgtatttgaaggtcagaggcttggatttattcatatgggcataacaactttgaataaagaaaccatggcatatgcagatagcatctggagcgcttactcagtttaagctggggaagaaagtaatgaggaacttgataaaagagaataacagtactagagaaaagctatgaaggatacatgggcttattttcttggtgaaggaagatgatttttagcctgccaatgttttaatttattaaactaccagaagggagtactttagggaagaaataacaaagctcaacaaagggctatctttcacaagcaggccaccctgtgaactcaacctcttcagtgccaataaggaggactggtctcatgcttcaagattccaccttccccctgacacatctagcatgccgtagagttctctcttgcccattttagatgtgaaaatataaatttaaatttaaatttataacaaggaacaaattaaacaggaaaactcccattgctatgacaaaagaagcatcgagccctcaaagagctaaagagtagatcttggtttctttgctaaggagcttgtcttataaggctaagttgatgggggctttctagccactggtggccatggaattgccattggctggatccttacattcgggtctcaagccagggggctcgggcagtaatgtattatacctggggtggaggtgggagcctttggaagaatgcaggcccagcaagtctcctactcaaaggaaacatgcaaaacccagaccaaataaacacttctggctgtctggctctcttcacctctcagtagagaaggttgccttttctatggccctgcactttcaaaaaagatatagagagaaagttacaataataatacaagaaccagaacatagaactgttaatttaaaaaaagataaacagattgaagttatttagtcaagagaagagatgccaaaaggaacatcttaataatggctttttagcaaaaagtaaaaaataaaaataaaaaatgctgcagtgaaaatgcagatctatttttttccactgaggcaaaataagaaatagccagagttggcaacaagatatatttagattaggcatgaggaaagacttctcagttataagggatgtctattctaattataaagggtatatagcttgactgcttatacagtctggcttcaaggatattttgcctcttatttttaaaagcttaaataactattgattcttttctcccaaataaaaaggttcatgctttttgttcttttaaaaaaaaaatcacaacaaagaatccaacaaaattgatcaaatggcttccatagtgagtaattttcctgagtttttcccaaataaatattccttaaatctcccagaaaatagcagattccatcttaaatatttaaattttagaaaatgttatttttaatgagaaatgtatttgtctatgctaagaacttaaagatttaaagcatagcagactttttcctgtgtcatgtgtgcctcacctgtacacataatcacacacaatcacgcacacacacacaggcacactgactaaactttaagtactgtcaaaaaaaaaatttccaaccaatagaaaatgacaagtgcatttattgtatgtctgttttcacatccagtcttgcttgtatagttatttatgtaagatcttgtacttgaatattaacacataaaaataaatctggcttgaaatgttaagattcatgagggacatagatgctactaaaaatcataatcagtaccaaaattctcacctaaactagaatttctagtgcaagcagagcctcacacatgaatttgctaattgaattcttccctagactgtggatattaggcagctttggtttttatctctgatagataatcttggggaattgagatattactatagaagtggtcttttggagaaaattcatttttaatggtaaattattaaaaacggagctcttttataccacagtgacagtgtggaaacattggtagtttctatggtagcaatttctcattttatgtctttttcccagccactttattatttatacaggtttagtaataggtattaattcctaatacaaagtaaaaacaattcaggtttcacaccaagcattacatggtcataacccagtaactaccagatattgtgcctgcctttaaatatttacgatttagttgatattagctcatgctctctaagacttttcaggagaataaaccaaaagaaaatctaagcaagccggaggggaataaaaaataggaactgtgccgatgatagagagaggcagattactatgagatgacaactcacttcactcccccttacaaacagttgtgcaagtaccactgcttcctaagcactatcggagaagaaaagcatgtttgtattcagcctgattattccatccgcagatcttagcagtaaaaccttctcaagtctgaaagggagaacatttttcctattgtcagttccacgggggtagaattgaattcttccctttcatatctcattgttaagtaaattcaaaaagttttcctatataactacagtcttctgcaatattttatttaataattgattttatatacccccccaaaaaaagtttacttgctgggccatttctgcctctggcaatgatgtttccaaatgaggaatgatgcctctaagatggagcctcaagtgttggaagtttcaacttctgcagtcacttacagggcagatttgaagggggatgggtagaccctgtactgaaatacccacctagagagatgtctaatatttccacatgaatgctcattttcttgtcctcttcctgtatcatgaacatattccctggccatggaggaataaggcatcagcgttcttacacatccacaggaatgagttctatgtcccagaagagaggccagggaactggagaggagcccagggtgctgaagggagatctgatgcagggaggagttagggagcagacagtcctcaaaatttcctctgctgctgcttatcttctatggtgtgtggtagaaataaattagattgaataaatcttgagaaagcattaagccagaaaaaaataccaatacttatttcacccttactttcccttttctgttgtaaatttgaaatatttttaaaagtgtgaatgtaataacactgtaagacatgaaaaagctttttgttaaactgagaccatcaaaaacctacagagaacttaatctggaacagattctgggggatttaggagcccccccaccatttttttatttttatttttattttattttattttattttattttattttttgagatggagtcttgctctgtcacacaggctggagtgcagtggcatgatctcggctcactgcaacctccacctcccaggttcaagcgattctcctgcctcagcctcctgagtagttgggactacaggcacatgccaccacacccagctgatttttgtatttttagtagagactgggtttcaccatgttggccaggatggtctcgatttcttggcctcgtgatccgcctgcctcagcctcccaaagtgctgagattacaggcatgagtcaccatgcgcggccaggagctcccttttcataatgtgttttgccctgggaaggaaggacatgcccaagaagcctgccgcccactccctcccactccacccttcaagttactataccctggatcaggatttctcaacatcagcactattgacatttgggccaggtgtttcttttctaggggggctgtcctgtgtcttgtaggatgtttagcagcatccttactgtctgcccactagacgcaatagcaccccgcaccccttagttgtaacaaccaaaaatgtctccagatattgccaaatattcctgggaaaggtgtgagggccagggggaacagactgtatgcagctgagaatgattgatctagatgaaactttccaaactgagtttcctgtgtcactatgccccataaaaacgtggcctcttgggaactggtgcatgcactcctctctcttaaagattcctgctgcacagtagcatattaggatctctcaaagtccagcttgtctttgtttaaactcatgccaaatttatttaagtatgggacccctgtttttcactaatgtcaatcagtactttgtggaactctttgtctttgaaacactctggattgccttggactgatagagcctagtataatggacaatttggtttatattaattgttcatgtgctcaaaagtctctgaacatgagagttatcatttttgtgaacgtgtctcaagatcatgagagagaggtctttatatgaggaaaggcacattttattcctccaggaccttgaaaatttggggaaaagtcagagtgatagagaaaaggacagaggtgacagaaaagttcctaattagaacttcaaaggaaattgagggctggctggccctaccttcctttcccctccagaaaatcaagccaaaccaatcaatacaatgagagggagataaatggcaatacctggcctagagagccaccaaataaaattttcgggtcctatctactaattgggggcccctatgctgtatatacttctatgatactataatatgttagggtgaaagaactaaaatcatgcaaacaagctgaagtaaacaagcagcaattattgaaaaggaaagttgcatgaagtccagatttacaaagactagagctagaaagagaaaatttcaggagctgaagtgttgccttctcttctcccctcttgccttgtcttctctcgtcttcttttctctctttttgttctcctttctctccctccccttccctgccatcttcctgatggtttcagttctcataatttcagttagcacatgactttgtgactttgttgtgatctagggctgactttggccctgattctagatggctttttcccaaaatgacttgatcgttcatggccaaccaatggacgaggtggccttgcatcaaggtgtttgcctctggtccagtcatctgaagccaaggaaagatggggcaggcaaaaaataaatcagagggtcacctagactactcattcagcagtctgtaaggacaaaggcagctcttaaagaactcatgggagagacagaaacctcaaaacatagctattgccacctatgctgtgtatagtttaagcagtagtagtcacataaacaaaaacaataataatagcattattgagtggttgagtgctaacaacaaatatgtcaggtacttttctaaatgttttttggtaatacactcatcttattctcaaaacaagtctatgggttagatatagttatatgttgtatttttcagatgaggaaacagaggactgaagttcagttcccaaaatcaagcagttgatagatggtgtagccaggattcaaacctacacatctggctcacagtctatgctcttagttaatctgctgagctccctttctgaaaaaaaaattaatcataataattagaatgtaaaaaatataacttcaggaaagtagatgcctagattttggcaaactgttctgggtgggcttgcatttcagaagtatcaaccaatgttgaaggaagcctgcctttggttatagaccaatcatgtcatttgtctctgacgttccatgcccaagatggatgtattcttcaagagctcactagtaatttactccacttagagtttgtctgtttgtctgttgcttggagccaagagcctaagcccagcagttgtccactacaatccagagctggggcctggctgctcaccaaaagtgtcttgcagcggcactgcctctacctccattatataagatagtggggccaggcacagtggctcaagcctgaaattccagcactttaggaggccgaggtgggtggatcacctgaggtcgggagtttgagaccagcctggccagcatggtgaaaccccatctctactaaaaatacaaaaactagccaagcaggtgcctctgattctagctactcaggaggctgaggcaggggattcacttgaacccgggaggcagaggttgcagtgagccaagatcaccactgcactccagcctggacaacagagcaggacactatatcaaaaaaaggggggagggggattctgcctgtctcctcacttccagtcagtctgtccatctgtgttataagatgtacctctcttctttattggtaaaccaaaagaatggtttgatccctttaaaaatagtagagtattctgagccagagtgttggaatacgcatctaagataatccgtgaccctacgcagatcatttatactccccatagcttgctctattattaataggtggccattaaagcctctttctgaagacttctgccactcaggtgttatttcagaatcaggaaactcaaacctttaacatttttctgacatttatttgagtgaagaaaaagcctgacaatctctttttctatgttctacatttttgctcagaataatattaatagtctgtcttttagaaatatttttcttactaaataccagccaatactttttatatgtgtattttgtctgattttctaagtgcagtggttttgccacacactaaaatgtggatggatcaaccatcttctttaactagggagtcaaggggttctgcttgctaccacagcacctatctggcttcaatagatgtaatcttaggctgtacatttgagttgcgttcaattgggaacaaaaattaccttaaatgttcttccttatctatttaattaaactcaattcaacagacatttattggaccacctgaaacatgaaaaaacactatgatattaaccttagtaaactcaaagaatagtgaaacaaagccctgccagaaaggggcttattgtctagttgggctgaagggatagaggaggagacagactaaaataagagttagagtaagcagccccaagttccatattaagattgatctcataacatggggaataatatacatgttataaaatcagcatagccatgctgcttgagttgaaaggaaacagcagtaagattcaattagaaataaataggaaatgcttcattagaggccactgtgcaggaaatatagttaggagaaccagatgttcaaaatatatgaagaaagacacagaaataagaatacacatggcaagtttagaaaataatgtgaaggttgattgggctcaacagcatgtttggcgtgagtagaagatgagcaagaaatagttgaccaggggcatttctggaaagcccaaggatgtagtgagtggcaaagagcaagatagtggtgtactggggagttttggggagtagacaggagtatcagggtttgaattctggagctgctacttactagttgtatgacgttgcttgcatgagagattctctttgagcttcagtttcctcctcagtaaaattgggaagggaaaataagagaatctacttcaccaggttattgcaataattgcctcagctaaaccattttaagttctttgtagacactcagtaagtatttattaataagtactcataataagtactctaaatttgttgactaatctttgtcctagagtcttgaagtggacatttttgacagaaaatttcccagtggaccaaaacaaagctgggtgtcagtaattcataactcactgaatcactgaacctaaacccaacttggctttatgatctgaatatattaactttgtcagttaaggatgtaaagaaaaatttaagacatgtggctccctcaacttgaaattcttgatacagttaatgaatgttcctccaaaaaaggttgtgggtgggagagaacagagccaagaaaatccatttacttacagcttttggtggtatgtaactagcaattcactcaaacgatatcagaggtactatccccagttctgtaagaccaacttcgtatttgtggacatattttatgtataaacatcctaaggactctaaacatataccaaacactcagttaatcctcatggattattcaatagataagaatattattttactgtctgtgctttagctatctgttatataatgctctactttttatgcagtctttgttatttaattttatttttcaattgagaaataatattgtatatacttacagtttacaacatgatttttaatatatgtatacactttgaaatgactaaatcaagataattaacatatcctttacctcatattgtttttttgtagcaagaacatttaaaatctgctctcagtaattttcaagtaggcagtacattgtttttaatcatagttaccattacccacaatagatctcctgagtttattcctcctgtctaactgaaatgttgtatgctctgaccaacatctccccatatccctctcaccagtccctagtaaccacaattctactctctgcttctatgttctcaaatttttcaaattccatgtaaaagtgagatcatgcggtatttgctttctatgcctggtttatttcacttaacatagtgtcctccagtttcatccatgttttggcaaatgactagatttccttcttttttaaggcttaataatatttcattgggtatataggacacctttctttctttctttttctttttctttttttttttttttttttgagatggaatctcactctgtcacccaggctggagtgcagtgtctcaatcttggctcactgcaacctcagcctcctgggttgaagtgattctcctgcctcaaccccccaagtagctgggattacaggcacccaccaccactcctggctaatttttgtatttttagtagagacggggttccaccatgttggccaagctggtctcaaactcctgacctcaagcaatccacctgcctctgcctcccaaagtgctgggattacagatgtgagccaccgcgcccagccaggacacatttctttatccatttacctgttgatggacacttaggttgattctgtatcttgatgattgtgaataatgcttcagtaaacttgagagtgcagatatctcttccacatactgatttcatttcctttagaaatagaagtagaattgctagatcatgcgataattctaggtttatttttttgaggagccacagaatattctgttttccataatggctgtaataacattcccaccaatagtgtacatgggctcccttttctccacatcctcaccagtactaattatcttttgtctttttggtaatagccatcttaacaggtgtgaggtgatgtctcattacagttttaattttcatttccctgatgattagtgatgctaagcctttctttatatacctgccagtcatttgtgtgtcttcttttgagaaatttttttaatcctttgcccatttgttgcagtttttaaaatttcaacttaaattttagatacagagggtacatatgcaggtttgttacatgggtatattgcacacaggtaatgagtatagtacccaataggtagtttttcaacccaaatttgcctttctccctgccctagtagtctgcagtgtctactgttcccaagtttatgttcatgtgtgctcagtgtttagctcccacttataagtgagaacacacagtatttggttttttgttcctgcattagttcacttaggattattcttttgcccacttttatttgttttattgctagtgggtcatttgagttatacaatatttaaataaaagagaaccataaacagtttttgtcttaggggataattttttaacacaatggtttccttttcaggtcaagatgagctcagaaaaaaaggtattgaaataattcaatcatagtttactaaatgagaacattttgctaatactttatgggttacatgaataacattcaacttgggagatttttatagtattgttcattttgatttctttttctaaagaatattaatgtcaaaacaagttttcttatagttcatcttctaatcattacacaccataacatgctcacttgagatctacccatcatttttataacaatttccaatgcagctgagatgtgaactcatgacagatttttttagttttttgagattgaagaacagatttcaaaataacacactgaactaatcacaggaaactaggaagcagaaatagcaatttttctgaacagaaattaatattggaactatcaagtcagtaattttatttgaaagtgaaaactagggtcaccaaaatcccacttagaggtcgtcacctcacactgaagactaagataaaagcgcctcttaagtgggtcgccatccgcatcctagttgtgggcactctgtccttccagaccccacagcctattgtcatcaacagcacatctctggcactgtgattagctcaatgtgctatttttaaatctactattcatgctcagagctctcacgcaggtggaagacccttgccttcccttcccagagctatgcagtattcttctctctcaccctccttccactcgcataccacacacacaccttcaacacttcgacctcccttatggggtgagcaactgctgtcttggtttgcctacaactgaaggatatcttgggatatggaatttttggtactaaacccaggacattgggtcacatacgtgaggagtgatgagggtgagatagtgagggacctctggctgttcctcatcttattccttttttttccttttgttccctaaaaaaattattcatataaacaaggaagagaggatccttttactgttcaattagttcttctcaaaaatttatcattttagggcatggttttcttaatctattaaccattttctgaaaaacatcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctaaataagtatacccaacattctggataagaatgttctcatgtagcatcctgtaaatcagtgagaaggaaacagaggcaagataatatatatggagccttggaaatctagatgagcttacagatggatctcttcaatccaaatctgtcaactcagtaaagatgtttataaaaatcagtcaaaacagctgccaggcatctgaatcacttaattaaatgctttatatctcaactagtttttgcatcttgtaataatgtccctaagaagccaacatcatcagaatagatccacaaatattcatttatgcattcaaatatttcttaattgagtatccagtatgtgccacttgctcttctagacatgttctaagaaatatggcctcagttcctgggcttaaggagtatataatacactggggatacaaaacagaaaacaataacccattaaatacataaccagagctcataaaggctttgggagaaaataaatatgttcaacagcagggttaaaaaacaaagtgggcttgttgaaatctaaaggttggcaggcaccatccaggcaggagtgaaggattgttctgggtagaaagaacaacttgtgtgagggaggagcttgcttagtagttctaggaatctgagggagatgcaatgggaaccttgtgggcaaagggcagctgctgctgaaggtgacagtcattaattgtagagaattttgtaagccaagacaaaggctttgcattttatatgaaaggtaatgagaagctacagaagagttttacacttaggaacttagatatgcagtccatttaatgttgcataaagattactctatctacctttgtgaaaacgacataagaatgagagaaaaatagcagagagccagaagaggctgcatctgagcatcaggtggatccagaattgttctcctcaactgtcaagaggtgggggattgagagctgaggctgagtgtctgcttgcttacccctttgccttcaggggtccaccctcattcatcccaggaactaccagagatggtgataaactgctctgcccccactgaattttattggtttgggacacaaaactgactttaaaaggttaattagtattactgctgcaaggaatcagctcatgaaaagttatactgcattaaaaactagcaggcttacattatttatggaaaacagctgttgaaaattgtctgctaaagcttcatttcttcccatttcccttctctctatctggcactttattataatttctagaagttggtgtactttttaactatgatcattatttctgatcatacagttggtgatgtaaacagtggtacctaatgactccctaagcctcaaattatattaaaagacaatgagcaatatctaagggctaccaacaacactaatattccttagaatttttcatttaattatttgaagagaaaaacttgtaattgtgaaggtttgaaatcctctttatataatatttctaagggaaagataagagttgtagtttgctgaaaatctgttcaattagttcttctcaaaaatttatcattttagggcatggttttcttaatctattaaccattttctgaaaaacgtcctaagatttataaatcataaaaatgtttatgtttatttgataatatgtagcagaaatagatggacctactgttgaaaattctctctcagtaaaacattagcacctcttaataaagggaataattgagtgatttttttctcagaaaggtgtctcagataagagttgtagttgctaagaacaatgatgtgctccaacaagtttctcattaccatggtgacttctcttcttttaagttcaacaaatcatcctttatacttgatagatgtttagacagagtcaacacttagaggctgcatctaaaaaataaaaatgcctcacaaaacattgacacaaggaattaaattttataaaactggctaactttgggcccactggggcatgagggggaggatttataggtgtttcagtagtacttagtgattctttattagccatgtggaaatgctaaaagttttacaacccgaattctgtagttttaatttgtggcaaatatccttggactaagtcccactgagattctcaaatatttcaactatgacaagcttcaaatttttttcagaaaatatgacttgttcatatctcactttggaaaactgtttgatttgtttatactacaaatcggagaagcaagtcatctcttattttgtgatgaattgtttttgtcatgtgttctcctatgacttagagatcctagagatttctacaaacaacagcttttagcctaatctaggtgacaatgagacaaacacaataagaattttaaataaattcagtgtctcacaacagaatcacatcaatctagagaaatgagaaaatgggtcaagtagataagaaaatctaacttcctactgttggaaaataaactatttaaagatcatgatataagtaatatgaataccagctcaaccatactctgtatttttctttaacattacatactttattgcttccattaattgaattttctacgattctattgaatttaccagtctatattgttttaattaagcatattggtataaatttgcagtcatttataggtgaccaatacaaatttttttttcacttgttttcgcaaaagatagataattctggactcacagatctctagacactgttcctggtcataacaggtattcaagaaacattggttcccattcctatacctaacaccttctgcacattacaggaagaaaaacatgtgatccttgaaaaacttagtctggagaataaatacatgaaaaggagggaaaatagaaaaattacatgctaagaaatgtgtactgcttgagaactctttaagcaacaaaagtgttgtctctattaaaagcagacaggtgaggttacctgagaagaaacccgtgttttcatgttcatctctttaacatggggcaggtccttaggtacaaaacagatctgaacttcttgctttctgttactcttaatttaactggctaaatcagtaatatgactttgcttttagacagttatactagacagatattttattgagtactctttgaatttagaaaaacaagggtactaaaatatgcccagtgatgtaggaactatgtgcagttggaaggactctttgccaaaactctaaggaatcttgtggattccttacaatgtgtttcataattgctacctgggttacatttgtactaaaatcctttcttcataggaatgatcttagagttaaataattttctattagtcttttaactacctcctctctataaatttttaaagaaaattcacttaaattacttttagtatgggagattgtaagcagaaggccccatagattttggatctgtggtagcatgggaaattttcttttctttctttaaataagccttattttagaaaaacaaatctctagctagctagctacatagatagatagaagtagacagagatatagatataggtatggagtagactctaatatgtctctatgtatatctatgaggaaaagtaattcttagtctaattcctatggaaattagacattagaataaatgctaatatacctagcacagttctctactctgcaggtgcccataagctctttattttttattcattaattcttcactcaaccacccaggatttattaaacattctgtgccaggcactctgctgggtgttagagatataaagataagtaagacttggtccctgtatttaaagactcacaaagcatcctaaggctagctccaattccttaagtcatgcgtatagaagtatagagagatcactatgattatataattaatcagtcctataaaccatattttaaaatcctaacctcataaatgctgacccataacagaggttcctcataactagctgtaaaaccataaaccagtcctttaatttctcaatgcattaagaagtttgatttgtaaaatgtggtactgaaactaagatcccttttatatttgtaggattgatctgaaagtgactactgattgaatgccatgttgatgtggatgaagagaggagttgaaagcttgtcagttaaccaacagaaaaaaattaaagttcggtggaataagaccaaatggacaatgaactgcccactccctaaacctcccacaggcacataaagtgactgccaaaaagtgcactctcagttgtctgggcacatggaaatatctggcacagtctcttatccattaaaatcctaaatatattaattaagaaccttgtctttggaattgcagaaccaacttcatgtgtttcatgtggctttaaactgcaaaattgtcaatttataagcttgcagttgtgccaatggaatacataaagtacataaagtacaatggagtatataaagtacaatgtacataaagtacataaagtacaatggagtacataaagtactctagtttgaaccagaagttttattaaactattggatagaagaaaatggtccaagataagaacatgcaaaatccagaacatgaaaaatgctcattttacccaggataatttaaaacgtatacaatttgttagatataattgttgatgaaattaataaagaatatcaaaaagcccattaggtagatatttgttaatattaaacacagtcttatgacaggaaatatcaagaacaaggactgcattttattcattttttgtttagatgaaacttacataatttaacttttctttattccataactgtcaggaagcttagtgtaagatttgatgctcattcctagtaactggtaactatttgtgctctcctccttttcttacatttgatgttattgtttagtgtttgtcccactttatgaatgaccattttttaagctttcttaagtcatctttgcagaggtcatatttaataaaaaaaaaagtctgcctttgtctcatcatagagctgaacagtgttccttatgtggagtaggagcttaacacatatttgccacattgttaattcattgtgaaggatttcataaataaacctagagaaaaagatatccactaacgtattaaatattttttaaaagcaagttcatctgaaaggagcaactatgtcttattatcttaaaacttcaaaggaagtttttctttaaatgtaaaacatacctcttaattccagaaagactgatccttcatttggcttttgtgcattttagccagtcttggctttctaaatcatgttgaaaacaaacagaccatttgtgccatgtttgctgttaactaagtaataaaccaagaggatttagctaattttttgaggtcattaacatgatgaagttaatcacctgagttaagacatatggacattttaccaaaaaaaaaaaaaaaaaaaaccgctcaaatggtccttgaaataaggttaaatagatctaatttatgttaaactttaattaaccatatgcactactgcgtgataatgtgcatgcatatgttgcttacattaattgctttcataagttaattactgcaacacactttggcttctgttcatttaaaacttaacaaatgttcgcaccagctgtggaagtgattgaaggcaataaatgaacgagtaaaccattggtttacttgtttaaattaaatctgctatctcaagctgtcctgtgtcttaatacattagaaaagacacttgggaatcaatgatcatgtaattcctattttaatcactgttagtcatacttaaagtaatagggacattgaacttttacgtttgttggctgacctctgctttctatagtttactgggccatcattgactatggtttacttttattacagcagaattgagctacagtttcatataattagatatttgtctggtccttgtataaaagcatacagactctgtcatgcctgatgtcttttattgcccactttaactggatactaaagtttgtgtttaaagagatgatttatatagacaaagaacttcttctaaaaaataatagaattctattttattgaaactaaagtttacttttttattacatcatttgtctctctgaatctgtagcatgttggccaatatagtatgataataaattactactagaatacctcatatgaaaacttatatttttcttgactattaatttgaatcacttttttaagaatcaaatttcaggatatctggttaatgatggtgggttgaacacatacattagcctctgagccccttctgaaaccacatcaaaatgaatataaagaggtcttttaaagatcctaaatcactaggacacaagaaataaaagagaacacaaacaaccctggaaagcatatggacaagtggtaactgacttagcagaacctagaaagttaaatcctaagtcagcaggtgggaaagccaagaaacctgatttatattgcagaccaaaaggcgaggaactagtggctccaggcacctctggaagtggaagcgaagtgaggctaaaacaaaagccttcttgtaaatttccttaagaggcatttagacacccagggccccttcccaactctgcatgcgaggtaattgcctcacactttgcctcacactttggcaaaaattggaggacgattctctggaaggcctgccagagagagcttccagattgtagtccccaaaggctagagttgagggaggaatactggactgaaaacaggcaggtaaaatgaaagttaatacattacaggtaagctctccctcacttgactcccaaaaacccaccaggcactggaagagccttctctcaggaatctgcagcccaagaataaacacctgactgcatagaaataagggcagaggggatgtggggagttcctcatgaaaagacccagccagattgccctaaagcccatctagctaacagagcttccaattagcatctactcttctcagtagctggcttatctgaggatggagtttacaaggtcttaataatagaaacattgaatatgaattataaatctgtcgggtgagtgagagctgggacatggaaaatatgtgtgtttgtgtgtgtgtgcgtgtgtgcgtgtgtgtgtgcatgtgtgtgatgagcgtggcagggaaataaggagaaagggagctacatcctcatcttcctaataggaagacaatagatgaggcctaagcctgaataactgagaagcagcaaataggcatcttatttagattttcttttttaaatcagttagacctgaaagcagttgacttgggagcaggaaactatgtgcctctctcaatgatatgcatgtatcactttgacaaaaataaacacttaatttaaaattataatagatgcttacatagttttcattttaaaaacaaactttaaagagagtaagagaaagctgttattctttttttaatcaatttcccatacttgttattttataacttattttcatgtagatcctcctgattatctgctattttaagacctacatagcctaggaattagcatttttggacgccttgtcctacatcatctcatatacggtagcttaaaatgcatctatatcctgcataaattatatgtggtataaaattaaagagagtttttgtaatgttgctttttgaactattatcacttcaagaaactcatctactttatgacttacttgttagcattgtcagcttttctgtgctgtattttatactaaaactgtttctgaaaatgcctgaaaaatgtttcttgaaaattcatttaacattgtctttctcaactaagaatatatctgccaattgactatgatttttataaaacattaattatgttgctttaaaacaggtttgaacataaaaaacaaattcaatgtcattctagagtaataaccctcaagaaaataccaggacaggagaaaaatctgaatttttaataagccaatatattttggagtatgataaattaaaatcaccttcagatgctgagattaaaaaaattctggacagaacttaccatgttaaggatttaaaagttttaattacattaggatttaccttaagagatattatgataactatagataagagccaaaaggagacccatgagattagcctttcctggccggaatgttttatctctctgcatctgattagtttctatcatctgttgaaggattatgcctttgcttctgtcgggatgccatccataattcttacaggatgaacttcccagtctgttggcggtggaggggatgagggaggttaggaggcagcaccctttttcttctggagatttgcaccttgcttctaaccatatcgtgtttgctcagtctctgctctgagtacttattaatgatctgtcatctgtcacaggtaattcattctacttgattgtttcaaattagctctagtgagttgaccattacttatcttccactccataaacctaaatcttgagatccttaaaaaataagtaaaaatcatgctgcaaaaatacaatgtataaatcaattgcatttctttgacttataaattgttactttctttaatttgattacactgaggtcatgtgtctcctcctaataataatagtagccatttggtagaggattttatagtttacctttgcattcacaaatactgatttatcattactatgagccgataattattctagttttaggcaaggtccctgatctcatagaatttttttcttgaaagaggctatacaaacaataaacaagcaaataaatgtaattaaacaagtaaacaaataaatgtacaccatctctgagcccaggagttaaaggctgcaatgagctatgatcatactactacactccagcctgggcaacaaagggagatgctatctgtaaataacaataagaagaagagataaaaactgggtgtttaaggaataaaggcatgtcagaggcatgaagatcctactttagcttgagttacggggtttctctgagaaggtagcatttgaaatgaaggcagataatctgctgaacatacatctagggacagagtgttccatgcagagccaatagaaaggccctaaattaattatggcaacctatatatatcaatgatgatggtgatgatgactgatgatgacaacaatgataatgataaaaaggaagataatgatgttgatgacggtggtggtggtaatgatgataatggtgatgatggtggtgatggtggtgatgacagtggtgatagtgtgataacagtggtggtggtggtgatatcctacatttataagtgtagctcaataaaactaaataaaatgcccacggtcacacaattagtaaattatatagatccctagacaaaattatttagtgacaatgagatttcaaaggtgatctgaactttggccttttggctgttatatcagaagtgctttagataattgccatatctttgcaggaatcccctaatttcaaaattcatctttaagtgtttcctaaattatagggactaatcctatgctgaaggaatcctagtactccatcttggtaacaggaggctctttctcttttgtctgggctctcatagctcagctatgttttttcactccactgatcaacaatgtcagtcaactctgaaagcttggttttaagcatctcacttcttattcttgcaacagtcactttagtgtccccaatcccactaaatctttggcccactgaaacctctaatacagtgacactgacaatacccatcacctcactcaggtacttactttcttcttttaactagtacaaattccatgtaccttcactatgacactcccttgcaatgaatccgctttctcaacaaaacttccaactttaactgaatccatatattggccttgttctatcttttttttttttttttttttttttgagatggagtttcgctcttgtcaccaggctggagtgcaatggcgtgatcttggctcgctgcaacctccacctcccaggttcaagcgattctcctgcctcagcctcccaagtagctgagattacaggtgcccaccaccacgcccagctaatttttgtatttttagtagagatggggtttcaccacgttggccaggctgatctcaaactcctgacctcaggtgatccacccacctcagcctcccaaagtgctgggattacaggcgtgagccacctcaaccaaccagcgttgtcctatctttgtcttgtgcctgagaaactaaacattgggaaaatcacataatcatgctgactggtatccctttaaatttatgaccatatgtctcaaatgggtcctcattcccctgctaagcatactgccggcactcagaagcagctgcatcaaatcttctcttctttgcatgattagttgtttcttttatcttgtatcattctcaccagctttttgacatgatctaatatatccctttaaaaacaaaacaaacaccttggctctgttatccccatccagcttatgcctatttctctgttcctctttatagcaaaacctctcaaagggacggtctccacttccttcatctcccattcactgtaattcattcctactgaggttccactctcatcttttcaatgaaacggtttttgccaaattcaaaatcctcactgtaccaaattcaatgacatctcatctgccctcctctcactctacctcaaagcagtattccatgctttggatccagcattccagatcagcctccttgaaactttcttttcttgcattctaagactcaacactctccaggttttctcttccctcctaggagaacccttctcagccttcttaataatttcccttaaatggtctcagtcaatgctatgtcttcaaatcccatctcttctggtaatgcccttttttatttgcttctctgatctccagactcccaactagaagcctctctgacatttccacttacttgtctgagagtcttctcaaacttggcacagccaaaacagagtcaaccagagtcttgatgtcacccaaaaaatcagagaaataatttccttaatcatctcatctgaaataacctacccacctattctctatcccattattcatttttgttttcttcatgtcactatcagaaatttttactcacttttttattttcttgtgcctgatctactttcccaccagaatgaaagctctgtgggggcaaggacaaggagctcatctgacttattctggctttagtctcagagcacaatacgatgcctgattcatagcaaacactcagtaaatatttattataaaattaattagaaaatgaatgaaagaaaaattaaacacttcaactttaacattaaatttaattcaaagatctaagtgaggggttttcctaaaatgaggaaaggtagcatagaattagatgttgtattaaaatgcatcacatgcaaagttttaaatatataaatgtatcatttttccaatctcttacaactgaaattataaccacagaaaatattatattttgtattctataattcagttatctgatttttaaaattaattaatctacttaactcattaaaatataaatgctgtaacaaattcttggcttttgtcaaaatctgtttcttgcctccgtcttccacatgtaattcaatttctctgagccttggttttctcatctttgggcttgatgacttccagttttcaaattctctgactctgtcttaacattatcatcatacagatgtgttcttgttcatggatttgcttgtctctgtaattttctcacattttcatttgtgtattttgcataattgagatagaactgcggctgtaactgtaactggagctatatgcgtctccagagagctgagagtacaaacaaaatagctaacttataaaaacaactattcatattgataaattacacatatgagctgaggatttaaaagagtaaagtaaaattttattgtagtaatttacaaataatgctctataaaaaggaattagtgctttacgaacccagagatgctttaaaattctttaatagtcactctctcctcaatttttttggatctccagggaaagcaggacttgctcctgtgtgatattctgtaagtcctggacaaattcagctgccaactgaagtccattttacttcaggcaaagaactatgtcttcctttgcttgaaccagcaagaatctgccctgagggacaggataacaaagcttcacaggcatgcacccaccagaaccacatttaaaggaaagttatgcttgcctctaccacagaaccatatgtctgtaaaatatagcacacattaccaaaataaatataattttgatcaagttaaagtatgtttcaataaaaagtaattttcttttcttctataagccttttaataattctttcctatatcagtttggctatgtaaaagcaggtggattgtgcatcctctcccaaaatgaagaacaaaattgaacaatcagccacacaaagaagtcctcagaaagctgcatgctctcaaatttgccaattaacaagagaaaaatgtgtgttactcttttaagttctctgttattatgcatgtgtaaacctcattttaaagtaaaattttttttattttaatacataaaatcaatacagggttaaagataatgggagtttttatttaagttctacataaaggtccaaatatatttatgtagaccccaagttttctcaatagtctatcaccctaatttgaccatgatggagttaatactggctatgtagtcaaaaggctttataacttacaattgggaaatgtgagcatatcactcactctttctaagtctgtttttatcatgttcaagaagtatcaccctgccctgaccaccttacaaggttgttctgatgaaatgagatgatgccagattaaaatacttggcatacaaatgaaaagttggatttcttgagcagagagcactgtgtccctagtaactaattaattcattaattaagacattaatttaataaactaaagcatttcctgaggcactggggcttcaagaataagtaggacaaaaaaatagattcatggttgcctaagcctgggaggtaggaatgggagtggaggcaaatgatcaggggacttctatttggagtgatagaaatgatttcataagatgtggtactagttgcacaattctgtaaatgtactaatatcataaaattgtacgtttatttatttatttttcttgagatggagtctcgctctgtcacccagactggagtgcagtggcatgatctccgcccactgcaacctccaactcctgggttcaagcaattttcctgcctcagcctcccaagtagctgagactacaggcatgcaccaccacacccggctaattcttgtattttttttttagtagagatggggtttcaccatgttggttaggctggtctcaaactcctgacctcaagcaatctccctgccttggcctcccgaagtgctgggattacaggcacgagtcaccacgcccagcaaattgtacatttaaaaccattgaattttatgatatgtatattatacctcaagaaagcttttttaaaaaaataaagcatggttcctaccatcaagaagcttatagtcaaatggggaaaactgacatataaacaaaagaaggctacagtatgctagagaaatgtggatgttgttgttgttggcctaaagttatacataattgaaacttcaagtgatttaagtattttaaaagaaacgttaaatacttctaacattagtaatactgtttcagacctagaacagatttcgtgctctattgtaagacatacaatatctaaaacttgcaaaaactcattaaccctgtaccacacttgtcatatatgagactgtattttaagaaacaaggccttgacatgccttgtctggaaatgttgccaatattgtcaatttgatgttcgttgagcattacagaacgctcagtgcttttggcgagcgggtggaagctgggttgaggaggagcgtctgtgccctggcacacttgattgcttgaacccagtccctcagggacactagctggcagggctcccgggtcatcacaaagcaagcaggacagaaggggtaggcagagcagagactgccaacccaccacagctgggggctctccttccactcggagtaagtctgcaattccagcccatgcgttctttctccagagacacttttctgctttagggaaatgcaaaggacacccttactctgggtttgaaattggatttccaactctgtcaagcatcctttatttccagaagttgtcctagtttaaatcctaagcctccaaactttttcttcaacgtacaaacaggtcctccttggagagacacctctccactaagcacctgcctccctgaacatgtattgtatattgttttcttccagcctattccatacacctcagaggagagaagcctcatgtatgcttccgcactgattaatttatgcagtctttcactcactcaacacatacttgtcaggccttattatctacttaaacttgatgcaagcctgcaaatcagagagtatctctggtatagaccacataaacctacctacacatctcccaactgagctggtatttggcccctggctgccccatgagaacatgttcccttagcagagagtaggcatttctttcttttcacgtctatgaagatgagtaaaatgtaaaaatgggtagaaagattaatagcaaccatcatttacccattggttttctctgttttgtaactaaatgtgaaggcagcacataaaaaacgtttattctccatggtgtctttctctctgagtcattttaaggtttgaaagaaatattcattcttcttaaaatgcctctctgggccctagttttctctcttataaaatgaggttgttgtattcacaacctccaagcactctttaagcttgaacattctttgatgttctgaatcatacccaaaattcagccctttatttcccattgagaggtagagatttgaagcagaaccagaaagggcctgcctattcccaaaaagaagatttaataatttgacaatgtctaccaaaggaaactgaatcattatgcattattatcattatgcattattattgagacggttattatttcagccaaattattaacatttcagcaggaaacttttttgcctggctctgatacttgttttcatgcccaggacaggtgttgcctaacctggcctgaatcatatctgactttagagtctccccagccctactcatgccccagcaagggctgcaacagtcatgtccagtcactggtgatgcgatcactgggacaataggaagacaggcccagtgtgactaggattctgggatgctaccagctgtcagtcaacactaccagatgcggacagagatggctttaatgtgtatgtcctagtaaaccgttttcgtcagaataataaagaccgctaagacaaatcacttcgattgcttaataatctgcttgctctacaaagaagcagtatcaggtagcaattaagcacaaggattctgaatttgagtctacctgtgtttgagtcatggcttctgcacgtactagctctgtaactcttagccttagtgttccctgttggtaaagggggaataacagtaaagttgttttaacgattaaataaggtaatacatgcaaagtatttagagaaatagctggcatatgataacctgcgttaattatctgtatgctgtaactccctgtgggaaaaaaatttaaattaaacttaagtcataaagaaaaaaattagatgactgaaaaaaaatacggcataatatgaaggacattagtgtcgagtggggtcttattaaacaaagattcagaaatccctgttccataagatggtcatcagaccgaaatgtttataaagtacctagactaagatagatctcagtgagtattaatttcctttccctgtctaatatcctcaattttatttcttttgccttctttttaaatttatttttctgtttattttttaaccttgcttccttctatctgcatgcataggatgggtgttgcctaacctggcctgaatcttatctgtctggagagtctccccagccctgctcatcttccttccttccttccttctttccttccttccttccttcctttcttccttccttcttttcttccttccttctttcctccttccttccttcctcctttcctccttccctccctcccttctttccttcctccttccctccctctcttcattccttccttccttcttccttccctccttccctccctcccttctttccttcctttttctctccctcccttccttccttcctccttccctccttcctttccttcttccctccctccttccttcctccttccctccctcccttccttcctcccttaattccttccttcctgacttcctcccctccctcctcccttccccacccgcacctccctccccatctctttctttctttctttctttctttctttctttctttctttctttctttctttctttctttctttctttctttctttctttcttttctccctcaactactgattgctggtttccttctccatgccaggcactctgtggctccttgggataaagttgggaaacaaaccaacattgttctgaccctcttatagtctaatgcggggaaaagttattcatcagattacctcattaatgaatgtgtaaatacaactttagataagtgttctgagcaaacacaatgttgttttgtaagggcatatgtctgaaacaccatgcctgtgagaggctgtgagagagtttacccaacccataagtggggaagggcattttctgctaaagcagtaactcctacagagaacctgtggcctgagctgccattttaagaatgtgactgaagctcagggaggcaggtaacagaggtgctaaggctctctactggagagatttcagagaaatagaacaatatctagcaaaaagttgctttgccttatatataaccaaacagtattttatgatttatttctaaataagagtttattttccatttacagaatcacacattttaaatgttattcactgacctgtagtatccaaattaaacctatttctcttattctgcataaattaatgttaatattatcagtaattgcccccatacataccaaacatgcatcgagaattgtatgattactctatgtaaaaattgagacgtggaatcattcttgacaccttagctccgtacctgccaagtagacataaggaggctcaaaaatatatgctacagataaaaaattaaagagactgacagataaaagaattaaagaaagcataacctcagtggcagagaaattctgctttcagtatactaatttacttttaacttttcagattattttgggaaaatttgaatacagaagtgaagcttcaaaaatatctgagccttctgagcagaaatacaggtttctttagaatagtttttcctcccgtgttcactgtggtgctatggggactctacggtgatatggaatgactgcggtaggggcagtgtctaaacctaacaagtccagtttaatttgccaaaaagtttctcactttgaccttggcctgcatctacctggataagcctatttggctgatttcaggaagaaaaatggctgtagtttttaatgaaaaatcacctttttgaagtttgtctttcactttatgccgtatttggcatacttggctagattacacaaactgtttaaacttacaaagctgaactgctctgaggggagatttggaaattaaataatcgatttttttatccttttcatgatcataccattgatgcaactaaaggcaattcaacattaaaacaaacacaatttctttttatttactacttaaatgtagcctgcactgttagtaatacatgttattttctcacccttttttaaattaaatgtgtggttcaaccatttttcaaaagcatccgcctcttatactgtcgctgaaagatgatcgtgcccttccttgtgccatacagaatctgcataaatatatcctaaactacaagctattgttgaggatctaccacttcagatagggaattgaacataaagaatttgctagtgtcaaatgaatgcaaagctggtctctctgtgatgaggcttatttttagttactaacaatttttgaagcctaaattacagaaaatagcaatcattctctagtgcattggctcttaaaattaatcaggcaactgggttaataatagcatatttttattaataacctacagaaacacctgtacttattcatcagaaatcttcaaaatgatattccagtcaagaagtgtcaaattatcatttgaaaattattgaataaattctaggagtagtttattactaagagtgagttaaataccttttcagcgcattcatttgaggagacacagtggcacagaggttaagagcaaaaggtactcagttagactacctagattgcaaccttagtttcaatagctactaactgcgtgatcttgaggaagttacttctctgggcatcagttttctcatctgtaaaatgggaatgatattagtaacacaaaatgactgctaagatttagctcctactttgcacaaggcactgtgcatgagcaagagagagaatgacagatagatattacatgcctagtactcttctaggatttaaccttcacaacagctgtataaggcagaaagtattatttccccctttttacagataaagacatttagaaaccaagaaggtaaacaacttgcctgaatttatcagagaaagtatcagagcctgaatttagacccagaatgtttagccccaaagtctgtcttcaaccactaatctacaatgcctgattcacacatcaacatatggctgttatttaatgagatgatatagataaaccacttagatcattgcatggttccagtaaatattcaatgagcattcattactattattagtttatgtattgtctcctttattgcattaaatacttaactttccactaagatttttttcttataccctcttttgccacattttgtgagatttggtaagattatcttggggtcaacacataataaaaggcatcacacattttttgtttctaataatttcatgcaccagagtgtcaaacaaatcaaggtcaattctttaaaaagtattcattcatttttttctacaaatacttattgagcacctactacatgcccgatattatttcaggacctattctaaggcattcagcagagaacaagacaaaggcctgtctctcacacaagttacctcctagtgaatcattttgtcattaactgaattcaaacttgagcctttaatcctgggaaatagtgctataaccaaaactgaaatcttccactgttaaacacttgagacattagcaggaagatgtttacacagcccacagccctctgtgtcactggcctttcctcatgggcttaagaaaactgcttcagagaaaacctctgaaaaacctgccaccaacctgtggcagcctacctcaaaccagcagctgaaggacagagcaaagacattccaggatctctgagaactgtatccataaataaagcccattcaaaaaggatgcactgatcatgtttttctccactggaacatgagtggatgtttcacaagtcacccattctcctcattgctgcgtggtgaaagccacaagttccaaaatagatgctgaggctttcaaattcctgaggacagaatttgattcttattcccttaagttatttttctcttgccctcatccttccaaaaaaaaattcatattctgctactatcgatatctcatgtgaaataattatattagtgaaggcttttcatatcagattatgtcctttgaacatacaaggaaaaaactcattgttataacaatatgatcattcaagatgctttttttagtcattttattatttgaagagaaatgagtttataaaaaaatataatttcctacaaatttaagggaaaagcatatgcttcttttttctttttcttttcttttttttattatactttaagttttagggtacatgtgcacaacgtgcacgttagttacatatgtatacatgtgccatgttggtgtgctgcacccagtaactcatcatttaacattaggtatatctccaaatgctatccctccccccaccccccaccccacgacaggccccggtgtgtgatgttccccttcctgtgtccatgttttttttttttttgagacagagtcttgctctgtcacccatgctggagtgcagtggtgcaatcttggctcactgcaacctctgtctcctgggttcaagtggttctcctgcctcagccttctgagtagctgggactacaagtgcaggccaccatgcctggctaatttttaaattttttagtagagacaggtttttgccatgttgacaggctggtctcgaacttctggcctcaagtgatctgcctgcctcggcctcccaaagtgctgggattacaggcatgagccactgctccccacctgatatatgtatacattgtggaatgattatatcaaacaaattaacatatccatttttctttattctgcaatactggtgtagaatattcttaagagactgagggggagaaaagaagtacatatattgaccgctcacaaattttaacatttaatctcatttaattctcataacaacactggaagtaagtacatgtaaccctcatttaaccaagtgaaaacagagattcgggagagccatgtaactgttccactttcactgacacagcagagccaggactagaccagctgtatccaaaggtcacgtcttctcacgaaccacagtattttacttcagcagaggtcatgcagatatccataagaccactgctgttcaagagaaaacagttccaaacggccttttatagaaccaattgctacatacatcacattcatattaacatgaaaaaccatctatatgtgttcctatagttcatcaaaaaactatcacaacaatgttaaagcaattatgcctctcggatgaagtgttacattttaaacaaattacttgatgattctattaaaaggaataaaaataatgtaattgacatagatgagattagcacctttccccattcattttatgatataccttttaaagacatcatcatcatcaaataatatttattacacgctgtaattcctagaagagcaggatttggactgaaaaacataactgagttacaagcaagacgtattgcttatttaatacatcatagactgctatagaagtgttatgtttttatgtaatggttaggaaaacctctgcattaatttgtagaaaaaaatagagaaaaatcaaaagcctacaaaaatttttgtacaactttgaatttaactatttcctctaagaagccaaagacacatttatttcttctctgccttaacattcaatctaattgaaaaagctaggagacaaggaaataaatatggatttgtttaatggtaaagtgcttgatatttctgttaattataacttgactattgaacaacttgcactcagaaatcttaaagtatctcaaatatttatctcatttacaacatatgggagaggaagattcctttctctttttcctcctatgataataaagaccggcaagggaatgtacagagagtttcacaatgagttgtgtaatcatgaccagtccccagacttttgagtctgatggtcttccagtctggcagtctcacaactcttcatattcctagcctttgcacttttaattttccaccagtgattattttaaccatatccctagatgactaacatccatatagcctttgaacctcagtattaaccgcagctgtatcattgagctcacagggccttctatgtaggctttcatggataatatttaataagatgatgtacagggggaaaaggtaaacaatttttctaacattgaaactaatatatatgcttcacttaacatgctatttctcctgagctttgaatatgaaataggcattgtttcacactacaaatttgaggtcaggcagtttttaatttactcttttcatgctaaatttggagtatctaaagttattatcatcatcaaaaaatatttattcaagctatactttatagaagaggggcagagtttggactgataaacataacggagatacaagcaagacttactgcttacttaataggtcattttccattttaactactttagaggtgttaagtccgttcttagccgctggtttgaaatatctaaagctcagcagaatatctctaatgaaataccaatggaagtgttgaagggtttcttactcttagtttgaaattcaattctgatagatataattgactgcaccacatccagaagtattatctgtttatctttgtgcatttcaaaaggcagaaaaaaagttgacttacctcataaagagatctcatggcatgtatctatatctctcagtccatcagtcaacatgtctatcaagaatggccatgtttattctgtcaaatattaaattatgagacttatgattgcagccaaagaggacatatctatttggaaagttatacagataagtgacatgaagatagagagtttatagttcatttttgttttactagaaacaattacagaatactttaactagaacgttggcttctgtacagtttagatacagtaaaaatatttttaaaaaacattttaaaaaacagtttcatgaaattcttagggatccacttataaaatgttgtggagagctactaatatgctgaagttttccagaacaacaagaaatcaattaacgtagcaccacatcagtttaaaaagcaatttatcaacttttcctaccaactcagggtcaaatttcattgtgtcaaaaacttaattttaaaataattgctggagtgaactttgattaacaatagcacaaatttgaaggagatgtgttaaggttccttgaggtcattcttatgagactaagaaagaaaaggaaaatatattggcttcacaaatggccaagatctttttaaaaccagctagcttacaaatccaactgacctgtcgttaccatacttcacagttaagaatcatgagaacaacttgttctgaatcttctggctgactccccaagcagagtgagcattgagtatcttctgtgattaacatataaactgttttattcagttttggcttcctttctctctgttccatgagagaaaggaaaagaaaaaaaaatctttttctttttaatggattcacagtcagtataaatttttcctctcaaggtatgtattataagaaaaaagaaagtggacattgattttatagtatttttctatacttaaacctatacccaagtaatgtatgttttatattttcaaaaaaattttccttaagttattttctatatatttcagtatttaggttatttgttgtactaatagattaacatatgccaagagttcattatcattttctttaaatagattaataaaggaaagcctgaaagagcttgaattttataaagagaagatgaagattttacatatgatgactttaattgatgttgacaatattatctccttgaaatttcttaggataggagggaagcatatttgtggatcaaaggaagttttaaacagcaaacaaatgcacatatactgtcttgttggagccccattctctctgaaaaacactttttttattttttcactcttttttggttagtattgttattggatcaaaatcaaagtagtgttccttgattggcaatgttcgtatttttttatattcattcaggaaacagcagaaaagaacacttatttttaactcattaaaattaaaactcagacacaacatctttggctttctcaaatggatgctgaaggctggaaagttgagtctggcttgcaactaatattaattttctacagcattatataaatcatctgcctgtgctgtctcacagaaaatataaatagtggaaaaataatttcctcttttggagatattgtggcttttggctctcatggtctaggccaaagggtgcaaaatagaattacatgtggcaaatagcatttcccaccatgctaagtggagcaagatccttagatccaccatgttgaaacagagcctcccatgtaaagtggtagacaaggacagctgtaaatatccttgtaatacttttgtgtctctcccatttctttaaagtagattatgaaacatcaacatcaataaatgcaacatttttctgagcttatactccatatgcatattgtagtgccaatattataaactgtagagaaaatttttaactacgtgagtatagctttaaacattttcatattacatgcatttttacatgtacttcaagccaatatttgatcacattcaattttaacatttttgctcgaaagtgccaaaattttgcactgaatgaacacatgaatgaacatttctgcaatagttaataaatcactctttccattctttttcataaatcattatgggaataaaactagctgctgctcccacaaaaattacactggaaagcaagaataacatttcccttgccctttccctcccccaataaactaaattttttttaaatggttatcaatttaatgctatatttaaccatgtaagaagaacaaaagttcttccctttttttcaaaatgctataccctctcaaatagttttttatttaaaactctcttgtacaatctttttattcaaaactctctacccttttcaaatttccaaaagagatgaaaaaaaattgcttttgttccttcaggagcagaattagtatatcacagaaatttctcttgaattatttttcaacaaggatcctggaaagccacatcactaaaaatcaagaatagctaagaaaaactaagaattttgcctgctagaagtttgatctcttgctgctttttaaaaaaatctgtcttgatagcagttttaacataactggtagcgtattcagtatcatttcttcatgacatgccactagcagccaatcttggtaaacaaactgattaaaagattatctgtcacccagggtttcatcatcctctacagtgattcacttgtttggaatcaaggcacagtctgaagtcactgaatggagttgatgaagctaatgcttcacaaatagaaaatgaaaatcatctgaaaaccagggagaaaatcctcactgattatcgccaacttgttggtagaattctaaccgtatggtttccatgcatgaatcacaggaaccattggttgcagcagagcccctcagctgtctcacttcctccagtggcatgagcctgctgctgtaccttgtattcacctggtgacagtgatgaccaagatgtttacacctgctgcagtgatgagcacacaggcatgagcagtccttccacagttgtgtgtgtgtcggagggcattggaggggaagtgaattccaagggctggagcggtagaacaattccaatctagcatgatctgtcttgaattctaagaatatgttttcataacttggaggatggccatatcatggaagggggaaacccaaatattgacgctttttgcctatcatgatgtcataaggattaatcatccaaatgtaactttctgagctctacaaaaggtcatgtgaaatcaaatttctattaataattagattagatatctgatcccaagccctcataacaatcttctctggccttttttgttactgctgcttagagctgagaatccctgttttctgaaaactttaagcctgatttctagttcctcctgccttttcccagatcccaaaaaaatcaatgttaaatcaacttgagtattttcacatgcaaaggaagtatttgaacatggaacaagtgtggatattgtcccaatgatcaggattttcaactttcttgttcttctcagatcctctcttccctcaaaaaattattctgttaaattaatttaacctcttagccttcttttgttgttgttgattttttgttggtttgttttttggtttttgcttgtttgtttgagacggagtcttgctctgtcgaccaggctggagtgcagtggtgcgatctcagctcactgcaacctctgcctcccaggttcaaccaattctccctgcctcagcctcctgagtagctgagattacaggcaccaaccaccacacccagcaaattttttttttttttttttaagtagagaagaggtttcaccctgttggccaggttggtcttgaactcttgacctcaggtgatccacccccttggcctcccaaagtgctgggattacgggtgtgagccactgttcctggcctaaccccttagccttctattaataatacaaaaagatatgtcctcccctaagatacgtaacctttcagtaattataaaagtatatacctgtgctcagtttttatttgatgatgctgtttttattttattttaatccacagctattttccacgaaacatcctatagaagagatactttcttagggatgagaattatgtattacgtacttagaacaagggcaaagtttaactcttagtacatggcaaagctgatctcatccctgaagagtgtaatgtacttctagaacttcatcttctatccaaatccattaaattaaaagagattgagggaactgagtggaatagtcatcaacatttcactaaataaaatgaaatctctctgaaattagtttggcttctacaactctagctagacagaaacatttgtccctgacacactgaagtcattacttaagagcaattgtgcatttggggaaaaaaatggccattgtaagtttgcaaagttgaaggtaagaaggatggatggtgaaatggaagcaaagaaggattcagtaagattagtatttttggataaggatagttgatgtgtcacacaacagagccaacttcaaagtttgacttcaaagaaaactctccaagaaaacacacttgtgcatgtacacagacacacacacagaaagcaaacacaaacacttggtagtttctccctttcatttgtgctaacaacttttccattctacttggtctaggattttcttttcctttttgatatgcttcaaattttgcatccttgaaaataaattttattagacatgatgctaggttcactttagacccttgtgttgtacacttcttaataaacatagctcataacttctccttctagaccacagtagtctagaatctgtcttgccactgtgttaagaagcaccccaaaattttagaaaatatttttatagtggtgtaaaattaccttattaaaatcagaaactctataaaatattttagccttttacaccaatgctaaattctaaacctaatttcatgttgtaaattattttctagcttaagctgaagagtttagaccttgtgacaatcaaagccaactgatcaaattctaccttctttgaggtgccctttcttggatagtaactgcttctttcctcagtaattttctaactagcaaagctcttgaagacctttctcgggaatcttccctaccattcatcccttctttatcatcctgccaaaataatttcttcactgggactttttgctataattacctcaattttgttgttttaacttaaaagtaataaactcatatgctacatctagattacaaattccggaaatagagattgaactctttcctgcatttcctgtttttcctgaggatccagtaatgtgctcttgaatgcaataaatgcttactcaccctctccagtaggctatttccatctgattctgtcattcatcccttcagtgattatttgttaagtacctagtgcattttgagcacactgtgtggttctagatacacaccacatagtgaaacagacttggtccctgccctcgtggaccttacaaccccatgatgaaggccacataacaagaaacttctctggacacacattttatccagtgaagatgtttttaaaatgtgattaattaacattttttcaggtggactttagcctgacttacagccaactagctacaaaccaagatttctttcttgtgaataacaatttaaattggcaacttgtgaatcacaagatctttccagtcctcactgaatgtgataaagccatttatgttgaacccagtgtgtgttttagttgctttctcataatgtaggaaatgacatcaacaaattgtaaaatgtttaatgactgaaacaacaattatacttaaattccttttcaaatccaatgaatcatactaacctgtaacctctgtccctctccctccccacagaataagagctcctctcttaaggcagcccccaccaatccctgctgccccctttaaaatcccttcatgcccatcccttctgtaactaagaaatcttggactgtttgcaccaacttcaagaaacatgaagaggtctcacatttttagttgcctttggagatgggagcaggatagacagagtcaggagtagaatgagacttcctcaagatatgtatgttacagaattttgacttttaaagattgagatgtacaaaaacttaaaagaaaaaatatgaagaaaatgaagagaggcagtatggtgagaaaatgaagtgactggaggagacagcacagccaatatttcactcacaatcattagtctttatctcatctttctgcaccccagattttccctggggtgacttatgaaatttcaattaacgaaccaccaacaaagaacagaggcgaaactgagtcaacaaaaggctcttgatacttaagttcagattccttggcaatctttcaaagtttttctttggcagacctcagcacaaccacgtaagaatatgtctatgtctttgagttcatcttaatgttctttatacagctttcttatctgtgacacagaacaagtttcactaaaaccatatcaagcttctggttccaactataggtctgtgttagagagccacacctgaaaaatcaagcatgtcagatgcagacctgtatgcctttactgctgttcaagaggaaagtgtaagtgctgtgggaggaaggcaggaggaggagccagaggcttggtaggggtgaaggtagatggagaagaatgactaaaagtaagtgcaaaaaatactgcaggaaagcagtttgagataactaaggcagcattccagtgtatccacttaaggaagggttgttaatacagctatacttctgtggataagaaattaacttactgtataattgcattctcggaagatctttcaagacttttctgtgtgtgtgtgtgtgtgtgtgtgtgtgtgtgttgataaaaactctcacttctagtaaacttaggataataggctatgtcttgctaatctatctcactggttattgaaaaactgtcgctctgtagtcaggggtggcaggaatttaagttgaaagcatgatatgactacaaaatgtgcatttctagatacgcagcccttccccaaacagacttggcagaataagttagtttaaatggttggttccatctgtgtggtaaaattgtgtctgacatctgtttaaaatgagcacaagatgcttgaaaaagaagggcaagcctcactgttgaacgtgatggaatctgggggccatggccctcgtgtgtatgtacaagctcacagctcacacggttcaccagtcttgtcagctgttactacctttttatctggatcctgttaacttgagatttgttcttagcttatggaaaaggtctccctgtgttttcttcctccagataggagaagtctcttggcagagttcttcaaaggcagttaagtcagtagcatcatggaaatttggcagcaagttgagtaccagagcagatctaaacgttagtttaggttattttcacaagcaattgttccacaatttttcatccctttattttagcagttagcataatcactcacaacagttcctaaagtgaacctgcttgtccattcttatcattgtgtagtctgaataaccatgaaatttaaatttaaattggatacataaacatggcaaaacatgaataaatcatccaaggccttctgaattgttcagttttcacctgcttaaagttaatgcaaaaagtcaaattgaggcctttgattaaataaaaaattgaacaactagattactttgatatatttcatctctggtaattttgttcttttgccttttaaatcattttaaattgctttgagtgttgccaaaatgcatgctcaccctaatctattataactataagtaggaactttgtgcctctaattaaaaaagaagatgtatattctaggtgatttaatccactctatatttgttgggttacttgggaagtgttgcagattaatatagaaggaattaggacttggtccttgaatagtgtctcaaatattaaagatcttgaaactgaattattttgcattttgtactttgaaaacattgtgatgcaccaaagtaacataaaactgggtcttctaaggttatgttttttaaaggtactatgcaaaaacaataattcttgcctgtagtcccagctactagggaggcagaggtgggaggaatgctcgagcccgggaggaggaagttgcagtgagctgagatagcacaactgcactccaggctgggtgacacagagtgagactccatctcaaaacaaaacaaaacaaaacaaaacaaacccagtaattctcaaaataaggccaaccttaaaatatcccaggtactaaatcatttagcctataatctgatatcactgtttaacagaaacttttccattgctgtcaactaaaaggtaagaaaagggaatgaaactaataaattctgagcacatgcttcgtgttggatacatttagtgctttacatttgctttttgtgctaaatcctttactaagtttatcatttcatgcaatacctgcaacaacccagtgacaacatctttattttacatatgaaagaaacagactcagagaggttgctcaaagccacacaacaagtcagttatcagaagaagaaaagatccaaaccagagccaaaattatttagcagcctcaaaaaaattgacttcagtgtctaaccttccctcgtgtttaaatactctttccaggataggagatgtaattaaaacaatagctaaacaaaaactcaagccattatatcccttgagggctggggggaagatttaaattggttttgttgttatttggttttttcttttttctttttttttttttttttgaagcttctttttaaccctttttttctttctttctttcttttattttttttatttttttattttttattttttatttttggtagaaacagggtcttgctatgttgctcaggctggtctcaaactcctggcctgaaactatcctcccacctccacctcccaaaatgttgagattacagacatgagctgctgtacccagcctttgcttttttcttgacatgaaatcttacatgcaaaacctatgtattcaacagattaaaactgagatactcttgttggaggagaaaaggggcaaggtaagctgaactcctgaaactctggctttcccccctcccaccaagatgggcttctgacatctcagaaggaccactggtttaagttatgttaggcaatctgaatgtataatagagttactgttaatagactatttaaaggttcctgaaaagtaagcatggatgaaaacagatgtttagagcactaggtgttcaggcccgttgcattacagtgcccagacactagcagccaggctgggctttgcctctactttagagcacagccttgagtgcttcacttcgccttgtgggtctgggttttctaagcttcataatgagtaagggtggacctagagcagtagatctcacccctggctgtacatatgtaggaagcttttttttttttttttttgagatagggtcttgctccgttgcccaggctggagtgcagtggcacaatctcagctcattgcaacctccacctcccaggtttaagcaattatccagcctcagcctccctagtagctgggattacaggcgcgcaccaccacacttggctaatttttgtgtttttagtagagacggggtttcaccatgttggccaggctggtcttgaactcttgagctcaaatgatctgcctgccttggcctcccaaagtgctggtattacaggcatgagtccctgcacccagccgtaggaagctttttaaaatgccaataccaaggcctcgctcccagggattccaatttactttcatctttggagcaagcctgaacatgatcatttttaaaatacgcccctgatgattctaatatgcagccagaacggagagccactggtcagggtgatctccctgtttccttccatgtctacactgattgttttcatcgaaatgctaatgaggatatttttaaatgcctccgttccatagcatcgggagcttaaggaaagttcattcttatgtcactctcctagtgtccatattattcatggactgaatttaatcacatcatggtcctttttcatagaaaacctgagaaaaaggtgggtagcttaaggagttccccaggaaaagatttcattcttgttctcatcttttttttccaggtcttttcaatgttttctataaatcactcttaaatgttaagtcttacaaattataaaaaagaaaaattctgagccctccttcagaatgactacattattttctagattccttagagcaagtgctgtgccttatgaactgatgtgtccctggagcctaatatagtgggtgcctggcacataataggtgctccatcttttttttttctttttatgaatgaaaggcatccaagctttcaaaattctgactcatgttacatggaaagggttcccttatgaagctcaaactgcccattacaagagaacagtttgaacatgatataaaacaaatgggcagtagagaggtagtcaatgtgatagcctccccatccccatcccaaggttaccagttgggaagatgagtggttgatttgatagggattgtttcacataacctctttataacatatagttagtggaagcacaacttactgttgtgttcaatttataaacactgtttcacaattgtttttcatgtgaggtttaatatcctgcctgtctagccccagacacccattctacacatccctccatcatatccatgggcacaatcacagccactcccttcatcaaacatgtgctcactttctaggctctcactttaagtgtctatctgtaagctattaaagtcaaacatttctgctatattgatatggttatgggatttagattattttgtgcaggtatattaaggtaaaacagaatatgaaaaccatatgaggcctaacatatgaggtacataataaatatgtgttcaattaatgttatcaggccttacactaaggtcaagaatcaggtaacaatcccagtggcataaatggaagaattgccctagtaagtacaatggaaacataatttcttacattttcaaagtgcaatacattatctgaaaacaggaaaaaatgtggtaaccatccatagtaacacattagggagagatgttaatgttcctataccacagccaggatctatttcactaacagcaccaatgaatgcaaaactttatggaagcctatatatatgctacctgtttatggcagtaaacgtgaagagaagaggtgtttatctttctcttttctcctgaatacttctgaattatatctcaacacttagaatattagcagccagccagtactctttgttttccctctcgaaaatatgaactttaaatcagatatttttgcaggagaaaataagtttagtaatctggggtcttgttatgaggcagaatatgcatcaataagcagaataaaatgcattcagctttcaggctaggcctggacaataacgaccctgcaaatcagagctagaattctaaatgctgtgcctgggaatctgcccagggccttttgggctctcatttttgctgttttgtatttgatatttcatttatatgcatcaaactaataccaactttcatatttgggcaaggaaaggaagagagaatggttgctagaattaaagaactccaaggaactctctaaggaacatagctcctaataaaggtttcagagttccatatttttagaaaacatgtatgtattgattatctacaaagacattcaacacacctccttaattctagaaataatgctaccagttgtggatatcatgaaaatattttaggaggcataatttactacagcatatctgagttgaaagagtagcgaacaatattcttttggttatgtaatatgctgggcagccctgagattcagaaatgttgaggaaaacaagaattcttccccataaataaatcacactgtctcattttagagtttacagtataaaatgatagtttttatcactttttaagttgctttggggaaaactcaaactgaaactgttggtgaatgaaattttataaacttgagaatccgggagattcacgacacaattcaaacctacttacaggaattatatcccaaagcacagaagtgtgaaaagtgtcttgagtgtgtttaatttcttaactaagctttcaacaatagctcttttcatctaagacttgaaaacaaataaatgtagagagattttatgctgctaaggatttttgaaaacatgccaagctgtaggccagaagggaaaggaatgctttgatacacgctattttgcgtatgctgagtttttatctctaacagagtaggatcatactgaaagaagcctgacaacacacccttactgacattattatgacatcagagcccctcaaataatgggaattactaacataaaactaagtaaggaggagaaagtgaccaaatgatcccatggccattccatcacagtatcactagcacaaatgatccagatctatcaataagcaactaattaagacaaactttacactgcccatgatgtcaatttataaaaatatttatttgtgaaataaacatctccagtcccttattttcttaactttttaataaatatttaagtgtttccctcaatattctatttctatttcagtgtccccaaatacatttgttgttgttgttgttgttgttttgttttgtttttattttttgagatggagtctcacgctgtcacccaggctggagtgcaatggggcgatctcggctcactgcaacctccgcctcctgagttcaagtgattctcctgcctcggcctcccgagtagctgggattacaggcacccaccaccatacctggctaatttgtatttttagtagagacggtgtttcactatgttggccaggctggtctcgaagtcctgaccttgtgatctgcctgcctcagtctcccaaagtgctgggattacaggtgtgagccactgtgcccaacccagataagttacttttatacagaactgttatctaatgaaacaaaaaaagactcttctatccaggcatggtggcctgtgcccgtagttcccaccactcaggaccctcttgtcttctgagtagctggaactacaggtgcaggccaccatacttcagaggtgggaggatcatttaagcccaggaattcgaggctgcagtgagctgtgatcacatcaatacactccagcctgaggaacagctcatctctttaaaaaaaatgcagttagagccagggatggcgggcttgtgcctgtagtttccactagtgagcctgaggtagaaggatagcttgagcccaggagtttgagaccagcctgggcaacatagtgagaccctgtctccaaagttactattctaaatggttaataatttattcacttctgaagctgatgaaatttaagaaactgaaaagtaaatataatgtggaccctcattatatactgtggataagagtgatataaaagaaaaattagataatgacacaaaatacacatttataatcacatgccaaactaggcaagaccacaagcattttttggaaatgatttcaggttaaagtggagtggactggaggccgggtgcggtggctcacgcctgtaatcccagcactttgggaggccgaaggcgggcggatcacgaggtcaggagatcaagaccatcctggctaacacggtgaaaccccgtctctactaaaaaaatagaaaaaaaaattagccgggcgtggtggcgggcgcctgtagtcccagctactctggaggctgaggcaggagaatggcgtgaacccgggaggcggagcttgcagtgagctgagatcgcgccactgcactccagcctgggtgacagagcgagactccgtctcaaaaaaaaaaaaaaaaaaaaaaagttgggtggactggggaaggcagggttggtggggatttggacgggctgagacgagaagataaagcatttcaggtgtggacttcagaaaggatgaacaaatgagcttgaaaatgatgaaatccattcaggtaattgtgcatgtggagaaaagaggttgacagaggagaacagagagattatatctgtaagtgaagtaactcaggaatggaaaacctaaaaccacatgttctcacttgtaagtgggagccaaggccaggtgggttggctcacacttgtaatcccagaactttgggaggccaaggcgggcagatcccttgagtccaggagtttgagatcagcctgggcaacatggtgaaaccccgtatcaacaaaaagtacaaaaaattaactgggtatggtggtgtgcacctgtagtcccagctacttgggagactgaggcaggaggatcgcttgagcctgggagacagagtttgcagcgagccaagatcatgccactgcactctaacctgggtgacagagtgagaccttgtttctctaaatatatatatatatatatacatatatatatatatacacacatatatatatatatacacatatatatatacacacatatatatatacatatatatatatatgggagctaagctataggtatgcaaaggcatacagagtgataaaatagacatcagagactcagatgcaggagagagaggactgagggatgaaaaactacccactgagcacaacatacattactcaagtgatgggtgcactaaaatcccagacttcactaccatacaattcatccatataactgaaaaccacctgtacacctaaagctactgaaattttttaaaattaataagtaaaataaatcactaagctcagaacagagagagaagccatgtctgggtcatgcatggtggccttgaaaggcagctgaaactctgtttagtccagagggacatagagaatcactgaaggttgttagagatggaaaccgaactgaaataaggaggaattcaggagtaatttatagactgtgtggcagcagagaaaaagtggagccagagagactaatagggaaccaatggcagcatccagttgtgaggccactggagccaggactggatggagacaatttacttgcttctcaaggccacacactgtccctctgcaaaggaccttatgcttgctattatgcaatgcccagctacaatcaacacctatctttcatttaggaattttgttacctgaggatttagatgcatttaaagacactcttgattctttatttcctctaaattaatgagatttatatctcatacttctcagaggaaaaaaatggtttaatcctagttctaatgtttataagctgaaagagcctcatttctcaaaaaataaataaataaataaagcactaagttaatttacatatttacaaaagaaaaaacattctgcagttggttgagtttatgtgacaagtattttcagacattttagagtgagtttcctttgaaggcagtgataagagtttaaacttcaggtctaaagtaaaatattttaaatggctccttagctttgcttgctaaaaagtagaacattatccaatggagatggaaaaaaaccctctttgcttggccagtgcaatacatgggctgcatatacggaattcatacttgcaaatgttctattttaagcttgagtcaaaatatgatttggctaatatattttagcacctgtttttcactgaacaaacctcagtcttactggaattaagtgtattatttattttaatttatgactattttatcttactaaatgccatagaaaatcaattgatatctgcatttctaatacatgaaaatgcctaaaatctggaaaggagtattgtttagcaaataaatatacattgcttaaatgatagtataatagaaaacattcatgttaaaaactgagttggaaaccttcatttagattgctatagctattaatcacagcttttattttatttatttatttatttatttattgagatagaatctcactctgttgcccacactggagtgcagtggtgtgatcttggctcactgcaacctccacctcccagattcaagcaattctcgtgcctcagcctcctgagtagctgggaccacaggcgcacaccaccacatctggctaattgttagtattttttagtagagaagggtttcaccatgttgaccagcctggtcttgaactcctggcctacctgccttggcctcccaaaatgctgcaattacaggtaagagccaactcactcagtccacagattttatttttaagatggtgagcttcgtatatttttttgtgaagtcagtcatgatgagtttcagtgccttgtttgaggtctcacaattttcttttgcttgagaaaattttttaaaaatgaatatttacttaaatgaatcatagcaatgctgtcttgaccacttttacaacattagttctcaagccagtgagtttcttggcagctttgtatttattcaatcagtgtactcagtaaacgtaattgtgccctgatagacttttaaatgtaagttatcaaacattaaaaatgatggcatcatttaagctgctcactttactcctctggatgacccttgcaatttcatgtggattattatagagatctggtcaaatgttttgtattaatcaatagtaggaacaagcctcattactctcaagtttctaagaatatttgcagccttcataggttttcatgttgtaattctgtttatttgttgattctaaaacaaaccacctttattcatagtgaaaatatgccttagggtacagaaagacattatttgtatatgaactataaataccttattgatttcctatccttggtgattacaagaaaatattcatttaagatcatctcttatataatttaataacagcaataccattctttgctttttaaataaaaaagttatgatacttagaattttacatattttgaaatttatatgtaatttatacagagttgatcctcaatattattagtgtattccatgtttgcaaatttgctaacccactaaaaatgtatttatgaggtgaaataacacctatggcacctttgtggccctttacagagcaacaaaaaaattttagtctcccaacattcgggttctcaactgagtttgaacaaactgacactcttgtcttcttgtttcagcactcacactgtaaacatgtgtcccttgcaagacctattttctgctgtttttcacattttcgtgctttttttaaaaaaaaattcttttttggtttacgttttatttatctatttgtttattttgtagaaattgggtctcactacgtttcctaggctggtctcaaactcctggtctcaagtgatcctcccacctcggcctcgagtgctggggttacaggcatgctcagccttttgtgctttttgttgataatttcaccacttaaaattggccccaagagtagtgctgaagtgctgtctactgttccaaagcacaagaaggctgtgatgagcctcttggagaaaacacagttggttagataagcttctttcaggcatgagttacagtgctcttggctgtgagttcaacattagtgaatcaacaatattaaataacgtatcattaaatggaagcacaggtaaaacaataatatgtattgataagttgataaaactgatgagaccagaggctcctggggacttagtcctgtatatccctacgagcaatggcttggtatttactaattcagtgtttgtagtgactttacagaacataactgccactgcaaataatgagaaatggctgtatctccttctgtttttttctttcctagaagccattttctcaacatttcatcgtgaactattatggcctcatcgggaatgtgaagtgtgtcatctgagcagatgttcttattgttttcctatccactgacccacagcatcaaacaatttagaggagaaaagtggtcctgtcatctccagagttattatctattttatttttaaatccaaacttccacaatcaagttgctattaaggtttatcttattagcatttaaatttttaggaaatgctcattactgggttaagcacaaaaaagtcacattgcttgaaaagtgctatttgtaaaacagaatggcccactttgtctatgtgtaagaggatctgctgcacatttttacctggaataatattgtcatggatttggacatatgtggaagtgctatttgtgtttatgcagatcaacctcttggttttacagaagagagatgccagtcccagggaggttaaagtgcctgcccaaggccgtgtgctggagcagaaggggaggtgctgcctccagtcgagttagagcacttcccaccatccaccaccatcaggtcctgaagccaaatacagaagatagcatatatttttattactttgagatatcatcctgagcccaagaagaatttcttgttgctgtctcataaatatattactttgttatttattagtttaggcagtttatgactagcagtcaaatattcccaataaggttcgaatcaaaaatgttattttgtttttgtattataaaaagaaaagcaggctaggtgtggtggctcatgcctgtaatcccagaactttgggaggccaaggcgggcggatcacctgaagttaggagttcgaaactagcctggccaacatggtgaaaccctgtctctattaaaaataacaaaaaaaaaaaaaatagttgggcatggtggcaggcgcctgtaatcccagctactcaggaggctgaggaaggagaatctcttgaacccgggaggcagaggttgcagtgaggcaagatcaccacactgcacttcagcctcggtgacaagagtgaaactccatcaaagaaagaaagaaagaaaaagagagagagaaaaaaaagaaaagcatattttgaaaggtatcctcttaaatttgtggtgaccctcaaatatttatgctaaaacttaactttcagtatggaaacagaaacatgggttcaatttaaaatccatgactggatcatgagcagggcaaagtgagaggcattgtgagatagggccaaatgcttcgagaatttactccatacagactgtgttcaggaacccagcacttcctctgtgactcaataactggcacatatggttgccagggactaccaacagctgatttcaataaaagttacccaattacaccttgaagacctgttgtttctggagggagttggaggaattaaggaatgtggactgagtttttaaaatatatcttacagaagtcagaggaagatatagaaggacaggaatatactcaagatacaatattttcttctactgtactttttgttacatggaacagaattttagcattggatcccttcagctgtgacaaaggagaaggtccatggttataaagttttccattagactctcctcacacacaggaaatgaacttccataaatttaatgatatgactcttagggttttatttctcccattttataaccctctttaggatagaaacacatttcttgcactataaaaattttagtcagcaaatttttcatattctcactgggatttcataatcagtctgtacacccttcctatgcaataacttttgatcagtatagtgaaatataatggtattatgtaattttaagatgtacatcttaaagacaaaaaaatatccctttatttaattcaagataaataaatcagtgaggaaaatgtatggtgaaaagtttgggcatatattagttatctttcaatatatttttcatttttttctttttatttccttcaaccatatgatgcaatcaacggatatttgttgggtgctttgatgttttcagatctatgctatgcactacaagggtctcaaaaaggaatgaagaacaaagtccctgctctcaagaatgtagagttttccatacaaggttctaaaaaccattaaggtcacttaagatatcagtcagaaggtgaataggatgatgttcctggatgcaaattttagaaatgtggcatactaaaatcttcccctggaacttcaccattcacacctaagaagttaaagatgtctcagtaggttctcactatgttgtctaggcaggtctcaaacttctggcctcaagagatccctataccttggcctcccaacgtgtggaggttacaggcataagccactgcacctgacccattttctccttctgaaaactcttttggattttaggataccatgttctttggattcttccctgcttactctgaccttccttcttgaccctcactgtctcttcctcattcgcagggccacttctccttagcgaccccaacacaaccaagtctcaaaattggacatctgatatatgtgacaaagatatgttttcatttatataaaatgtgaatagaaacttacatacacacacacaaacatacaaacacacacacactcacagtgtctcagaagttctgcaacaaagaaatacagttattgtcattgaacccagaactccctaagtgtttttgacagagcaactttttcttgagacagatctataaaaatctcttgggatagtggtgttctatggaaaacagtctggggaatactgaattagagaaccgtgtgagacattttattattaacatgcaaactcaaagtactgaaagtgtagagaagagaaatatcattatgatctagacgggtgaagaaaagaatctcaaaggaggatagacttttaaagaaataagtgaaaaaaaaaacagaacatgtgatgaggagggggaaattcagattatatctcccaaattgatgatattgattatttgaaagaggaaggcaaaggtgtagacaatgattattagggactttgactttctaagttatacatttctatattgtttatgtacttgtttttacaaagttttacaaatgttttatgaagtggcttattcttataatccagagatattctcctaaaactaactaaagtttatttatcagattaactaatgatgtgtatagctcttacttccacaattatccatatatacatatatgcaatatttacaaacatagagatgtacaaatataatatctcggccaaaaataattgaagcatcaaagtcaacctacattgtaatcttgggcagcacctgttgtttattcatctctcaagtgtggctgacttcagggatgagaataaacaatgtgatctcttactaagcttccctttggactagtcatccaattggtatgtgatgactttatacctgaaactaaggagttgaggaataagctgaaaatagccaacttgggtttcctaagtacagtttggcttctgtaagaactgtttggttgctcctcaatttcagtgtattcattttttaaagtatatttattttaaaagtggcaaattcaggtattacttaataattaagaagcatttatgcccaaacacaatatatgtttacaaccaaatttgaaagtaattgaactgataaccctttagacaaaggagatgtgttataataaatattattgtcagctttccttcatcttaagattttttgaatcttggaagaagatatgcatgaactttgtgttgggtatttataaatgtatacacatatatacatagcaaaatgtaagcacaatacaggtataacatgtaaggttagaccatgtaaacttgctgaaattcagttgtttctgacctacaataatggcaatttcatatggttgaacctaatggtttgtctcagtcattagttagtggtgcctcctcccctaggtagagttttccaattgtgttgggatggtattttcactcttgtaacattcccaacttgtatcagaattcccttcatcttccctcctctacttttatattattctattccgtcatttttctcctagatacgactggacagattgtttacttatagcagtccctatatgttaatccatttctttggtcaacaaattctcaaacatcagaccttaaaggtcaaagaaaatccctgtgttgaattcagtaccatgtatacagaattagtcaactattgcggctctttccctattatctatccctatttctgttactgttgatgttgtctgggagtatctaaacactcccaggaattcaggtacttaagaggactgtctggataacaacgtctggttatctgatgtcaacttctgaacctcttggcaggagtcctaaggcctgcatagaagattggctctaggacaaatgctatcaagaaaatattcccattgggtgcaggtggctcatccttttaatccaaatcactcaggaggctgaggtgggaggattccttgaggccaggagtttgagacctgcttgggcaacatagcaagaccctatctctaaaaaaataaaataaattagcagggcatggtggtgtgcactagaagttccaattactccagaggctgaggtgaggggatcacttgagcccaggagttcaaggctgcagtgagctgtaatcacaccactgcactctagcttggatgacagagcaagaccccatctctaaaaatataataaaagacaaataagaaactagtcccccataattcaaacatgcttattactcactatgattacagatcaaaataactaccagcttcagtggattaagtatctaaaccttgatgtgattggccaatagtttgattactaccatgtgtgtattacatatgcacatgtattcaatgctgatacaataatctgtaaatagaaaagtgcaatagttttctatatgcagtttcagtagtaccaaagctaattaccagttgagaagaatttggctttataagaggtaagccaaaagaacaaagctggaggcatcacgctacctaacttcaaactatactacaaggccacagtaaccaaaacagcatggtactggtaccaaaacagagatatagactaatggaacagaacagagccctcagaaataataccacacatctacaactatctgatctttgacaaacctgacaaaaaacaagaaatggggaaaggattccctatttaacagatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcagggcataggcatgggcaaggacttcatgtctaaaacaccaaaagcaatggcaacaaaaaccaaaattgacaaatgggatctacttaaactaaagagcttctgcacagcaaaagaaactaccatcagagtgaacaggcaacctacaaaatgggagaaaatttttgcaatctactcatctgacaaagggctaatatccagaatctacaaagaactcaaacaaatttacaagaaaaaaacaaccccatcaacatgtgggtgaaggatatgaacagacacttctcaaaagaagacatttatgcagccaaaagacacatgaaaaaatgctcattatcactggccatcagagaaatgcaaatcaaaaccacaatgagataccatctcacaccagttagaatggcaatcattaaaaagtcaggaaacaaccggtgctggagaggatgtggaaaaacaggaacacttttacactgttggtgggactgtaaactagttcaaccattgtggaagacagtgtggctattcctcagggatctagaactagaaataccatttgacccagccatcccattactgggtatatacccaaaggattataaatcatgctgctataaagacacatgcacacgtatgtttactgcagcactattcacaatagcaaagacctggaaccaactcaaatgcccaacaatgatagactgaaatgtggcacatatacaccatggaatactttgcagccatataaaatgatgagttcatgtcctttgtagggacatggatgaagctggaaaccatcattcttagcaaactatcgcaaggacagaaaaccaaacatcacatgttctcactcataggtgggaattgaacaatgagaacacttggacacaggaagggggacatcacacaccagggcctgttgtggggtgggaggagaggggagggatagcattaggagatatacctaatgtaaatgacgagttaatgagtgtagcacaccaacatggcacatgtatacatatgtaacaaacctgcacattgtgcacatataccctagaacttaaagtataattttaaaaaagaggtgctaaatatgatctagtgagttctgtggcagacatttttaagtagaaacagggacaatgtcttgttatggcttcttgatggggtcaaaggctgtattgccttctagctaccggtaaagaaattctctaaccctaaccaacaagtgcctcagcccctacctctgcaaactgcagtcagtctgaaggcaatctgccatgccagaaagccagttttcagaatctccctttcagaaatctaatatggaaatagacagtcttgtaaagacttgcattatctatttactagtgaatagatgaatatctacttgccattaaatatagcaattaaccaataccagtcaacaatcattgagctgcttctttttttttctttatttcttctgaaaaaacaaatggaatacatgtgcagaacatgcagttttgttacataggtatatgtgtgccatggtggtttgctgcatctattgacccatcccctaagttttctcccctcaccccctaccccccaacaagccctggtgtgtgctgttcccctctctgtgttcatgtgttctcaatgttcaactcccacttatgagtgagaacatatggtgtttggttttctgttcctgtgttagtttgctgaggatgatggcttccagcttcattcatgtccctgcaaaggacatgatctcattcctttttaagagctgcttctttgtataagtgcctggtggttaacacaagtgcctagtaggtgttcaataaattgttcttccactaaattaaaaagagtaaaataaaggcctaatctcaggggcactataatcttctcataagaatacaatgtgtttgtataatgtttttatttcatcacctacataatcaaatcctatctacacacagcatgtattagacttcattttaccaatgaataaaattgaagctaacagtacatcagagatttgtccaacagttacaacctaggaagtagtgaaactaaactaaactctaggccttctaatgtgtaattcaatgatagttctaccaaatctccctggttcactaaatcaaactgaaaaggaaacgcttttggtaacagaggaaaaccatagccacattcactgatgtcccaaatgggttgaaaaatgagtcccactttctgcaataaatggccctcaattaataatttattggtcataggttacaggttatcatagtcatatcatattgataggcctataaatgttttaccattagtaaaaagaaaatttcaagatttgggagtcatgggaaatctttgcaccttcctctcaatttactgtgaacataaacttctctaaaaaaacctaagtcactcaaaagaaaaatatgggtcaacaatacttttttagagatgccatggatttttttgtcaagcattttgcaattttttttttactggagggaaaggattttgtagaaatcctttgaaaggctgaattattatggaaaataattttgaactttgagaacattaaattcctttgtttcccaaagctttgtggcaaaaaagagatgctctggaaaacttttcaagcacttagaattttacagtgatgtaaaagttgtctgatacctattatgagtaatagtacctggttagttttctattgcttttctttgaattacggttttccaccaagcaacattaaacaggaaagacaaagatcaaatactcttccgatcaactgatgctcattttatctaatacaaatgacaaaaagggaatagtaaagaacagaaacagtttttctgtcacttgcaaaatagtattgggaacttagttctgccaaagaaattaagaaatatgtgacatctctatctgcctttatttttcctttggttatttttgtatttaacgagacaaaaacattcaacagtgtacataaacttttcccacattttaaatttatttttgaatgataacctttaaattcacaataagttctgacataaaggtacatttatgatgggccctttatcatgagtacctgagtaggaggagacatacactgaaaactttgctgggggagaagtaacattgtcttgccagatgagagtggaaatcacattttagccctttgtaatactctaaaccgagggttagtaacctatggaccaaatccagctttccacttgtttttgtaaataaagtttaattagaacataattacacctattcatttacagtttgtagctgcttttgcactacaactgcagtgctgagtagctcctagagagaccatatggctcacaaaatctaaaatatttactatctggtcatttacagaaaaagtttgtccacccctgctataaatctttctctcttcccttcctctcctacagatggcaataactagtggcaaaaaaaaaaaaaaggcctagactctcttatggcaagaagtggaaaataacgcattttttctggattgtgcaggtgatacttctgggtccctgccagcctcgtgcattttcaagggcctaggaatcagaaaccatttctgactctttgacagcatagccctcctcccactactctctaaatagaagcattgacatcagagtatcctaaaacaaccaaatatgggacatgtttatttagtgcatccctgtcagcttactaattagaaaactgagttatgtttctcttttaaaaaataggacaggtgcccatgaaaactgaaaatttaggccaaactatctatgctaataacactttctacttttttttttttttagatggagtcttgctctgtcatccaggctggagtgcagtggcaccatctcggctcactgcaacctccgcctcccgggttcaagcaattctcctgcctcagcctcccaagtagctgggactacaggtgcacggcacacccggctaattttttgtattttagtagagacagggtttcactgtgttgcccaggctggtctcaaactcctgagttcaggcaatctactcgcctcggcctcccaaagtgctaggattacaggcgtgaaccaccactcccgaccctaacactttctacttttacatctcccagcgccatttaatatgttttagtttcaactatgcacctaaaacagtaataacaaaatttaagtaaacatctctagaactttcagtgaaggataaaatatgttaggtaaagccacatttttgtctttcttcttatcctcctaatgtgtttctacctacataaaatcatcaacttcaatttttttttttggtcacaaaaaaaagcttgatgcttatatacatagcagcagcaagaaaaaaaacataccttttttctttacttaccagaccccagaggagtgactacagctttaaagctgactgtgaatatatttttggagagaggaagtttgtgttgtctagtgtccatcgcttgccaacttttctgatctataaaatacttcagtgacttcacacactgatgctggctttcagctttcttttagctctggtcaccaagagcaacaagtgccattgtaggtcaatccctagagaaacatctgtcttctctattccttgggcaggtactttcatgtgtagtagtttcagagtttatggttatttctctctggagaccatctgtctgctgggtttattttttcctgatgttgtaccacatcataaagtctactgccaagagtactttactcaagaagattttgttttctgctgttttagtcacttcactgctttatttctgtaagccaaatcaagtggacaaaatcagtagcaattccccactccacggccctgtagcataacctggctcagtttggttgcaagttcttatgactgctttaaaacattctcctcacacaataagtgatgggtcctcttgtatatacgtgtaacaaagagctgcactgagattttccatgaaatgtgaatgcgctcagaaagcctttccaagttttttaaaacaagtgaatcatgtaggtctaatcagttgaaagtaaccaaattcataattgatttttattagcaaatatagtactttgaaatagctttttatgctgcatgacccaaggttaacaaaaaaatagctttttgtttccagggaaaaataagtttaagcttatttttatcctttcttactttagttcccaataatcatacttaaataaatgtactccagagtttctatttttcattttcagataatgtaatggttattatcatatagtcatagaaaattgcaatggttaagtcattatttgcctaataaatttacaacctttttacggaaaaatgattccggccagacaaatgttgtcaaacaccttttaatgtgttttcaacctttgtcatagctcactttcttgcataaacagagccttccaaacaaagcatggaaaatttaaaccacatagattcgtattatcaaaactattacaccggattattttccatagtgtcagcattgacattaatttcttgagaagataactttaaaaggaacactcacatggattttacaatgtctcttcctcacccttacaaataacttttattcattcacggctataattagcacttcctgtaaggcagcccttttctcggttgtggatgggcacactgtgaattcattagcatggtagccaggtcagcagagtcattagtggtcattttaatgatgacttggaaaccctgcctggtcaatttaagtgaggctcattcccatgtactgactgcagccaagcagcttcacaatattacccatttatttaggcagcttcaaatagtttcccaggaactggagtaacaagaagctgaatgcagaggtctgtgtgtcaagaagtttccatgactagtgaaccctgagcacttctctgtacacattcaaacccaactcttacattcattcttcaaatgggtttgcttagaccaagccagattacttgagcaccttaaattttgctgggtattgtttcatgttttacatttataagtgttttgcattttaagcagggattttatataataaaccaatataattcattgtcatcattgttatccatgttagcgaaaacttgtaaaattatgtagcaattatgtgtcaactggcatttttaactctctttggtatttatttatttattatgttaaaacacagattctcattttgaggctatctcattttattctcaaaacaatactagaggagaagtagtgaggatgtggaaaggaagccatgtacctgggacacaaagagtatgagcttggggatcagctgacatctgacttgcagactgtggctgcaggcaggggaagtagcacacaaaagcatcaagtttcattattatatcatgttattatgttacagcatgatattgtgcaggaaacagaaaccagccggacctgcctagaaggtctatctggagaaatggaagaattaatgttcttgtgaggatcttaaaagccagatgaatgagtctggatgtgatagcaagggaaaggaaccataagttttaaaacaaggaattggcatgataaaagcagttccatagaaagcaggggccggaagacctatgcaggctgaattccaaatgcaccattgctttggcttgatgactttaggggtttgggggtttcacttacaaattcagtaaatgtcaccttttcagtgagagagaccttccctgaccactttgtccatacgttcaactctccccgcttctgcatcctatctatcctctttctctgctatttttttctccttagcagttatcactttcaaacacagtatgcattttatgtaataatacgttgtttatggcccatctttcccgctataatgtaagttctgtaagggcagtgattcttgtctatttattcactattataccttcagcacctagaacactgcctggcacatagtagcccctgaatactacatgttgaatgcgtcaatgaattgattagtacctgtaccaagtcctattcttgatactagaaataaagtagttaataagatacacaagttttctgttctcatggaggatacattttagtagtggataccaaaataaacagagttgtaattccaagtggtgctgtttgctcagaggaaaatataacagagttaacaagaatatcaaatatcaaataaatgctctcctgttgcacacattgaatatataacagtcgaaaaggctgtttttgtttccagttttgaattcattattcctgaacaatctacactggttttttatcacagttatttttcctggaaaagacacagaaacagcttgcaaaagcaagaacctgactgtgatagatttctaaattgtagatcttattccattcagcaagatcattcccagtcattccattcagccatgaactgcatgtcccatctactatgatggaaaacatccttttcaactgctatcaagaagcagagcctttttatttattttgacaggccaatatctatttggttctttccacactgaatgagtatcttcaagaaactcagacttctgatagggactcagtgatgagacaacaattaagaagaatctggactttcccattccaaagcctcttctcaaggcagttgtgatccttttaaaaaacacagactaaagtaagtggacagaataagtacatagataaagaaacacagaagttaggaacacaatttttttattatactttgagttctagggtacatgtgcacaacgtgcaggtttgttacatatgtatacatgtgccgtgttggtttgctgcacccattaactcgtcatttacattacatatttctcctaatgctatccctcccccatcccctgaccccacaacaggccccagtgtgtgatgttccccttcctgtgtccaagtgttctcattgttcagttcccgcctgtgagtgagaacatgcagtgtttggttttctgtccttgtgatagtttgctcagaatgatggtttccagcttcatccatgtccctacaaaggatatgaactcaaccttttttatggcagcatagtattccatggtgtatatgtgccacattttcttaatccagtctatcattgatgaatatttgggttggttccaagtctttgctattgtgaatagtgccgcagtaaacatacgtgtgtatgtatctttatagtagcatgattataatcctttgggtatatacccagtaatgggaatgctgggtgaaatggtatttctagttctagatccttgtggaatcgccacactgtcttccacaatggttgaactaatttactcccaccaacagtgtaaaagtattcctatttctccacatcctctccagcatctgttctttcctgactttttaatgatctccattctaactggtgtgagatggtatctcattgtggttttgatttgcatttctttgatgaccagtgatgatgagcattttttcatgtgtctgttggctgcataaatatcttcttttgagaagtgtctgttcatatcctttgcccacttcttgatggggttgtttgatttttttcttgtaaatttgtttaagttctttgtggactctggatattagccctttgttagatgggtagattgcaaaaattttctcccattctgtaggttgcctgttcactctgatggtagtttcttttgccatgcagaagctcttagtttaattagattccatttgtcaattttggcttctgttgccattgcttttgatgttttagtcatgaagtcctcgcctgtgcctatgtcctgaatggtaatgcctaggttttcttctagggtttttatggttttaggtctaacatttaagtctttgatccatcttgaattaatttttgtataaggtgtaaggaagggatccagtttcagctttctacatatggctagccagttttcccagcaccatttattaaatagggaattctttccccatttcttgtttttgtcaggtttgccaaagctcagatggttgtagatgtgtggtgttatttctgaggcctctgttctgttccattggtctctatctctgttttggtaccagtaccatgctgttttggttactgtagccttgtagtatagtttcaagccaggtagcatcatgcctccagctttattctttttgcttaggattgacttggcaatgtgggctctttttttggttccatatgaactttaaagtagttttttccaattctctaaagaaagtcactggtagcttaatggggatggcattgaatctataaattaccttgggcggtatggccattttcacaatattgattcttcctatccatgagcatggaatgttcttccatttgtttgtgtcctcttttatttcattgagcagtggtttgtacttctccttgaaaaggtccttcacatccttgtaagttggattcctaggtatttcattctctttgtagcaattttgaatgggagttcactcatgatttggctctgtttgtctgttattggtgtataggaatgcttgtgatttttgcacatggatttgtatcctgagactttgctgaacttgcttattagcttaaggagattttgggctgagagggtagggttttctaaatatacaatcatgtcatctacaaacagcgacaatttgacttcctcttttcctaattgaataccttttattgctttctcttgcctgattgccctggccagaacttccaacactatgttcaataggagtggtgagagagggcatccctgtcttgtgccagttttcaaaggaaatgcttccagtttttgcccattcagtatgatattggttgtgggtttgtcataaatagctcttattattttgagatacgttccatcaatacctagtttattgagagggctgttgaattttgtcaaaggccttttctgcatctgttgagataatcaagtggtttttgtctttgattctgtttatgtgatggattacatttattgatttgcatatgttgaaccagccttgcatcccagggatgaagccaacttggtcttggtggataagctttttgatgtgctgctgatttggtttgccagtattttattgaggattttctcatcgatattcctcgggatattggtctaaaattctctttttttgttgtgtctctgccaggctttggtatcagaatgatgctggcctcataaaatgagttagggaggattccctctttttctattgattggaatagtttcagaagaaatggtaccagctcctctttgtaccgctggtagaattcagctgtgaatccttctggtcctggactttttttggttggtaggctattaattattgcctcaatttcagagcctgttattggtctattcagggattcaacttcttcctggtttagtcttgggagggtgtatatgtataggaatttatctatttcttctagattttttagtttatttgcagagaggtgtttatagtattctctgatggtagtttgtatttctgtgggatcggtggtgatatccccttttcattttttattgcatctatttgattcttctctcttctcttctttattagtcttgctagtggtctatcaattttgttgatcttttcaaaaagccagctcctggattcactgatttttttgaagggttttttgtgtctctaactccttcagttctgctctgatcttagttattccttgccttctgctagcttttgaatgtgtttgctcttgcttctctacttcttttaattgtgatgttaaggtgttgattttagatctttcctgctttctcttgtgggcatttagtgctataaatttccctctacacactgctttaaatgtgtcccagagattctggttgtgtctttgttctcattgctttcaaagaacatctttatttctgccttcatttcgttatttacccagtagtcgttcaggagcaggttgttcagtttccacacagtcatgcgattttgagtgagtttcttattcctgagttctaatttgattgcactgtggtctaagagacagtttgttgtgatttctgtccttttacatttgcagaggagtgctttacttccaactctgtggtcaattttggaataagtgtgatgtggtgctgagaagaatgtatattctgttgatttgggttggaaagttctgtagatgtctattaggtctgcttggtgcagagctgagttcaagtcttgtatattcttgttaaccttctgtctcgttatctgtctaatattgacagtgggatgttaaagtctcccattattattgtgtgggagtctaagtctctttgtaagtctctaaggacttgctttatgaatctgggtgctcctgtattgggtacatatatatttaggacagttagctcttcttgttgaattgatccctttaccattatgtaatggccttgtgttctttgtctcttttgatctttgttggtttaaagtctgttttatcagagactaggattgcaacccctgcttttttttttttttttttttttgctttccatttgctttgtagatcttcctccatctctttatcttgagcctatgtgtgtctctgcatgtgagatgggtctcctgaatacagcacactgatgggtcttgactctttatccaatttgccagtctgtgtcttttaattggggcatttatcccatttacatttaaggttaatattgttatgtgtgaatttgatctgtcattatgatgttagctggttattttgcccattagttgatgcagtttcttcctagcatcaatggtcttcacaatttgacgtttttgcagtgtctggtaccggttgttgctttccatgtttagtgcttcctttaggagctcttgtcaggcaggcctggtggtaacaaaatctctcagcatttgcttgtctgtaaaggattttatttctccttcacttatgaagcttggtttggctggatatgaaattctgggttgaaaattcttttctttaagaatattgaatatttgcccccactctcttctggcttgttgagtttctgccgagagatccgctgttagtctgatgggcttccctttgtgggtaacccgacctttctctctggctgcccttaatattttttccttcatttcaaccttggtgaatctgacaattatgtgtcttggggttgttcttctcaaggaatatctttgtggtgttctctgtatttcctgagtttgaatgttggcctgccttgctaggttggggaagttctcctggataatatcctgaagagtgttttccaacttggttccattcgccctgtcactttcaggtacaccaatcaaatgtagattttgtcttttcacatagtctcacatttcttggaggctttgttcatttctttttactcttttttctctaaacttctcttctcacttcatttcattaatttgatcttcaatcactgataccctttcttccacttgatcgataaggctgttgaagcttgtgcatgtatcacatagttctcatgccatggttttcagctccatcaggtcatttaaggtcttctctacactgtttattctagttaaccattcatctaatcttttttcaaggtttttagcttccttgtgatgggctcgaacatcctcctttagctcggagaattttgttattaccaaccttctgaagcctacttctgccaacttgtcaaagtcattctctgtccagttttgttccattgctggtgaggcgctgcgatcctttggaggagaagaggcactctgctttttagaattttcagcttttctgttcttgtttctccccatcttcgtggttttatctacctttggtctttgatgatggtgatctacagatggggttttggtgtggatgtcctttttgtggatgttcatgctattcctttctgtttgttaattttccttctaacagtcaggtccctcagctgcagatctattggagtttgctggcggtccactcctggcggtccactccagaccctgttttcctgggtgtcaccagtggaggctgcagaacagcaaatattgcagactagcaaatattgctgcctgacccttcctctggaagcttcgtcccagaggggcatcgggctgtatgaggtgtcagtcggcccctactgggagctgtctcccagttaggctacatgggggtcagggacccacttgaggaggcagtgtgtccattctcagatctcgaacaccatgctgggagaaccactgctctcttcagagctgtcagacagggacgtttaaatctgcagtggtttctgctgccctttgttcagctatgccctgcccccagaggtggagtctacaaaggcaggcaggccttgttgagctgcgtgggctccacccagtttgagcttccaggctgctttgtttacctactcaagcctcagcaatggtggatgcccctcccgcagccaggctgccgcctcacagtttgatcttggactgctgtgctagcagtgagcaaggctccataggcgtgagacccatcgagccagacatgggatatactctcctggtttgctgtttgctaagaccattggaaaagcctagtattggggtggcagtgtcccgattttccaggtacagtctgtcacggcttcccttggctaggaaacggaaatccccccaccccttgtgcttcctgggtgaggcaataccccgccctgcttcagctcaccctccatgggctgcacccactgtccaactggtcccagtgagatgaaccaggtacctcagttggaaatgcagaaatcacccgtcttctgtgtcgatcacactgggagctgcagaccagagctgttgctattcggccattttggaaccaatcccaacaattttttttaataacagtaaaaacaagaaattcgaagccctggagagggcctataagaaaagcaagaagtcaggcacagtggctcacacctgtaaccccagcactttgtgagggcaatgcaggaagatcacatgaaatcagtagttagaccagcctgggcaacaaagtgagactgtcactacaaaaatttttgtctaaattaacctggcatagtggcatgtgctggtagtcctagatacttgggaggctgaagcaggaggattgcgtgagcccagatgttcaaggctgcagtgagctatgatctggccactgtacaccagtgtgggcgacagcgcaatatgttgtgacacatgcaccaaaaaaaagagaagcaagaaagaacgtaggaagaaatcaatcttgttcacccagaaattctccaaagaactcagattttttactctgtgtttttaaatattgagaaaatggaaggcatgtaactaacagcatatttttaacagtttaaaaaaccacagtcatcaagagtaatttcagatgagctgaaaaccagataaaccacaacattcccctgtccccaaaaaggacttttttaaattacaggaatagaaaagaaataatcctacttgttggtggtcagtattgttacagtaacaccaagagatcagagctatgaaaatcctaacctcttcctaattttccatcaaaaagcctgattttccaccacagaatgcaaatgaaaaccacaatgatatttcatctcacactagtcagaatggctagtattgaaaagtcaaaaacaacagatgctggtgaggctgtggagaaaacggacaacttatatcctgttagtgggaaggtaaattagttcaactactttggaaagcagtttagagatttcttaaagaacttaaagcagaaaactaccatttgacccagcaataccattactggctatatacccaaaggaaaatagatcattacaccaaaaagacatatgtactcctgtgttcattgctgcactattcacaacagcaaaaatatggagtcaactagctgcccatcaatggtggatcggataaagaaaatgtggaggctaggtatggtggctcatgcctgtaatcccagcactttgggaggccaaggcaggtgaatcatgaggtcaggagttcgagaccagcctggccaacatggtgaaagcccgtctctactaaaaatacaaaaaattagccgggccttgtggtgggcacctgtaatcctagctactcgggaggctgagacaggagaatcgcttgaacccagcaggcagaagttgcagtgagccgagatcgcaccattgcactccagcctgggtgacagtgtgagactccatctcaaaagaaagaaagaaaatgtggaacatatacaccacggaatactacacagtcataaaaaagaatgaaattggggtcacagtggagcaggctctcatgtggaggtggggaagtttggtccatcagaatgatcaccaagaaacacaaagcagacctgggccctgggctcccagagaagaaaaagaagaagaaagtggtcaaagaaccagagactcaatactcaattttaaacaatgatgattactttgccaatgtttctcctataagagccacatccccctctaagagtgtggtccatgggaaggcacctgagatgcctctagtgaagaaaacaagtaaaagaagggtgtcagcaccctttgtgaggagcacgtagaacctgacaccacgctgcgtgccagacggtcagagaagtcacccaatcccaggaagcaggtgcttggccatttggagttcctctgtggggagaagaaaaagaagaagtcacctccagccatgtcccatgcctctggggtgaaaacctccccagaccccagacagggtgaagaggaaaccagagttggcaagaagctcaaataacacaagaaggaaacaaagggggcccaggaccccacagccctctcagtccagaacccttggttctgcgaggctggggatgctgcggacacttgctcagtggggaagaagggtgaggaacaggcagccttggggcagataacggaagcagaagagccccagggagcacagtgggaaggtgaagaagaagaaaacaaaaatccaccaggagggagatgccctcccaggccactccaagcccttcaggtccatggagagcagccctaggaaaggaagtaaaacgaagccaaagttgaggctccggaatacatccatccccaaaggagatggccctaaggcccccgagaagaaaaagatgaagtccaagaaggtagagcagccaatcattgaggagccggctctgaaaaggaagaaaaagaacaagaggaaagagagtggggcagcaagagacccttggaaggaggaaacagagacggacttagaggtggtgttggaaaagaaaggcaacatggacgaggcgcacatagaccaggtgaggcgaaaggccttgcaaggagagatcgatcgagagtcaggcaaaacggaagcttgtgaaaccaggaagtggacgggaacctagtttggccagtgggatactgctggttttgacaacgaggaacagaaactgaagtttctcaaacttactggtggcttcaaaaacctgtccccttcgttcagccgccaccccctccaagccccgcagcacgattgcaaggtccaacatagccctcagcaagaaggcggccgacagcctgcagcagaacctgcagcagaacctgcagcaggactgtgaccgggccatgagctggaagtacagccgcggagcccgtctctgcttctccaccgcccccaacaagatcttttatattcataggaacgcttccaagttagccaagctggaagattaaactctagagttttgtcccctcaaaactgccacaattgctttgattatcccatttatgctggagattacaagttttttttggtgaaaaatcagatcttggtgatgaccttgagcagtaggatataaataactcccataaacttagcgttccaataatggaacactaggcataagtgggttattcagttgtgctgatgaaagccatctgacagttggctcacattgaacacctgtggagactaaggacaaggacaaggacaactatcttgatgggcttggatgaactggggagaggcagctcatgtttggggagccaggagaacaagtgagtggctaaaacctcctgttttctgtgttaaacattccgtccctgtttgagacatcaatgtgtacagatgacctttgttgagtgtttagcaggtgctaggcacatactagtgttttccttaatgtatttaatcttcataattatgaaatgggtgctattattatccgcatcttatagatgaggcaaaggaagttcagggataaagtaataaaatgccctgggatcacccaaccactaaaaacaaacaaacaaaagaatgaaatcatgtcctttgtcccaacatggatgaaactggaggccaaagtcctaagcaaattagtacaggaacaaaaaaacaaataccagatgttcttacttataagtggatgctaaatgttgagtacccacggtcgtaaacatgggaacaatagacactgcagactactagaggggaggggaaggagaagggcgtaggtcaaaaaactacctactgggtactgtgatgactaccagagtgtaatacccatgtaacaaatctgtacatgtaccccctctatctaaaataaaacttggggaaaaaaagcatgattttcttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcgttgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcatttgggtatatacccagtaatgggatggctgggtcaaatggtatttctagtcctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatgatagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtgtggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgactttctcttttcctaattgaataccctttatttccttcttctgcctgattgccctggccagaacttccaacactatgttgaataggagcggtgagagagggcatccctgtcttgtgccagttttcaaagggaatgcttccagtttttgcccattcagtatgatattggcggtgggtttgtcatagatagctcttattattttgagatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggataagctttttgatgtgctgctggattcggtttgccagtattttattgaggatttttgcatccatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcaaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgagtttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctggagatgtctattaggtctgcttggtgcagagctgagttcaattcctgggtatctttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcatcagttgatgcagtttcttcctagtctcgatggtctttacattttggcatgattttgcagcggctggtaccggttgttcctttccatgtttagcgcttccttcaagagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggttgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttgattccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggttcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagctgcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgctttggctcgcgcacggtgcgcacacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcctcccatgattttctttttttaaactaaaagggatttttaaaaatatgattaagaaacagtgaaaatatgagatgggaaaattgttggctattaataagttcatatttttgcatctagctttgtatcataaggtatcaaagtatttgaagatgaaactgaagaactttcattaatagtttctcataatattttagcttttatttatgtacaggagtatgataaattttaaaaaatcttgaaaaaatgtgatgaatgccaaatgaccagagagagaaaaaatatcctgagtgccaaaaaggagtaaaataggaggccctgggctttgtatattgataagctcaataacaattcctagaaatattctagatagaatattaagcaaatgatttataataaatttgagggccaggcacagtggctcatgcctgtaatcccagcactttgggaagccaaggcgagtggatcacttcaggtcaggagttcaagaccagcctgaccaacatggtgaagccccatctctactaaaaatgcaaaattagccaggcatggtggtgcacgcctggagtcccagttacttgggaggctgaggcaggagaatcgcttgaacccaggaggtggactttgcagtgagctgagattgcgccattgcactccagcctaggcaacaagagcgaaactctgtctcaaaaaaaaaaaaaaaaagggaaagaacaactatcattcctagaaaataacataagttcatcaagagtaaaaaaattacattaaataatgcttatttcttattttgataggttaaccagattgctacatcaggggaatagagtagataaaatgtcttgatttcagcaaagcactgataagtgctttataatatctttgagggaaacaaagagaaattcaggtaagatgatagtcgtgggagaagaggtacctgataggggtgctccaaagtcaagatatggtgtttgtaaagaaattcggaagataagggtaaaacattaggaggttcttgtttagggagtgggtagttcatgctaggaataaatgaatcaagattaccatagtaatatgtaaatgtaacaaatataaagactttccagaaatccaagtgagcaaaatctattcattttcatttaagttcaatttgaatcaatggcgtcatttagttcttttaaaaaaaatgcaactttagattgaatactcccatttcaaagaaagagtagtaatagacaaaaacacatctttacggcttttgttacttggtcaaatatatcctgaataccttgtaacgtgcagaaaacatctgtggctgcttacataatatatgcggtacaagtggataaaaataagcaaaagtttgtcttcccatttaactgaaagccctgatgaggacacagactatgcctgagttcccagttcctggtacaatgtctgtaaatatttgtgattgatataatacagtgaaagtaagataatgatagaacagtgcaaagaaattgggaatgaagttaatccataaaaatgtataccagaaggatctgggacactattactatttgtaatgtgggtcccaaattcacctttgagcctcttggcatccaaggcaaggaaacaaatatgttaaaagatcacagtctccgaaacctaaaacttcatcccttttgccagaagcaacgtgttaatagatttttcttgcaataaaatcctgagagaaatttctcacaggatgcctcattgagcaaatacaatgtgaaatagggagaaattcttaaaatacggtaagctggttaaatgctttttactcctagttaaagtaattcctttagggaccaaagaagtagggtccaagtacacagattgccagtggtcagctttgctccaggccctgtggtgtggtaggaaaagtacaacaaattaagtgattgcatatacttgagacagtcttttttgaaaccaaacttttgctgtagctgggcagtatccagtttgaatctgtattccccagcaagaatggacaatgcagatatttactgttggtgattaaatgccaattcttttgcttacactgaagaatgagaatgagtctcagtcccactttgagggatgtaacaacaaactgggcaaacgtaaagaacagtgacaaggagaatgacacgtcaggacataatttcatatacaaagtaggcagcaaactgggctcggtatattgaatctgaagaccaacagggaagtcatgataaaaccaacctcaaacatctgaagaactctcttagggaggaaggagcacacgtcttctgtggtccagatcctgaccaaggagtaaaggtcccagacaaggagagcgaactcaggagaaaatcaatttccaacggtagagctgtctgtaacagggctatgccgccgtaaaatgatgggagggtcctggatgctggaggggtttagagagacactgcacaactgtctatcagtgatgtttcaaaaataatccctgtcctcaaagggagactgaatcagaaatccttctggccacacgaatttcctgatcctgaggtgagaaggcatgctccatgtctgtctacgcggagtccactgactgctctgagggaaacctcttgaactgtttatgggttctgttgccatctcctagcttttttacattagccatagtcctttaaagaaatactctaagcaagcagaaaccacagtttcccataccctccaatttcctcttaacatcccacatgtaaaatgcaatatttcattctttaaaaactgctcgctgatgacgatatttttaaaacttcacaggccgggcacagtagctcatgcctgtaatcctagcactttgggaggtagaggcgggcggatcacgaggtcagaagatcgagaccatcctggctaaagtggtgaaaccccatctctactaaaaatacaaaaaaaaaaaaaattagccaagcatggtgatgggcacctgtagtcccagctactcaggaggctgagaaaggagaatggcgtgaatccggaagggggagcttgcagtgagccgagattgcgtcactgcactccagcctgggtgacagagcaagactctgtctcaaaaaaaaaaaaaaaaaaaaaaaaaaaaattcacagagatttcagtgatagtatttattgattagggtctttgttaatatttaaggttcattgcacttgaaaagcagaatcgtgcagtgttctaatcaattattccaaatcaccgttaaagacactaaaaatgtcatatttaatttttattgctttgcagtggaagctgaggcatgctctgagtagatcccaggtgccaaatgcacttctcttatggaaacattatgcataaaggatattttgcaaagtaccaagtttagaaagaaaggtaaatttaggatgctggaagaaagaaatgactccagtgcttccctctgctgatgaagttttgatttcattaggtggcctgtcctccaggcaaagtgctgtgccagccagtggggtcagctatagtctctaatgtcagcaggcatactccagtcatcataattcatgaaatgctctcaaggtcccctgtcaaatgcactgaagatcatacttcatcaaagcaatacttaaagtttatgaaaagtcagaagcagggttgaatttcctttggaagttatttctgaagaattgttttcttaaaatattctatatcttcttcctgttagcatcttttatttcaatcctatggttccattccatttaaaacatttaagggccaggcacggtggctcatgcctgtaattccagcactttgggaggccgatgcgggcggattatgaggtcaggagatcgagaccatcctggctaacacagtgaaaccccatctctactaaaaatacaaaaagcattagccgggcttggtggtgggtgcctgtagtcccagctactcaggaggctgaggcaggagaatggcgtgaacccgggagaaggagcttgcagtaggtcaagatcacgccactgcactccagcctgggcgacagagtgagactccatctcaaaaaaaaaaaaaatttaagatctcccctccctcaaaactttcttaatgagtataactaacttacatgggccattatgccatggaacacttacagtctgccaaaatgcttgcagagagcacctgctaggtggaaatgtgtggttgcttcaatcagcaaagcctactctgttgatttgactgttgtatcatgctaagttcagggagatgtctactttaaacctcagctccatttctcctttcttcattgcatcattcacaattgtttgtgagtacctggggattgtgtgtttgtgtgaatgccaatagggtaacttgccatggttcgttcagtagagcttttctgaatgttttattttcacatcattttcattcttgctaaatgaatctgtgcttgatgcactagttctggaagctagacattatctgttatacaagcacccatgagattcccaagtcaagctttttgtcaaattaaatctaacaaattgattcttaattaacccacaagaaaggctgatgatagttttcttgagtaaacatagagtcctttgagttggtaatatttaaattttttataaatttccttctttttctcttacaataatcagtgccttccaaataagttttggataaaagatctagatcaaaatgaatttcctcagaaacaaaatataaatgactgtttcaggcaaaataaaggccaatagctgttccagactaattttgaaggaatatccatcttatgatacctcaggattaacgtatacatggaaaaacattcatatattttaaactcatcataaagctgacaggtgcaaaactgggccctcttccagccccgtcttaccaattctcaattacagatgtcttaatttttatgtgtgccatgggcccttcagcaatcttgtggaaactatgaaccattcctcaaatatatgtgactacaaaaggaaaaattatgatgaaatctattattaaaacattacacaaatttgcaatatggcaatgcatatgcttctttattaaaaacaacccctagcagtagggctaatagctacataatcttgaaatgatgagcaaaatcaatattcaagatgaaacaattatggtttcatctacaactgtaaaatgagattttaaaatctgtgatttttgtgagcaacaaattcacaagtacggctaataccatcatgatctattgccatggttagcgaaagataaacacataaatatcccccctctatgttcactaccccctaaattttacacacagatcccctggaggaccgtggactctacattaggatagcctgagcccagtgactcttgccaccgcttctacttgtattcaaccactagagaggtgcgttggggtcatggtcagtaatcagcatgcatacatgcgcacaggatcctcagaagcaatagagtcagcaaaaccacacacacaaacctcactatgtcactgccaatcagcccaacatctgaacactgtcaccttacgggggtcactctgtgtcagttcagtgttttctccagccagaaagtctgcctctggcaatgataccaagagctaattcagagcagaatgtgttcattgttctccatgatgtcatttgccaaatgaaagaaatggttctagaatatcctctatgcttatttaccaaaactttatatgcttggtctgcactgtcaggataacatgttccatacatttactttttctagggggaaaaaaatacttccatatctccagctagaatttatagccgagatttaaatccacatttccacgtggatgtctaaaactggatttatcctcttctccccaaaaccagtttctccttctgactttgacttttcttctcctgacttgtacagtcatctcagactttccagccaccacacccgcttcccagactccactccccaatttacagcatcccttcagtctccctgtttattccattctcatttctactatgttcatttacagcctaacctagattcactgttacccttgttcctgcctctcactactcagatccattctatacacactgctgccaacttaattttcccagaaggcaactctgatgacccttttatcctgtccagaaatcttcaatggctccccattttctactgaactaaatgcagactctgccctacaagcctctcctccacttagctccagactcccaattcagccacctgtttcatcctgttctgcaaactttgataattctcgttccatgaaacaaaaggcaaatagtttgcctcattcattttctgacttgctgccttccacattttgtaccctccttctaggatgtgtttctccagaaatttctcttgttgaaaccttactcttccttcaaagaccatctcaaacaccatcttttttttggaacacttcttgatgtgctcccacctttcccaactaaatagaatccctccccactttcagcctctgtagcatttttcttagcacttatctgcctctgcctttcattctgatccaatgtgttcactttgcccacctcactagattttaattcctagtggtaagaatttgtagaccattcctgaaaatccatttttggcataggaattatttcaacacaattgaaaacatgtattgagtacccattgtagaaggcactgtaccaaaggctaccagctgtacaaggctaaattaaaacagcattcaaatattgatgaagaaggaactagcaataagatgtgtttcgagcacagacatagattataaaactgccattgggatgctcttgaaggaggaaagcatcttaatgattaaataatcccctgctcgcttttccaagtgttttctgggaaacctggacttggtggggaaagggagggaatatccagataagggctcctcaccagaggaggacatctatcactgtcatctgatgccacatcatcctcccaactaccttagtaatccctgtattttactttctcatttatagtttgggggtcaggtaggtgcactggattttgaccactagtttgcaaattttagtccattaggaccaacttaaaatataatccacagtatcctgaatcattagatgcatgaatcaaaagtaggatgatgccagacacactttgggaggctgaggtgggaggatcccttgaggccaggagttcgagaccagcctgagcaacatggtgagaccctgtctctacaaaaaattttaaaaaaaattagccaggcctgctggcctgcgcctatagtcccagctctcaggaggctgaggtgggaggatagcttgaaccctaggagttcaaggttaaagttacaatgagctatgaatgcaccactgcactctagcctggtcaacagaggaagaccctatttctaaaaaaataaaaatgaaaaataaaaaagcatgatgaatcattaacatcgtgtactaggttttttcactagcaggctctttcctcttggagccttctgtttagaatggcaacccctttcccctcagtttgaggagatagagaagtgtcttcctgagccgagaataccaccaccattctcatctctgatgcttattcagcacactgcatagaggcttagactacacagtgcttaggttctctttctgctacacaaccttggaagagctacaaatgttaattctcagttttcatatctgtaaaatggggattataataattttattccataaatttctggggataacatagagataattgataatgtaagaatgaggagaatgcatttaaaagggacttagcacagtgtccagcttgtaggaacccctctatgaatgttagtcattattatcagcatagaaaacatgttgggataaatataaagaaacaaggaataaatgtggtggggtcatctattgacccctgaatagtcaggggtcaacaaacatttctgtgggccttactgaccctgttataactactcagttctgcaatcatagcatgaaagcagccatagacaatacataaatgaatgactgtgactgtgtgctgataaaactttatttacacaaacaggcattaggagccagatttgtcctgtaggcataattaggcaaactctggctatactgcccaaaccctggcctttgggaacttccaatcaagtgtggtggtaagacttgtaagacttttcaggggaagcaaggaggagtcagggactaacttcaccatcatccagaggagcatagaaacttggtattttaagacagcttactatatgaatttcccagagaggaacacaagtaaaaaatatgacctagagcaaatagctcaggttttttttttaacactgcctttcaaaataagtaacttcaactttgaaacagagccttcccttttagtagacattttccttggaaactcagctcccgccttgatcctagaagttacacatttgtaggaataaaaatatctgtagattaattggtagacaatgcctgatcctgaattctgtttcttatccttatatatgaatagacagagctgagaagtcatttatccagcagtttgactagaaggaaatggaaagtgtatgggtagcagaggaaatcattcacttccttttctattcttattattaatatatgatcttattattaataatataaaggaatagcaaatgagaatccatgagcaatatcagaccatgaaaatgagccagtggctgagtaacaaccaattaggacacttgatagtttagcaaagttgccaaacaggagacagactcggctcctttgaacgaagagtgactgcagtgtggattccccagataggagagcaagaacatactttctgggcctctctcaggatcgttgtttgggaaggaagttgtatgggaaattcacaaactcttagatgctaacatttaaatgcagcatgccacacacacaaacccacaaacacaacctttttttcatcaataaaattgcagaggagccccatttgcacagtatatcacattgtattttaatatccaaaatggctagtcccttccagagtttttatgagttaatgtgtgctaatttaatgggcctggtgctttattcatttgaagcaagaaattaagtctgtgataataaggtaaggttcttatcagatttctctttttgttgttttacagttttctccttgtctttggttgcttgattttgtcagtgttttctaccatccctgagcacacaaaattggcctcaagttgcctcttgatcctggtaagtgaaacatgaacaagaacgtacatgaatgttgtataagaactgcctataacatttatactatgcatcttatcctacaaaaaaatcctatctaaaaaagagttactgagaaatataaaaatgtcaaagattactgaaacatttgcccaccaatttaacatgtagtcaatccttagaaatatatagaaatgttcaggattgctattacacagcaatatcttgtgttgtagatatatcataaatagaaggcaatattagaaagcagttttaagtatgtttatctatgctaataaacaaattatataagaagaatcagtatctatgaggcctctcattatattgtgaaagactatagagtagagagcattttccaataactgtaatttggcagtagctaaatataattggccaagaactatgaacatatggcacctcataagaaaatagaaggctccttcatgctcttttcaaccaacagactgcattatgagttttgctgctaatgcagttacctggtgataaattctgcagtttgctctgtttccattatgctgtcaatcctcaaccacacagaattgctcaattcactttaaaatggaaaaagaccccaagatatttttatcagaattattctgagccttttaagctctcatactttctattacaactaaactatagcactgtacactctaatcacatctgattgaaagtttggttcattttcaactattttgacccactcactttgtccaaaattatcagatttgacagtcttagagctatttgaatgaactacaaactggaacagctcactgtttctgtaaagcctaggggtatacagaagcagggggaggaaaacggtaagatggtttatgtgccctaataagcagaggttggttatgttacagcaataaatattgaatatgaaaaaattgttactaccacgaaggtggaaactgaaagatttcaactcatataacctgagagagggggcagatgcttttcctacctttgctttcagatggctagtttgtactcaaggttgctaagacatcatcaagtctttctgtgcaatatcagggagacctcattttgaatctgtaataaatctctctcaattcatttgcatacaaattgtgctccagcagcatattgctcatgttaaggttaccgtttcaaagcccaaggtagagaacagatagaccaaagagcacatcagagatctgttccatttgcaagctttccctttgggtagaaagtaggcttttaaccttgtctgcccttttgataacacaaatgatctgagcccaagggctaaggtatagctggcttttaggtccacatatggaactacaaccaggaattttagactgaaaatataaatctgatttttaaacttggaaacaaaaaactggatctactgcatgaccaatattaggaataaatcaatcattaggaatctcatgaaaagatttcttccagagccaggtcaaaaatccaaaatgttagatttatatcctccaaacctctgaaatataaattctgtcattgctaatgaatttctaaatagtccaaagaaacccatgtaatcacaaagtctaaaactgattagtatcttgacttttaaaacctgttaaatagtgaacaatggatcagagtttagtaactagagtgcatttagtagaaaataaaaatgtagatgtcagtcttgaatgctttctgatttagcaaggtggaaatgagttcctctatgcagatgaggcctttgttttgagcaatgtggttagtgctacagatatatattcgcagaaacctgttgcaacaaggctttccatagggagagggtttgttaatcctactatctttgtactatagtgatacattgtcaaagtatattctcaaaacctacctagaaatatgcagactgcattgcagagctaagattcacagatgaaattcttcaccaatgttttctccaaaatctttttatctggacacaaaaattcaaatactgtcttttactttttctttagcaatgaataaattaggaaagcattaatattttaattatttttcacaatgagttaacatagtatattataaaagttcaatcatttgtagaagatttggaaaagtcaatcattaagatgacaaatcttaatgatttaagtaatgtctcatttattaccttttaacatgtatttttgagacagttactatgatttcaaagtcacagaactcatagaacacgattctgattagcagtaaagttcccaagatgagacatatcgaaggaattaccatccaaaggaagaagaaggattatcattgaaatagtaaaaagcaatggcttttaaaatgcttgcaagaccaggcacagtgactcatgcatgtaatcccagcactttgggaggccaagacaggcagatcacttgaggtcaggagtttgataccagcctggccaacacagtgaaagcctgtctctactaaaaaacacaaaaattatctgggtgtggtggcatacacctgtaatcccagctatttgtgaggctgaggcaagagaatagcttgaacccaggaggcggaggttgcagtgaaccgggatcgcaccactgcactccagcctgggcaacagagcaagactccatctcaaatatgaataaaataaaataaaatgtttgcaaaaatgtacaataaatccacatttgtacacttttcgtgtacactgttgatgtataaagacaacaccagaggtgtacatttagaactatgtgtaaatcctatatcaagattgtgtattttttcataacttccatcccttttggtttttttaacattttaaaatatgttcagatatttcctacaattctatttctgtgcaagtgaaaggcaccgacacttgtgacagggagcacactacaggcaaacctggcttgtagacagagccctctttgacactcactcttttccacctaattgttcccttgagggcaccagcgtgttaggtgcaggccatccctttagacatctcttgcttgcctcctgggggcccccataaggactttcgctgtccatcccacatccaaaaaggaagtctcccctcatttccatccagaatggcactgccaacgctcttgtaaacttgtaacttcacaaacttgccttggttacaagccaaatgaatacctgtgttaatttgctcatttattcttttcagttgtgggaactgagatttcagcctatacaaccaggttccttatttctctccatagaagcagtggagcatagacttaagaatgtgatacagactatagtcgggctccatgaattcaaatttcactcctgtccaattttagctgtgcgacttggaaaatcactccactgtgccttagttgtcttatctgttaaaagtgaataggaggattctagaagaaagacagagtaggaatcaccaggattctgtctccccacctaaacaacaattgcactggcagaatttgatgtaattcaatggatggaactctggaatctattgaatgtttgcaacttacagaggaaggcttagatggtaagttgcagttaattttgtccatttcagctcttagcacagtgatagctacccatcccctacgcccaggcccattgcaggcagctgtgcacatgttccaggagggacctgaacacagcttataagagccaggatgggcaaaaagaactctgtcctccaaatatcagaaatctgacctcggatcactaattgctgcttctgatcacagaggcgcagacaaaaaatgtggcagccattgctgttgcaccttcacccattgctgtaagcccctcccctaccagcaaaagtgacttctaggggattaaaacgatcctccccacatccttcatttttcttttttccttttttggaatacagtgtataaagatgtaattatgtgacattaataactgaaaggtgtagggctagagatgtaaaggagcagagtttttgtatgccattaaagttaaactggtataaattcaaattagagtgttataactttaggatgttaatttaattcccatggcaaccacaaagaaaatagctatagaatatacacaaggagaagtgagaaaggaattcaaacatttcactacaaaaaaaaaatgaactaaacacaaaagaaggtagcaattcaggaaatgagagacaaaaaaagctatgaagtatatgtaaaacaaagagcaaaatgatgaaagcgtctccttatcattaattactttaaatgtaagtggataaaagtttctagtaaaagacagagattggcagaattgataaaaatacatcattcaactgtgtatatgcttagtacaagagacttactttagattcaaagacacaaatacattgacagtaaaagggtggaaaagatattttatgcaaatagtaaacaaaagagagcagaggtggctatactaataacatacaaaatagactttaaatcaaaaaagttataagagataaagaagggcattatatattaataaaaggtttaatacaacaagaagatgtaataattataaacatttatgcacctaataacaggtaataaaatacatgaagcaaaactgacaaaattaaagggagaaatggatagttctacaacaatagttgtagacttcaataccctactctcaataatggatagaacaaccaaacagaagataagtaagaaaacagaagacttaacacaataaaccaactaggactaacagacataatacagaacactgtacccaataacaataacataaacattcttatgttattcatatgccattatgttagcccgcaagttaagtctcaacaattttaaaagatggataccacacaaagatggataccacacaaagtattttttccaaccacaatgggatgaagttaaatatcaataacagaagtaaaactggaatattcaaaaattaaacagcatgcctttgttttatttttttttcttgagacagagcctcactttgtcacccaggctggagtacagtggtgggatcttggctcattgcaacctcgacctcctaggttcaagagattctcctgcctctcagcctcctgagtagctgggactacaggcacgcaccaccactcccagctaatttttgcatttttagtagaggcagggtttcaccatattagccaggctggtcttgaactcctgacctcaagtgatctaccaacctcagcctcccaaagtgctgggattacaggtgtgagccactgtgcccagcctaaacagcatacttttaaacaaccaatgggtcaaaaaataagtcttagaaattaatgaaaacaaaacgcaacctgccaaaacctatgggacacagtgaaagttgtgctaagattaaaaattatagctataaatgcttacattaaaaaaagaaatatctcaaatcagcaacttcattttacaacttaaggagctaaaaaagaatacagtagacccaagctagccagaacaaaggaaacagtaaacatggataaatgaaataaagactagaaaaacaataaagaaaatcaatgaaaccaaaagttggctgttagaaaaggttgacaaaacagacaaacctttagatagatgaactaagaaaaaagaatactcgaattaatagaatcagaaatggaaatgggaatattgctactgattctacagaaataaaaaggacaataagagagtactgtgaacaattgtatgccaacacattggaaatctagatgaaatggacaaattcgtgaaaacacaaaacctaccaagactaaatcacaaagaaatagaaaccgaatagtgctataactagtaaggagattgaatcagtaataaaaaatctttcaacaacaacaaagaagcccaggatctgatggcttcactagtgaattctaacaaacatttaaagaactaatatcaatccttctgaaactattccaaaaatataaaaaagaagcaacacttcctaactaattctatgaggcattactttgatgccaaagacacaagaaaaagaaaaccatagaccattatttcttatgaacattagtgtaaaaatcatcaacaaaatgctcgtatatttaccagaatattaagaggattatacaccttggtcaaaggggatttagtccttcaatgaaagaataattcaacacacaaaaattgatcagtgttataggccacattaacagaatgaagggaagatgccacataattatctcaattgaagccagaaaaaacatttgaaaaaattcagtacccttctatgattaaaatatatatatatactccacaaactaggaatggaagaaaactacctcaacatgataaaagccacatatgaaaaacctacagccaacatcatacacaaaggtgaaagactaaaacttttcctctaagatcaggaagaaggcaaggatgtctgtgtttgccatccctattcaacaaagtactagacggctgtactaattgctagctagagcaattaggcaactattaaataaaagaaacaaaaggcatcccaactgaaaaagtaagtaaaattatccctgtatacagatgatgtgatcttatatgtaggaacccctgaagatttaaaaaaaaaaaaaagactgtaagaaataataaatgaattcagcaaagtagcaggatgcaaagtcaatatacaaaaatgagttgcattttaccaacaatgaagaatttagaaaggaaactatgaaaacaattccatttataataatatcaaaaaatacttaggaattaacttaaccaaggagatgaagaacttgtacaatgaaaactacaataacattgctgaaataaattaataagacataaataaatggaaactcattccctgtccatagttttgagaacttaatattgttaacatgtccaaagtgatctacagattcaatgcaattcctatcaaaatcccaatgatgtttcttgcagaaatagaaaaacccatcctagaattcatatagaattttaaaggacccccaaattgcccaaactattttgaaagtaaagaacaaagctggaggacttataattttttattttaaaacttactactacaaagctacagtaatcaatcatgaggtagtttcctataacattatgaatgtatttaagctacagtaatcaatcatgatgtagtttcctgtaacattatgaatgtatttaatacactgaactataaaatgattaagctgtaaattttatgttatatataggcataaagaccaacatttagacccatggaatagaatagaaagtccagaaataaacccacacacttacggtcaaatgatttttgaccattcagtggggaaagggcagtcttttcaacaaatggtgatggaaatattagatatccacatgtgaaagaatgaagctggacccttacctaagacaatacacaaaaattaacttgaaatgccttaaagacctaaaactataacattgttagaagaaaacataaggcaaaaacttcatgacattggatttgtcagtgatttcttggacataacaccaaaggtgtaggcaacaaaagaaaaaaacagagaaactgaacttcataaaaatttaaaatgtttgtgcatcagaagacagtatcaacagagaaaaaaggcaacacacagaatgagagaaaatatctgcaaataacatacctgagaaggggttaatatctggactatgtagagaatttctgaaactcaacaacaaaaacaacctaattcaaaaaatgagcaaaggacttgaataaacatttctcaaaaaaaaaagaggtacaagtggccaataagcacatgaaaagatgctcaacattattaatcattagggaagtgcaaatcaaaactacactgagtaccacctcacacccgttaggatggctactatcacagaaacagaaaataacaaatgttggtgaggatgtgggaaaatggaatccttgttcacaattggtgggactgtgaaatgctatagccactatggaaaacaatacagctttttttcctcaaaaaaataaaaaatagaattacatgatgcagcaattccacttctggatgtatgccaaaaacactgacggcaaggtctcaaagagatgtgtacacccatgttcatagcagcattgttcacaatagccagaatgtggaaacgacccaagtgtatactgacaagtgaacggataagcaaaatatggcatatacatacaaaaaaagtattcacccttaaaaagaaggaaattttgacatatgcttcaacatggattaatgttggggacattatgccaagtgaaataagccagccacaaaaagaaaaataatgtatgattccacttatatgagtgagatacctagaatagtcaaaaaagtatagagacaaagtggaatggttgttgccaggggctgtagggatcagggaatagtgagttattgtttaatagatgaagagtttcagcattacaagaagaaaagagttagggagatgggtggtggggatggttctgtaacattacgaatgtatttaataccacactgaaccatactttaaaatggttaaactgtaaattttatattacatatattttaccacaataaaaaaattgagaaaaatcttttaaaagattaaatgagcattaggaaaaatagctaatacacgctgggcttaatacctaagtgatgggttgatagatgcagcaaaccaccatggcacacatttacctatgtaacaaacctgcacatcctgcacgtgtaccccggaacttaaaataaaactaaaaattaaaaaaaattaaatgaaatttaaaactcaaaaaaaaagtggttaatgatatagcctacttcataaggctgatgtgaaaattagataaattcaagtgcttaggactgggcccaacagaaagaaaactcttggaaagatagcaaatatgatcatcatgggatcttccatgtttaatggagacctcatagggacacaagtacaggtgaactgtggaacatttgaaaatgctacacttaaggaaatattatattttataatagaaaacaagtatctgtgtaagagttttctcaccgcaatcactgttaattatggaagcttgctacataaacatgttctctaaaagtgactcagtggtacacattcggcatgcagcatgtgttcacaatagccacttatttctggtggctaatgaaactgatttcaattgttgaagcattttagtaaatacgtctgatgacagtgcttgtggctttatatctcttctctcgatgtctgcatctactgagtgaaacattgggcaggaataactccagatctgatggacttgcttgctctgccatcaccctggtgataaaatttgtgaactcaagaacgtgtatgaaactgtgtgtccacattccagggacagttaaaagctggtgttaatttcctatatttggtgattccatcaaaaatgaaagggagccagcattttttaagtacccttcatttattaggctcattgatttcttactagaaaaataaaactggcaatgtaagtatcccctcccattttcacaaatagctaaataagttgtgcaagataacacaccaagtgtaaaatagccaagattccagcttaggcctggctgaggaaaagactgggctgtcttcagagcatcccgctgcctctcattctcttgcttctttcaaggctgacaagtctaccaaaatgcatttgccagtacccaatgaagtgctcatgtctaaggcttctttttgttccatatatgccaaataaggcttacaacacttttacttaggatgctgtgctttcataaagagttccacttaccaagttatcacaaatgggtatatcaattcagaccactagaagttctttgtactgagaattctaaattctgttttgcaaatattcaagagcctgattcatggggtaaatagtcaagtgtaaaagttcatcttctagccccagttcactttgctcaggtgagtatcatgctgttgaagtgagttctcctatttccaggttagactattgtggtaagttttgtttggtttgttttgatttcattagccaaaggttgtaggttttagcattgtatttcccacctttttgagaacaatactgtctggagtgcatttcctctctgttaaagaacttcttgccatccagattaattttaaagtatttattttaagtttttagatgaaaattgtccatcatgttgagaaaagagaactccatttgatgaaagtgatgcatattatttgcaaaattcttattgcaggttatcatttctaaaagtgcccacccataagcagtaaaaggaatgccactatcaattttagcaagacagagcctgtctcagtatatttgctcctgtaccctcctgctgtgttagaaagactccaaactacaaatggatcgtgctcagcatctggatgagtactctatccaggctttcccaaacatccagatgtttgacagcttctacatatgcatattttctccttatgcttcaggtagcaaagtaaacatgggtttattgtttccctgcacagtgactctgctcctgaattgtgtacaaactcaatttaggcaggtctaattatatcttaaatgtactagtggagcttactatttaaagaaaatctatagggaattcttttgtaaagtgaagcatccccttggaaaggtaataacagctacataatttgttacatgtttgttttctttttaatgcgggcacatgcatttttaattgctatataaatattcactatatatatataacatggtattgaagaattagagacatcattgccacttcctatataccagtattaacgggggagggaaaaatcagccacaagcacatttactggtccttgcaaagtagaaaggtttgcacatgaaattgtaagggtttgatacagaatgagatgacagtagtctttacatttaaaacttctggtattaaatattgtaagagaggataacagagtgtaaggataagaatccattcgaggatattaaatcttatgtttgtaaaggcagtaacgcagtatgagatatgaagcaatcagatgtgaggaatgagcaatgcttctttagatttatcacatccctataatttactgcagaaagctctcagaatatcccaatgaacattgaaaactgcagttattttcctttgcttttctttcatcaaggaaaaatgcaaataaactctaaaatgattcacagagactaacgaccctcatcaatctgccgatgactgaaaagaaaaaagcaggaatagttaaacacctacactgaaccttaacagaaggataataacatagtaagttgccccataaaaagtatttcagatattagaggaaagaatttttgaagctaaagataatgattgtgcctgaaaaagaccatgcctctatctacaattaaggaaggaaagaattttccatatttttatgcaaacattgatgtctaaccaagtggtccaggctatgctaccaaactctgtacaactttgtttcaagacttgacaggctacccagcagacatccttagagctataaatgagccatattcaaccaggtccacactgatgtttagctcttatgcccttttgagcttcacaaaagtatatctgatggagagagaaagagaaacaaggtagtatgataaattttacagggttactggaaaataagtcaaaatgtttgtcagtagaaggaaaaacacccttcccttactatctttccatgctgtgatcatttccatcatttgaaacctggaccaaatacctcctccttcctgaaataaactttctttcctctaactttcctcagtcctgtctacttgacattgtatcttctccattattcatttattcaacaagatgtatgcagtacccaataaggatgaggcattcttttttaagagctgaggagatagcaatgaacaaaacagccaaaatctctgttctcatggagctaatgtttttgtggaagacctagaataaacaaacaggaaaatcaatatattagatattacaaataaaaggaaagcaagaaaaaggaataggtaatgaaggaaagtttagatagtatgtttagagaagtccactgaaatgggtggcagagacttgaatggaatgaggcgatgaggcatgcaaagattagggaaaagaaaatgccaggcagatagagcttcaaggacataagctttagacaggagcatacctggtgagacaaggaagggcaagaagatgagcaactgaaggagggtaagccagggttgggagaagtggagaaaatgaggcaccagttgaactgtaaatttcctgagaagagaatccaaagctgactcagtgacaccacttaatacagtaatagttggtggcaaatcatcagtaaatgaaaggagatggcccatttaattatataacactaatattgacatgttcatggaatcatggatatggcaccaaaattcagacaatatgcaggacctgactttagaatggactagagcagagagtaataggatgggggacatttaggaagcaggtgaagttattcaagtaaaacacaatagagccctaaaccaaacagaggcagcatgaatagcgaaagggcatggactagaacaatatagagaacttacaggttaaaccaaaactgtaagtcctgtataattggtttgtgcctcacagaaatttctgggagggctttcctcagcagattagaagtattctgccccttcagttactacatagctgcaggttacctgcctcctgccagacatggtttgctttgtctgtggttcccatttgcttactgcctctctgattgattgagacctgccatcttgctctggcctacatatcccaactctggatttcccacttggtctctgatcctgtggatttctatagattttcatatatttccctgggttctgcttacttcctcttctaatttctccagctccagtcccttaactcatgcaattttaactcaaatatatattaaatgcttcctacattttagcccctgtgctggggtctggagtcccaaaaatgaataaggcatcgccctgccctggaagaattcattgtccacagtatggtattttctacaacctctgactgattccagaagaaaataaccttgaaatcatggtgaaattactaaattagaagatgagagagaaataggttaattcatcattttttaagttcccactttaggacatatccacacaagaaaataggtctatctctaagtcatttttttatcttggagattacaaatgagatgatcaaaaactattttcaatataggttactactgatcatgcccatttattgagtattgctttggtactgcacaaaaccaaaagctggaagcaatagggtaggtcccactgttccccatgcaggtatacacaccaggggttacaactaaagtgagaagacacatcatgcctctgcaaagtagattagagaaaaattttccaagctgtaaatggcagcttgacaaacaacattacaggctggattcaatgaaaacgctgcagacctggctccctccagggctataaatcacaatgaatacacagaacattactggaaaatgcagaacagaaaagagactgtgcaagtgttacaggccctccagccttggctcactgaagactaatttagggagattcagtgccgcaaggtctcagcatcatgggaaaacctggaaagccctcctcatgaaagaacactgcagaagagtcttaacaaagaaatggaaactccagaccaaaacagctctcaggggagaccagaagggtagaaagtaaaagaggaccacccctaggagtgcagggcagtagggaggactcactctggttctcactccccaccccttactctcctgaacgttattttttaaatcaggtgaaatcaagtatgaataacatcaaatgcaacctcaaaagaaagagaaatcccaacatattatgttggaggagtgttatgcagaaatagagaagggccggggggcattcctgcctctttgacttaatgataataatgactggagaatttgtgagttaattacacctctataagtctggaggtttctctgcctgtcagttagcccatctgtttctcttccataggctcctttctgagtcactttctggtcttgacctatagcctacagcggtggagaattggatgcccagggtcactgtagccaggcagggatgcgcatacaactgggtgaggcaagtgggctgtgtgatgagtttgggaagcttgtcagtttgtagagtccaagaaagagctatggagacctctaggatagaggtcgagctgtgtccttcgaaaccccaacactgtgaggacaaacatttccttaagtcacttctgcagttttttttttaatcttgagctgttcattgattcattaattcatttattcactcatcaaatattcactaaggacctaccaggtatgctgtgagccagaggcatggcatacattatataacagctgtacactgagatactcatatagtccccatcgctgtctgtgatgattctttaaaattattttcctagttaaatcaggtggagaatgtggagcattatgcaaatacagtcaatctgctaccttaagtttccctaatgcaagttacctcatccacaatttatgaaattgtacatacagtaatgatgtcaatgtaacacagaagttagagattatttttctcatataatagcagctcagcatacaacacattggcctatctgaatgcaccaagcttgaaggaatgcagtactgccatgtctaccttctttattttggatactcgctcttccttggaagttacttagacagatcttcccagtcttgtgcagaagacacaaacatagatgatgaacagaagtaatccatcattagcatcaccacattgtatgcaaagccaacacctctgtctacctgtgatatatgacagggtgaccttatctccataatgcagcagcctgaatatttaccagcatcccagtccatcaagctctcttcacctacatgttaagtgaaggccaagattactccagcatttccttattagaatttgacatgcctttttaattgtacttctatcttattagaattgttttcgttaggtctctgtttacaacgtttcctaggtttagagtggtttggttgaattctatttttatcataagccctgttctttttagtgtgaaatcttgccccaaactatgttttccagcaatgtatatatggcattgtggcaggaaagcccatatttcagtggatagagtttacccattctgcctattcaaaagcacactatattctgattgataatgcagtcctttccagtgaaagacatcaacaacacaaactaagtttggcgggtatcatccttaggtcccataaatcaaaaggataaaaggataaaacctgcatcaggacatggtttggagtattcttcatccaatcaaacttttctactctcctttatccagctatattaaagaaatctttaagctttacaaacctatttatcaaaagttcaaatttttaaaattagcctaaattttaataaagggaactatcaggcagtttagattgaaaaacaatgttatatggtgttaaagttagaaacaaattttacagctattactatagcacaaacaatattttgttaaaaatataagacagtctgatttaataattataagctttctttttcacttatttatgtattttgacattttctcagtgcatagcacctataacattgggatcattctgtcttttcctatttttaacccagagtaaaattccaaatattttttagaattaaaagatttaattctttaccttatcagagaggaaaaaacaaagtcttttatctgtccactcacaatacagaacacttcttacaccagatgtgtgggggtttttccctacacgcaaagcaagcgatcagttttagagtggacaccagctgggtgtcctctaattcaattcagttctgataccacctacctggagatagagtcagatcccacagatcttgtggctcagtcccatgagactgccccaactttcagatgccaattgcaagctttagatttgctttcttacctatgcttccaaccaatcaactatagatcagcgttctcgtgaccttctccttgggctcaattaatttgctggaatggctcacagaactcagggaaacacttatttcatttaccagcttattataaaggatattacaaaggatacagatgaagagatgcatagggcaaggttatgtaggaaggggtgccaagattctatgcccttcctgggcacaccatccttcaggaacctccagatgttcagctatacagaaattcttcaaaccttgtccttttttatttttatggagggtgcttcattacatagacatgattgacattgtccactgatcatcaacttaacattcagcccctttcccgtccttggaggttgggtggtgggattaaaagtcccaaccctctaaccctgtcttggtctttctggtgaccagcctccatcctgaagctgcctaggggtttccagctaccagtcaattcatacaaaaagacacttatcactttgaagattctaaggattttaagagttgtatgccaggaaacaaggaggaagaccaaatatactgtgtatttcacagtatcacaccttgctacacacaggcttctcacatcctgatctttcctacatctctaggctaattgctgcaccaatttcccttaaaggtgcccacacatgcacacacacacacacagtcatgtgctacatgccagcaatactaaaccattcatatttttcatgcacactgtctctgtgcctttaaaaataatgttccttctatttgaaaaacccagttctaccacttcccttcaccatcttggtaattcctatcaatttattaattctcagctcgctctcttcttgaaagtttaccctgactctccaggagttgttacattccctacccttgtgttctggggttcaacacagctcagagggaatggtctgtagcagtggatggtctataacggtgttcatcacactctgctacagttgttggtttccatacatacttttatttctgttagattgaaaactatataagaataggaactatttgttagtagtctatgtatttcctagtatgtatcacagtacttatcatacaagaggtgctcaatacctatgtgaataacctgaccattcaatctaaggaagccagcagtgattctccacatgtattcctgttttattgtctttatagaatttataactatttgatgtttgctggcttatttgttattgtctttcattattggttttattatacataagaacataagctccctaagagtggacccttattgttttgttcatcactttagccccagtgcctagaacaaaataggtattcagtgcctggagcaaaagagatgcaagataaaactgtcaacttcatgtaatgaatgagtagattcaggtttttctctcctgtactaatagcaagctttttaataaattagtatataggttcaatgcctccatggagacattaaaatactctggtttcaattaatcttgcaattttagcagtattaaattccaaaaacaatttttcactcatttggaagatctataaaggcaactgtaattaagtaatgtggaacacaagtttcaaagtctaaaataaagtgattattcgctcattttgtgcctcttttttttcactcttcctcatttttttctgagattcacttacccttctgagtctgggctaatcaatcatttatgttattaaagcaaatatgcttatctaatatcaaagcagtataatcatgcacattaaagaataatagtataacatgagtctgtagccaacattaaaaatgcataagatcatgtaacaagaattactgcaaagacctagccagttattcaacactaacatattttaattaaaaactaatttagtaataaccgaatgattcactagtgatctctagatgcaaaaaaaaagactagtgtcttcaaacagcttcctataacattttagatcaactgagcctagtcaaactaaaacatagttaccaatccctcctcagacctcacatgatacttttgtttttcacttttaacacatattttgcttttaaagcactgtgtccagtttaaatataaactggacacagtggcttatgcctataatcccagcaacttggaatgctgaggaaaggggaacacttaaagccaagagcccgagaccagcctgagcaacacagtaagtcctcatctagcacatgcctatagtcctagctactcagaaggctaaagtgggaggattgcttgagcccagaagttcaaggctgcagtgagctatgatcatgccactgcacaccagcctgggtgacagaatgagtttctgtctctgaaaaaaaaatgcattaaccaagcatttcttgagtgcccactagttctaagttaagtgccctagctcattcctgacttcattcatgcttaaatgagaggacctaagtaagtagaatgaaagcctaattggttacaagagaggaagggactcatttccactggcaattgaaggaagcttccatagatggagacatttgaggtggttctagcatcacaaaggtcttggtcagtctggctagattttatgggggtcaggtagatgaacagaagctcaaaggaagattgaaacagagaagaacctactcttctgagtacagtcatttgaattttatgttgtaagtgattggaaatggaaaggaggtccttaagtagcacaatgacctgatctgatcaaatttggttttgagaaagataattttgactatgtcttgaggaataactggaatggagaaggaatagtggagggcaggaagaaatggaggctgctgcattgcccagaagctacatgagcatcaggactaaaatagaggcagaaaagatggagaagaaaaactgaattcatagaacattcctgaggccaagccatcaaggggtggtgtttgaggtgagaggctggaggtgaggatttctgcactttctgactttggggcatggtcagatagtgatgacatcagccaagactaagaacacatggtgttcgacaatttcagaggagagataggctggttttaaatatattacatttgattcatttggggaccatcagaaggtactggaaatatttatctatagtccaggagatacgggagtctggatttggagatcatggctatgtagagaaaaagaagggaactcgtgaggtggagagtgaaaaaaaatggataaggaaatagtagccaccattatgatgagcaaaacactctggaaacagacccaatattaacacacttcattttcgtattaagcccctaggaaccttcatttaaagcagtgcttctgtcaaaatttagacttgaggcatttcatcagatgccttcccaggacatggcctaacacctgcatcattttcaatgctagcatttaacttgttagagtattagcttacagcagtcttcatccaaagtcctggtgctctgggatgatggaagcaaaattggggatggcgtcttcttcctttgaaagagctatggattaacattgcattgaggacttattgatattaattattttaaagagctcactgggaaccattcttaaacctaatctaggataaaaaaccagaaatctttagggtaattgcagtaacctgctactgccaattttttcaaaggacaaagggatggaattctccaagaaatggagcaccttggaaggtttaggttttttatctacataaatatcattgtttgcaggatactagcatcactcccaaatgtcaattctctttccaataattactgggccaatcataattgcctcttaacgcatcaaagggaatgtcttgctcttgacaaccacacacctaagctattatgaactgtaagcagtcagtccttacccttaagcctctggcataaataatcctggccaaatacctgagcagcaaatatcaatataggagttcaaccactgacacaagcacctgcatcattaggacagaatgatttcaaaggacaaggtaattaaacaaaaaaaaataaccttaggttacccacatatgtgaacctcccttgatatgccatcaactgaaagcgatagatagatagatagatgatagatagatagatagatagatagatagatagatagttgatagacaggtagatctcaaagtttggggtttgcagcagatgagggcaggaaggcaaaagagaagaattaattgcttgggaaaatctccaagaaaaaaaaaattcatctgaaatgagggattgctctttctcttgactcagtaatcttcagaaatagaggaataaaataaaatcttcacataatttgactctagccagagccagaattcagttttatgtttctttcaactgccaacaactttgttttaattataagatggaaatttctaaccactatagtgactagcagctttttataagactgacatttcagatgaacaaaaacattattcaaggagattcactttccaacagacaaaatgtgaccaaagcaaataacgacattcaagttgtatgaatcaggccctagcctataaatgttcagtgcattctgcatgacaatagtcatcccactgcccaccttcccaccagcacagtgtctctcctcaatactcaaagatttcaattaagtaatagtatcaattataagccacatgcttttcttaatattttgaacactcaacatttgattgagaggcacgggaagataggtattatgtccctaacttccttattaatattctcacttcatggccactcctttacacgcagtgctaaagtcagaaaataagataaattcaaagtctctactccccagctttggcttacatgccagaaaaagtgaaaagtgatctaattctctctattgtcatattctaaagacatccgagccagacatttgtcaaaattggagaaaaggatggcaattttaccaaaactgttgcaacataattgatgctctagattttccagcaagaagaaattgagcagctgaacaagataagcaagcattctacaaacttataaataaaaacacttcagccgggagaggtggctcacgcctgtaatcccagaactttgggaggctgaggtgggcggatcacctgaagtcaggagttcaaaaaaagcctgcctaacatggcgaaaccccatctctactaaaaatacaaaaaaattagctgggcatggtggcacacacttgtaatcccagctactcaggaggctgaggcaggagaatcacttgagccgggaggcaaaggttgcagtgagccgagattgcaccactgtactccagcctgggcgacaagagcaaaactccatctcaaaaaaaaaaaaaaaaaaaaaaaaaaaaaaaaaaaattcaagtgttccgaattcccatttaaatgtattttggaaagtatataaaaatcaaatataagatggttcttcccatatctgctgtttttctttcctttattgccagtaaacaataccaaatctcacattgtttctcatctcctcaaagacattcttggaaacttgtccgttcatggccacgttgaggaccagggctgagtagctgtgggttggcacttggcagtgagcagaatagtattcacttgaaagttctcataattatggaaaatcgtctaatgaggatatgatatatttatattttcaagcttctgcttttagcatgcatcagggaatgccttgttcttagcttagattctcattcctattcccttgcctagaatagacacacttatgagtcttgtcccagtttccatgccctgatcctcggatcatctccaggtgcccagttcctttcagaaggatcttctgtctctaccaaaacctggtgagggatgagagcagctgtggtcagagcacaaatccaaacttctgcccaaggcctttgtcctggaatgtactccccatttcttgcagagtaaaagccaaagttcttacagtgacctaaaaactatgtagggacacagtctagtcagccattcccagatatcctcacctcctatccctctccttttacccagtctacttcagccagcccggtctccttgttcctcattcacactcagagtttttgcaccaactgatccttctgtctcgaaacttctttcatcagatatctgcttgactcccttaataacttagagtttgctccaaaaggcctaccctgctcctatttaaagctggaaaccttccatctcttcccagcaccttcatcctcttttatcactctctatagcacttatcttccaatgctctatctttctgtatcccaatgtacttgttcattatattatctgcttgcttccactagaaacatcaaatggacatggatatgtttactctgttcagttctgtattccagcatttagaagagcacctggctcagcaaatatttaatgagtgggcttattttatttaacagagttaaagcgatttctgtgtatcaggcactgttctaagcactgtaaaaatattaattcatttaaagtctggtgacaaccctattaagaatggatttttcattccaattttatagaaaaaaaaaactgaggcacagagaggttaagttaaattgcacacattccataaatggcagacccctccatgcttctatcccctgggctctgctgaatgaatgaatgagacatagtggaaaccaccttttctgcactttgttctgagcgtcccactctgaccaaattaatgatcccagtgtttgacattgacccattgaagtcaatgtgctggccctttgcttccccaaaacttgtagcttattagttatttagaagccagtatcaaggagaaagaggcaagtaggccttatctactgggataggtctaccttttagtagaagtatgaaaaggatcaaaacagaatatgcaaatacagatcaaggaactagtgaagatagggctgtggaaatgaatctcaagccccttggatcagcagtagacccttccttctggtccagcttgtcatgctttgctaggctaagggctgcctccacagattgcaggaacctggaacttacctgtgggacagaccgacacgtatttgcatagtaatttgtacagctagctgtagcttattggaatgattacttcaatgtttgggaaacatttaagatgattgaaagggggtaattagcatttgggaggaggcatatctcctatcaattttcctttgagtcgatacttagagaatctctgctaacaaactgttgccaaataaagatcctgctgggttttctttaattaatgagatggcttgattgtaattattccattaattgtttaaatgcaaataagtgctattaagggtcttgaaaagtgtttcctcttaactatgctaaatcttcccccttgtcctctcatttctgttctgaatttgcctagtatatcctcttttaataaataatacaaaaataagcatcaaccaaactctagtggtataatcacaaattctgaattaatggagtctgaatagaagtgatgaattgtattagtgttctggaagaagataagattccactgaatccatatttaccatgcaaacaagcagggtaataaaacagaagaagttgtaaaaatgggaactttcaacagtgtaaacaatttatagtctctgatgagataccaatcttggatatataaacctagtctttgaatactgtactttcagtgactctagatactctttattatgggggaaaaaaattcttgccttaatacaattctattccctgcctgccaagatatggggctgggggatactgtactttcagtgactttagaaactctttattatgggggaaaaatgcttgctttaatacaattctattccctgcttgccaaaatatggagcagcagagtctccccagctcccacacctgcagagagattcttggggcttcaccacggcaagacggtgtgaacaacacagctgcatagtcaggctacctgtagggaggtgtgagagcatttcctccctcgaggcttcatggctggcctggaatgtaagcacggatgaaaaaggggatgcaaacgagagaggcaagagttgtttcctttacagcttaggaaatttttcagagctctccttgtttcaagaggagaatccactgctgtgggttccttgttcctttttccttcagcccagccaccccgttcactctgacccaggctgtaaatttacttcctgtgcacgttgctctaggacttcttttatctagattttacaaaaggtcaacttgacaccgctctatcactttacatctattcaggcatgccatgctgcttaggaaagagtaagaagtgcactttctctctccaatacattcttttctgggcagactcttagttctgaatagacagttatttttgcccagagcttatttcttgttaatgtcctgtaaattcaatatatgggtctatatttccatggctttggtcactagttgtgtacaggatgctttattagttaaaattgtgaatcagtcctctcatatatcattaaagtactaccatggtctccaaatcaagtgtcgtgttgccaggtaggaataagtctacaaccaaataaaggagcaggagagtagaggagggtttcaagttactgtggcagatcagttccctcctatactaagtgattttccaaatcaattcaagcaatggcaattcatcctgctgtggatagaggccgtcacccatcagaggttgtttggtaagtgtgtgtgcataatgggtggcaagcaggcagtgatgtattaattaagacatattgatgatgtgagcagaggtgtatgacagcaataatattccaaacactactgtgggcaaataagagtgatggcttatgtacagtaggagtcatctctatcagagataaaagttacacttggcaagcaaggcattttctctccagcagggaaactttagaaaaacaaatgggaatcagaatgtagcttggtaaataacacaacagagaaacggattgtgacagaaacaaaggatactcccatgaattcctggattcagctgtcaggataattcaccattaaatctaactgctaaatatttgccatgtgctatgtgttatgcttagggagcattaaaaaaaatgcattctaaaacacttggaaattgcccaggtagttctcttgtttttatcctcaactcagtttttttttttaagccggtatagaaacatattgattcttaatctattgtttaatggttcaattgaacaacaagcagaagagattattaaattagttcaagattatctctgatcaggcccttcatcttactcaatttaaaagtatacttgatttggccgggcgcggtggctcacgcttgtaatcccagcactttgggaggccgaggcaggtggatcacgaggtcaggagatcgagaccatcctgcctaacacggtgaaaccccgcctctactaaaaatacaaaaaattagctgggcgtagctactcaggaggctgaggcaggagaatggcgtgaacctgggaggcggagcttgcagtgagccgagattgcgtcactgcactccagcgacagagccagactccgtctcaaaaaaaaaaaaaaaaaaaaaagagtatacttgatttatggcatgagtggtcttgaatgattttgatggatgactggaaacaattagagatataaataaatagcacagaatcatgacagatttcatgaagaatacactgtgaagattcacatggttaataacattgaaattattaaaataaaagagactgcatatattagatttttctttgtgatctagttgttcaaagcagcagaaaactttaaattttccttaattttgaaagtgtgattaatggaatattgttacaatgccattgatttatatactttgaggatagttaacttctttatgtttattagaaattgcactgagagctaatatgcagtttctattggtggtgatatgttctgttaacagggcctcctgtcagtttttattctgagatttctgcctttcctgttcttttgcatgagcctaactgactgagtttcaatatcaagttctgaaagcaagtgagcatactagtgtgcatgcaatgtgcacagaaagatgtgttttcctacctctcaaagctcaccaaaggatattactcatattgccacaaagtacatttacaccaataacacatactttggtaatgggaaaaataaataatcttaggtaataaaatgcactttggtgcttataaaggaaaataatcatcataggtagaagaggaggaaggcaagactaggttttgattcaaaatgttttctgttttgctaggaagtctagaaggaatttggtcaaatgacctgaggaggcaaggagatttctcccagtggcacatggcagtccacaagaagactaggggcagggaaacaaagcaagattgtatctgatttctacaggactccaacactaccctgccaatacccttttctcctctgaaagccatgatcccaaaggtttccatttcttccgggtttttcacattctaccaacaagcagaatgtcttccccactgacagctcaacagttgagcttttcggggttctaccccttcatcaacacagcctttgctttcctggttactgagtaaataaaacacactggccacttctgcttagccttcaggagccactctggctccaccctgaagttccatttcctccaagaactaagacatttggagattctgcctaaaatatgcttaaataaaagggataaactgtctctcactttctttcccccacagcttgtcttaagaacaacggtgtaaccattagtgaaaaatcctttcaggctagtaaaatgtaaaaagagaagaggtatcgggtaacaacaaatgaaaataaaatcattcagtggtagaaaccataggagtgaaattaggtagttactgtcctccagcttacattaatcaaaataagcccacactgtcactaagacatcttgcagtaagaagccattcaccctctcattgcaattagtgtcataaagctgaatagacaggtcagaaatgaaaatcataggccaattaagttattctcatttttccacctccagctagctctttttgagaattttgattttaatagataataaaacagtatgctaattgggtggtgctgagcctgaagccgtgaactgaaggaaacttcaacaaacatttggctagggcctgctctaagcagaggggctacgacaatgggtaaggcatttctctagaaaccagcactcagcagaatttctggcacgagattttgtgagttttctagtggtgtgtcttatcttcccccaatagattataaactcctcgagggtgacagaacacattgctgatctttatatcctgcatgtttatggtattcggtagacatttataaaatgaattcatgaaaagcagaacatctagaaatgaagtcaacattgcagagaagttagctatatgaaactctgtaaataccctcaaggaagaaggaagaagcagattttctggaaatcaagggacctcccagtataagagcaattcctttggtccaaagaagggcagctataagaacagagacataactcctccgtaagaaaagataaaaattctgaaagttctctaagaacatgcccagccctgacctgcctctcactctcagtagcatggaagccgtactatctcttatcttgacacaagcatccacttcaatccacaggacaaatatcaccaatatgagaagataagatctgttttatagtcaacttggctgacatgtactaatttctcaaggtcaggatagctctctaaatagaaatacttgtttgttttaaggaattttatttaaatttgtgtatcttaaattttaattttgatctcggctcactgcaacctccacctcccaggttcaagcaattctcctgcctcagcctcctgagtagctgggattacaggcacctgtcaccatgcctggccaatttttgtatttttagtagagaccggatttcaccatgttaaccaggctggtctcaaactcctgacctcaagtgatctgcttaccaaggtctcccagagtgctgagattatgggcatgaaccactgctcccagcctcatgtagttcttaagaggaagaaaagcctatagattagtgagaagtagacaaattagcaatttgaatcaaatgaaaacttggtttgatttcattcattttggagacactttcggtgtttccattttgatctgattcaggacattgatcttcgattctaagttgcactggttaatttgtgattattttacaaaatcataacagaatacatatctgggtccagttcaaggtacagcaagccattttcaatgtttccagcttggtgtttatgattcatacatgaatcatttgggcatgcagacacacccaaatagaaacctcaaaccaattaaggtataaataggtttaggatgggggaggatggacaacaaaaaaaacctcagtaaggctcctccacaaagggcaccacttcagcttggtcccatgggcagacttcacctgtggcaggtgaaggggaaagcctaagacatcctgtgccctgatgcagatgtgacttacagaacataaaacgtaaaggcagaagggatcatctgggtggctgctcatactaggcaggcattatagctgctgacaagagccaacccatccctaaggatctaaaatcactacaagagaggacggaagtcctctcatcatggcatcccaactagtaactgggatgcatagggccactccaggtaggcagcgaggggtaaaccaggaatgtcctgctgttcccacctcttttccccaagcagggggcacccacttcctgcctccagcccatatggtctcaatttatggcctcaatacctgataaaaaaccagccgtgatccttccttagtaacaaagtgtcaatcagtcatttggaatggggcattttcaaactattgcctccctatgatcttctgaagaacctctgggataaatgaacattgttatttaggtatggttaaatgaattacttttcaggagcagatttatatattaacaggtgtgaaaaacttgaatggataaatcatttataaagaaatttcaggaatcaactaatcccaaggggaaagacccactaagacactagattttgctggagctactcaaacaaattcatctatcatatctacctaagccttccaatcaatgagactagccgcagtgacactgtctgtcaaaactacctcagtcatttttttccaaggcaggaagcatccataccccttcacaccttaatctaatttcccctatctccaccccactcccacttctatgacccccttccccccatacccacccccgaagcatctactagccaacttagtgaagttctgtcacgctctcacaaccacctctgtgcagcaatgattctgtaaatatccatgtgtcctcaacaccaggtcaaattagtccctttggtaaaaacattcattccctcaaattctcttccaatacactaatataccttcccaaaaagtaaggagaagcttgaaagctagctggattgatgatggtatgtgatgttctataagttatagttagtaagcatgtttttaggatatttttctgctctccaaagagacacaattccggaagatatttacttttgtgtatttccacattttggtttaagtttggagccatctctagatcttaatttcattcccctaatatgtgttatactagtagaattttccaaattacatagaattataactgcaactcttctgactgatgccttttttttgcattttatgatgcagtttacatcacaaattctttccctgcagggattatgtaaagaggcatgttgacctgctagccctatgttactttaagtatatgcacacacacaaaaaggaacaaaaacagctgggaattgattatgttgatattctgaataaaagcaatagttctaattatgtatgtctaattagccacagctcttcaagaattgctgcaaatgtcacagggtttataatgtcggcatttcatcttcacgaaaatgctatttgatggcataaaaccagaaaaaactaatggtcacagaagacagcttgtagattagacaaaggtcactgtgttttaatgaacagtgctgttaattaatgagaaaacaactggtacatgagcttttaagcattgtgaatttgtacccaaaaaatcaatctgcctaaaacaattttaagtagctaaaaaacaaaataacggcaagaacataatttaaacctcaaatggtacagcagagttatatgtatcaattaaattgaatcacagttctcaggtgtgacatatgaagaggcttctttaatgcctggaaaagagggttaatatggattggtattctcaatacatattgtagataaaattcaagactagctctaccactgcctcttttcttttttttttttttttttttttttgagacagtatctcgctctgttgcccaagctggagtgcagtggcatgatctcggctcactgcaagctccgcctcccgggttcacgccattctcctgcctcagcctcctgagtagctgggactacaggcgcccgccaccacacccagctaattttttgtatttttagtagagacggggtttcaccttattagccaggatggtctcgatctcctgacctcgtgacccacccgcctcggcttccgaaagcgctgggattacaggtgtgaaccaccgcgcccggccaccactgcctcttaggcttcttaatttccttatcatttaagaagaataagaaaattcttctatgttttaccaaaattctgtgaggacaaatgaggaaccattgtaactcctacaaggtgagtgataaaaataatacacatttattgtctttgcttttgtaaagagttatccaagccaagcttctaggggcttaaataaggaaggacaggaccattgttaataacatcaagtttccactacagctttcctccaaacaagtcaaatattctgaatattattcactaatctctttagctgccatttcagtaaatagcgagcattttatttcaactaaaaccaagcaagagaaaatgaactgctttatcctgaggtacagcagcaaaggcaccagaacttgtctcatggcttacccagcaagggtcagaagaaccatccctaatttaaatcatctcgactgaatgtaacagatttttgtattttcaactcatatgaaaataaaacaatgagacctcatccaaagggtgatttagagagtacctctaaacaaaacacagtgaaaatagacccagcatctggatttgaagaacacatttcctcttacgagtctatcccattgtctagattgctggcaatggcttttttaaatttaaattgttattgagataattgtagattcacatgcagttgtaagatatagtagacataccctgtgtatactttacccaatttccgcaaaatgtaacattttgtaaaactatagtataatatcacaaccaggataataatattgatacagctcacaaatctcattcagatttctccagttttacttgaatacatttgtgtgtgtgtgtgtgtgtgtgtgtgtgtgtgtgtgtgtgtgtgtattggctctgtacagttttatcacttgcagagattagtatatctaaaacaacaatcaagatattggacagttccggccgggcacggtggctcactcctgtaatcccagcactttgggaggccgaggcaggcagatcacgaggtcaggagatcaagaccatcctggctaacacggtgaaaccacgtctctactaaaaatgcaaaaaattagctgggcgtggtggtgggcgcctgtagtcccagctactcgggaggctgaggcaggcgaatggcattaaccagggaggtggagcttgcagtgagccgagatcgcaccactgcactccattctgggcaacagcgcgagactctgtctcaaaaaaaaaaaaaaaaaaaaaaaaaaagatatcggacagttccattgtcacaaggatctctcaagttaccccttgctaaccacatccaccttctccttcacacttgcacaccccttcccttctccagcctgaccccagcagccactaatctgttctccatttctgaaatgtttttatttcaaaaatgttatataaatggaataatacagtgtataactttttaagactgacttttcttgcactcaatataattccctggcaattcatttatgttactctgtgtatcaatagttcattcatttttattattgagtagcattccatggtatggaggcaccagagcttgtttaaccatcctcatggtgaaggacatctgggctgtttttggggtctggtcattatgaatacttcttctgtgaacattcatgtacaggtttttgtacaaacataagttttcatgtctctgacacgaatgcccaagagtacaattgctgagtcatatggtaactatatgtccagttttataagaaacgaccatgctcagaaggaccatactgttttacattcccatcagcagtgtttgaatgatccagcttctccgcatcctccccagcattttgtgttgtcactattttttgccactattttttattttagccattctgctagctgtgtagtgataccattgcgatctaatttgcatttttctgatggctaatgatgtcaaataacttttcatgtgcttctttgccatatgtgtaacttcttttatgtatgtcctcttttatgaatatcctatttatacctttgccaattttctaattgagtttttggttttttactgttgagttttaaggtttctttacatattttagatattagtcctttgtcagatatgtggtttacaaacattttctcccagtctatggcttgtcttttcatccttagtacctgggctctcacagagtaagtttttacttttgatggagtccaatttctcattttttccttttataacttctgcttttgatgtcaagattaagaactctttgcttagtccaaatcccaaaaatatctccatttttttcctaaaagttttattattttatgtttaatttttaaacccgtggtccatttttaaatgattatcataagataggaagtatagattaaggtccacttttttgcctatagatgtccaatttttccagcatcatttgttgagggcccttcttcctccattgaaatgcttttgcacctttaaaacaaatcaattgagcatatttgtgtgggtctagttctgaattctctattctgttcactgttctatatgtctgtatgttccatatgtctatccctccaccaatccacagtcttgattactggagctataatagtaggctttaatatcaggtaaagtgattgatctcgttttattcttctttgtcagcattgttttagctattccaggtcctgtgcatttccatataaattttaaaataagtttgtatctaccccccaaaaaaaactttgctgagattttgacaggaattttattagacctgtagatcaatttgggaagaattgacatctttgctatgatcagtcttccaattcataaacacggtatttctcctcacttatttaggtcttttctgatttcttttatctgcatttcataatctcaatgcacataaaccgtatgtgtttttctaagtggatatttaagttatttttatttggaattattataaataataattttgtgtttctaattttcatttccacatgatcattgttagtataaagaaatatgattaatttttatattgatcatacatcgtgcagccttagtgaactcacttgtttcaagagtgtcttcgtagatttcttgggatttttctgtagaccatcatgccatttgtaaatagagaccattttatgtttacctttccaaactgcatgttttttttttcttttatttggcttattgcagcaactattaatataacttacaatactatgttgaataagagtgatgaaagtatacatcttggttgttcttaatgttggggaaaagcattcagtctttcactattaagtatgatgttaagtttgttgtaaatgctatttatcgaattaaactgttaaacctcttttcctaacttgccaagagttttttttaatcataaatgggtgttggattttgtcaaatgctatttcttcatcaatttatatgatttttttttagctttattatataatgcattatattgattgatttcaaccattgagctagccttgcatacctggaataaatcctacttgcctatatattgactgattgactgtttgctaatattttgctgaggattttttgtgtctaagtttatgataaatatgggtatgtagtttttgttttgctttgttttattgtctttgtctggttttggtgtcaggataatactgacttcataaaatcattgagaaagttttttctcctctattttctgggagaaattgtgtgaaaatgatatattcttatttaaatgtctggttgattttgccagtgaaaccatttgacctggacatttctgtttggggagattttaaactatgagttcaattgctttagcggttatagggctacctagattgtctatttcttctttgttgagttttggtagcttgtagttttaaaggatttggtccatttcttctaagttatcaagtgtatgtgcgtaaagttaccatagtactccttcattttttcagtggcgtagaatctatactgatatcccctattacattcctgacattggggattttcatcagctttcaagaaagagatttatcaactttattgattttctcaaggaaccacttttttgtttcatggattttccatattgttttcctcttttcagtttcattagtttttgctcttttctatgttatttccttctatctgcttcctttgggtttattttacccttctttttccaatttcttgaggtaggtactcagattattaatatgagaactttcttcatctataatgtaagcatttagtgctataaattttcctctcagcactgcttttactgcatcctacatattttgttatgtcatttttttattttcattcagttcaattttttaaaaatttttgagactttctctttgaccaatggactactgggaatattgtttaatttccacatgtttagagatttgcttgttgtctttctgttattgatttctagttttattccattgtggcttgagaacacattctgtctgattttattcttttaaacttgttgaaatttgtttatgacccggaatataatctatcttaataaatgtgcatgggtgctttttaaaaatgtgtattctgctgatgttgggtgaaatgtctcatatcagtcagatcctgcaggttgaatgtgttgttcaaatagttcacatacttgttaattttcattctagtagtgctatgcccatagttctgagcaaggataaggtgggttgatgaagttcccaaatacgacttaacatttgtctatttttcctttcagccctattggttttgctttatgaattttgagactgtcttgtcattttcccctcaccttcttaaaaaaaaaagcagcaagcaatatttctgaacaatagggcttgaataaagaacttgtaaatgtactttatcctgccttactgcagcagaggaatagtgcagtgaccttggcatacctaagaacaatgggcatatatctgtcatttgttaagaacaatggacatattggtgtcatctgtttccatgaaaaagaaaaattactacacggtagtgttcgggggctcaggccacatttgggattttcttgggatcccttataatatgagtactcacaactggagtgccaaatgtcctggcataagcaggaattaggggcagggattaaaaagtggatctgccattcaacctaggttgggcacaggcacaactacatgggcattttgggcctgagtatgttttccatatttggaaagatgtgctggattaacaagaaatgatctggcactttagataccttaataaatgaacagactcaactacccagatatacattcaaaaccaaaacaaagccaaaatcaaacaaaaccttcggattattaatgaatgtatgttgaccctaattttggttatctgtgcataaagtcatctttgaaggtttatcctataagtaattttgaataactgtgagtaagcagtgatgatattgggtatttatttcccatcatgagaaatatttgtggattacttagtgcaaaataagagaaggatagaatgatatagctctactaggcatttcaaaagtgcagcatatcatcacatgctctaattaaagaaacagacatttgcctgaaatttgcaacaaaaatgccacttttataaatttggtaacagtttttatcctgcgagtaagaatgggagaatggggagtaggttagaatgtttactttctctgctttgtatttctgtgatgtttggaagttttaataaagacaatatattacttttacaattaagctattataacaacaatctataaatgttgttctacattataaatcttgaatcaaccctcgttttaaaacaagaaagtgaattattttttaaaggaaaaacaattttgataaataaagtgcctgtccctatagagacagcaaggtgactgtgctaagcttgctccagaaatgctttcgttttacaaattccatttggtttttcattctatcatcgactgtttaatgagccactctagctggcctttccccagggttaactcacaactcttcctaaataatctcagtcattttcctggagcaggtgttgttttctaggcagctcttgccaaagggcagcataataattaacaagcttcagatctggaggattcagggtctcatttctggcaaaggatatgtgtgtcacactgtaatgcttttgaaacttactgttttataaggagattttgacactgtaacgaaagaattcagtatacttcgaaatatttgcttctttttctctaagaacaactctcgaagatttagagattatgtcactccttgcagcaaaatgaagctctattttctgtaaaacttgccattatatttcaggatcgctattttatttcagatatttcacatgttactgggtagctaaagtcagctacactataaattccagacgagacagatccattattcagcctgcacatttagtattgaaactgactcccaaatttacgaagcattaatgacttgaaaaggaatagcattccatgataggaaatgcagacagtatgaggttcaaatgctgtccagatttagtttgatctggagaaaggaaatgttcttaactttagatattaacaactagatcctttagacaaagtgcctaaatgtccaaaaatatgcatagagcttcttactgtggtttgctccataatgcttctctctgatatgtcttatctgatattttaggagttcgtgatgattgtcgtctttggtttggagttcatcattcgaatctggtctgcgggttgctgttgtcgatatagaggatggcaaggaagactgaggtttgctcgaaagcccttctgtgttataggtgaatatcagagtctcagatacctggactatgacaccaacattcttgtcttctatctcctgttttgcaatatttgattaatattaaaagctaacatccatggagtacttatcatggaccgggcactcttgtgtcttgaaaatgttgactcatttgatgttgtctccacagcattatgaggtagatatttttattatccccattttacagttgaagaatttgaggcaaagagagacggagttagttgctgaatgtcatacagctactaagtggtagagcttgaattttagccaggcaatctggctctagaatacccacttatatcaattaacttatatggaaatacatgtttctccagtgttgccctaatttaggggaacattgatttcagtgagtataaaaaaccctttttgctctacaatatgacaccagtttatgctctggatcagctggaatagatagccatacattggtactggtaatgcatatcaattaacattcttcaagaatgattataagtatggtttgcttaatgcattggtaactgtagactggacaaagtgctctacactctgaaatatgaatcccccaccctccaatccaaaatacccaaatacatagcacatctctgcacctccctagctgccattgtttctgagagacatcattcacctgggttctagcttgaaattgtacttcctaatgaagatgccatagagcattctggaattaagatctagcatttcccagtaatatttaaaagtattataaaatggaaaagtctatatataaaagctattattattattatttagtagctaaatttggctctcttgcttttttgtctttctcacttcctaggcagccattcaaatccaaatactgaaaattcttgatgaggcttatttatttcaactattttcaacctgaaaaagtaggtttttaatttacaaaatagtttaggctatcttctacagctaccacaggttttctgttttgttttaggagtcaggaattgttgcgtaatcttctcagtttcctcccttactcctgttccctatggtgggggcagagtggatttaaggaagaaagtgtatcaccatccatgggcactgttaagaagaatcctttattccatacttctttcatagtatgcacatctcaaaagtctccacttattaaaccagaatttatggaaatgtggctgtgtgtgaggcactggtgttacaatagtgaatctagtggaattctcagttaaatctatcttaaaataccttgtttggccctcacgaatgcagtctgtttgtctgtcttctccaataataggctttactgctttttggaagccatcatgctaaggtatggagcaaagtcggtggtaactccaagccttgcaggttcataaagccccaaggcatattagtgaaggcattagatttttctccctggagatgcttttttctctctgaattctctactcaggcagcattacaaaggactgtaacctgatgtgaaactactgcacaacaagtactttctgtcccataaggggcccaaacaaaacaattcacaaggcagatggttagccaagattcactcaacttctacaggataaggtcagttcatggatgactggaaaaatgtttcattccagattttaaaaccaattaaaaattggttttgttccaatttcagaagcaatgccaatgtatctctggcctccatgcgaaaaagaaagctttttcccagatgtctgctgccttttgatagctgttttcagctacggatacatcaacacatcttagtcctttagtctttctcttcctgcctcagatccttgcaggtcttgatataatatgtagttctaaaaatgatgttatgttatctataatcttacttgcctttggatgtatcaatagtgaccttaaaaatttagtatgatgcctggcgcagtcactcctgcctgtaatcccagccctttggaaggctgaggaaggcagatcacttgagcccaggagtttaagaccagcctgggatggaaagacctgtctctacaaaaatttaaaaattagctgggcatggtggcatacacctgtagtcccagctactcagaaggctgagactggaggatcatttgagcccaggagtttgaggctgcagtgagccatgttcctgccactacactccagcctgagtaaaaagagtaagaccctgtctcaaaaaaatactagtatgacatggtttaggcataattgcagttttgttaacccttcagaccttttctttatttagatattttacctctaggaaattaattgctttggaagaaaatttcatggataaatatataatgaatccccattagaacaaagtctagatttgtacttacagttaggataattatgaattttttagtcttttattaaatgtacatgtttgacccatggtccagctgaatggatgttatagtgaagcatgttcaaatgtggcttatcagtatgaggtcagtaaaatttaacctacacaaaggaatcaaacatcaccttcctgaaggcagcaagctgtaccagatgactgttgagactatttctaggcccgttcaacaggttcataaaaacgcttgatgtaactggtaaaatactaaagtgaacactgtagtcgccttgttcaacctaatttactgtgacaaaatgaaaaaagaaatagcatctcttatctgtccctgataactgttctgaatgggtgtttggaaatatagctaaaacctcccaaaacttcatgtatttgtaagatttgattactctgaacattccaagtacacacccaaatatttttagaagtgttgagcattcgagaaaagaacatagaaaagattgtggtagactggctgtgccttcaacctgggaaatgctttctgtaagcacaccaatgtttttctttccagttggaaatacactgaagctgctagagtggtcagctaacaagccccatgtactattgcaccctattgacaaaggcccaattgatagaggttttatgggctaattactgaaggttttagcatgtccccttctgaactgcccaccttccttacccctgcactctagccaaaaccaagagcatttcaaaagcccactgatctcacaaatcctaaaatcattacatatttgtgtttggaaaacatattttaaacaattataacataagggaagaaataaatctatttaactttttttaattaggtactttgtttcattactactgtacattgatgtatgtctgcttggttttaagcatttgctttgaaaattagtaaaatcttatctagaacataaaattcttcctcatatctatgtgttcaatttttatctctcccctaagactcttctgtcataataacattctatagctatgagcactaattgctgtattgctgatgtggatagtcaagtgtgttttgggatgaccacccaagctgcccttcatttacccagactggctgctttatgatttctctatgtgaaaacacaaaacactcacccaataacatcggcataaagaatttgtgaataacctctaagactgatttcatagtcattcttttttctagctttcattactgacctacccaaaaattgcaaatagacctaaggctgaaacttgggtcacaataatgagcctgatgtgtcaggaagccaacaaattacttctcacagtggctttttttagattccttggtgacgctttccaaaggcagatataacagggccatatttttcagtcttgcagggagtctcagtgagaaaataccagcctgttgttagtcttggatctgcatttgatgctaagtgtaagttgatttcttattgttattttaacagtttattttcagtgtaattatttccacaagaggacaaaagaggaataaaataaaattttattttatcctacgtggataaaataaaattgaagcctttattaaaatcgaccacatggctgagactactctaatatatctatgatttcatcttattaaaaggcaacttaagttgctaatgtgttcaaaagttagatcagactcccaaaactgccactgtgttctaaattgattttgagacatcatttttctgtttctctgtcttctctatcttttgttctaagagacttactcttcaatggcattattttctataccttctactcccttttccctttagtagaaattatattatttcacttattttctgttagtcatacactcttctgcaacttattacttctaagtgttcaaactccctcagtgcatgtagattccttccatgtgattaactggaccatctgaggacaattaaaacctgttggattggctgatcacaaaacattaaaacaattttaatccctctagttagtaatagctgatatttattgagaactactatatattaggtactactttaagcactttataaatatggtcttatttaattctacataagtactataatgtccttatttattttattttattttactttactttattttattctattttattttattttattttattttattttattttattttattttttgaggcagagtttccctctatcacccaggctggagtccaaatggcatagtctcagctcactacaacctccgcctcctgggttcaagccattctcatgcctcagcctcccgagtagctgggactacaggcacacgccaccacacccagctaatttttgcatttttagtagagataggatttcaccgtgttggccaggctggtcttgaactcctggcctcaagtaatccacccgcctcagcgtcccaaagtgctggtattacaagtgtgagccaccacgcctggcctttataatgtcccattttatagatgaggaagtaagacaagactgaagactttatagatgaggaagcaagacaaacttaaaaagatgataggtgaaagaacctggatttatttctcatgatttcactctagaaaaatatacatacccaactggaaaattgtctttactgtttattagcattttaaaattaaatttaattgaaccttatctattgtcatcaacttgtaaacagaagaacatgatactattatgcttatcattagtaattcaagatctttaaagaaaagccaggctttatagaacattaattgcagtatcagccttaattatatcaactaaattatgttacctattgctgctctctaacctgaatgggaaattaggacctaaaatagacttacttacctgtatcaaacttgcatatactcttcagttgttgttatcatgaggctccctgtgtatttccaaattggagacctctggagagcaagtaacattactcgcaggactaccttcaaatgttttttaacattaataaactatcggtaatttagataattgttgacctggtacacaaacttgaaagttgaacttacaagacagcttgattagctgatatggttggaccacatgaagaaaatttatttccgaagaggaaaatgaataaggattatttcccactctttctataaactttagtagagcactatgatatactgtattaacattctgtactatcacatgttacataagaaaattcattcacagacagggtatttattatgtgtcaaacataatcttaagtataaaggatacaaaagcgactaaaacacggtccctgcctgtaagaatagaatctcctgtgcccttagagaatggcaaaacttaaaggaggtatactataattatggtgttacagagcaaaggtgatggaaattgaagtagtcctagaaagaaggctatggaatatcatgagtgattgtataaaacaaagaagcaaaggactacccccaggttttcaaattatgtttgagtcatccactgaacatttatacaatttctaccatgtccaagcatgcttatggatgctggagaggctgtatggcaccaaatgggcaaggtcttccttcttatagagataatattcgtgtggacgaagaaaaacaatacacaaatatgtttttgaaaaacaagataatgtcatctacagataagcacaatgaagaaaataaaacagaaagagtagaggctaccttagcttgggtggtctgagaaagtctttctaagtagttgacacttgagttgacctgaatattaagaagaagccagccatgaggaggtttagacacagatctttccaggccagggaatagtaattgcaaggattattaacacttgatgagcttgggttgtacaaggtggagacataaggtctcgtggctggagctcaatgagcagtggggagaatagcagaaggtgataggggagacaggcagaggtcacaccctgaaggccatgtagcctctgctaccctgaatcaaggttccttctaaagacaggccaccaggcaaaggtcctacgggttgctggcaggcctaatatgaatactattcaggttatgaacagcagcattaatcaggcaacaaaaagtatggctgtttaatgccctgggttttttagtcatgtatgcctgttggaacttcatatcagcaatatacaaattattacccatttatgtttataaaaaacataaacataagtttataaggaaataatcctctgaattttgtttctatatttctgcccttagaaacatgaaattttacattgttttttaaaatgttatttttctatgaggaactggaattagaatgtgatggaaacttttttacagccccagtggtatcaccagtaagcagttcctaagatcctccttgccaagggactctattccatactcttagttatgatgattgcagtgcagaattatttcattaaagattgtttatttcttttgagaaattgtccctttttgccttgagatgttatctgaaactgtatgatcaataagaagcattaaactgtcactatggggtaaattttcaaagtggtgcctgcaatttgccagtatgagtcccattaacttctgtggaagtcctgcagttaaacccctgcacatggctttgaaaatgttctacaagtttgtctttgtggtgccttttttatttttaataaatatcacagagcaactcagtgcatagttgattgcagtatttaagaacgtggataatgtactgtgcaggaggagacttttaaaattagattttaaagcttcatttctattaagagtcacaacaacaatataaatacatctttagttcttcaaagagcacctttctataaaggaatttggagctcaattagaatatagagcttataaagcagcaccatgtccctctgagacattgtttacttcactctatagatggaaaagtcgaggcactgtgaagtgggggtgctttgtccttagcccataaatcagcagtaaagctaggaatagcatgctggcctcccaatagctcattgctctaaagcactgcctcttgttagagtcaaatttaattatagtataatccgtttaatctacatgtggagaaataatgaaggagcaggaaaaatgaatttcttaacagatcagtggaaaaccatattacatagattagcaactgtcttttcaagatccgtattttcagcatgtactagatggtatctgatgccatgaaagcaaatattctaattccactggccagaactggcaaagaacttcttattttcctcactttgaaacataagtaaaggggttccacttgaaaattaataagccatgtgatatgattcgattcctgtccccaaatctccctccttctaggggccattgtctaaagtctaaaagaaaacataccaggcacagtggctcatgcctgtaatcccagcactttaaagggagagcaaggtaggaggatcacttgagcctaggagttcaaaatcatcaacctgggcaacataatgagaccctatctctacaaaaaaaacaaacaaaaacaaaaacaaacaaaaaaaactgtaatagctgggtgtggtggaacacactggtagtctcagctactcaggaggctgataggagaaggtaacttctgcccaggaattcaaggctgcagtgaattatgattgcaccactgtactgcagcctgggcaacagagtaagacagagagagagagagacaaagagaaaggaaggaaggaaagaaggaaggagggaaggaaggaaggaaggaaggaaggaaggaaggaaggaaggaaggaaggaagggagggaagaaggaaggaagggagggagggaaggagggagggaaagaaaggaaaggaaagaaaataaatgtaactattataaaagatgttcaatgttttattttggaataactttagacttacttagaagttgcaaaaatagtacagaatttccatgttcaaatgtactctttacctaactttccccaaaatattttacctacgtatactgcaattatcaaaaccaggatatgaatacatactattagctatagtctttatttgaatttcaccagtttttacatgcgctcaatttttatatacactcctataaaattttctcacatgtatatatgcatttaaccaccaccacaatcaaaatacagaacttttccatcaccctaaataaacttggaatgatatactttgtattattcctttacaggtactccctctcttcaatcctaacctctgggaaccactatatctgttctgtttcactgtaattttgtcatttttataatgttatataaatgaaattgtaaagtagtaatcttttgaaattggctttttcttacacagcatgatgctcttgagatccatccaagtgcatcaatagtgcattcctgtttattgcttaatagaattccatgatctagatgtaacacaatttgtatattcatttacctaatcaaggtcatttgggctgcttctagtttttggctattacaaataaggcagctatgtacattcatgtgtaggtttgtgtatgaacgtaagtttttatttctctagggtcatatagtgctagttcacctttatcagaaactgccaaactatttccttttaaaatatagaaatgccaatgcaaacatgtgcatggaggtcagcagccccaccccctgccccacgctgccactgctgccagtgtgaacatatgcatggaggctggcagccccacgctcaccactagcctgcccctgcactgacactgctaccagcatgagcgtgcacatggaggccggcagccccatggccaccagcactctgccccagttgatgagcattcaccccaccacactgccacttgctcttggcactgctcttggcacttacaaatgagcacagatcctgctgccaccaccccaacaaagtggtttggctggcaccacccatcagagtattgtggccagaggtgcaggaacaccttagcgcctccactttagcagtttcctaacctcaaggggccagagaataaagtcagagatccagtaacagcctcccaaagttgcagcatacagcccaaaagttctgagctgagccttaccccctaaattcttccagaaatgaagccagtcaactgaacccaccttatatgagattcaaaccttccagggcatcaaagaagatagaggcaaaaaaaaaaaaaaaaaaaaaaaaaaaaaaaaaaactatccaaaggacagcaatttcaaagactgaaggaaaatcagcccacacagatgataaagaaccagtgcaagagctctggcaactcaaaagtcagagtactttcttacctccaaacaactgcagtagttccccagcaatggttcttaaccaggctgaaatgacaaaaagagaaatcagaatgtggataggaacagagatcactgagattcaggagacagtgaaaacctaatccagggattctaaggattacaacaaagtgatacaggagatgaaagacgaaatggccactttaagaaagaacagaactgatctgatagagctgaaaaactcacttcaagaattccagaatacaatcacaaatataacagcagaatcgatcaagctgaggaaagaatctcagagcttgaatatcacttctctgaaataactcagtcagacaaaaataaagaaaaaaagattaaagaagaatgaacaaaatctccaaagtatgggattatgtaaagacaccaaatctatgactcactgatgtccctgaaagagagggagagaaagcaagcaacttggagaacatatttcaggatatcatccatgaaaattcccccaacttcactagagaggccaacattcaaattgagaaaatgcagagaacccttgtgagatactatacagataaccatccccaagacacatacttgtcagattctctaaggtcaaaacaaaacaaaaaatgttaacagcagctaaagagaaggggcaggccacctcccaaggaaaccccatcaggctaacagcacacctttcagcagaaactctataagccagcagagattgaggacctatattcagcattattaaagaaaagaaattccaaacaagaatttcatatccagccaaactaagcttcataaatgaaggagaaataagattcttttcaggcgagcaaatgctaagggaattcattaccatcagacctgccttataagaggtcctaaagagagtgttaaatatggaaaggaaagattattactggcaactacaaaaacgtgcttaagtacacacaccattgatgccaaaaagcaaccacacaaacagatctgcataataaccaattaacaacacaaaacaggatttgatccttcaaatccacacatatcaatattaaccttaaatgtaaatgggctaaatgcccaattaaaaggcacagagtggcaagttggacaaagaagcaagacccaacagtatgctgtcttgaatagacccatttcacatgcagtgacacacataggatcaaactaaagggatggagaaaaatctaccaagcaaatggaaaacagaaaaaagcaggagttgctattctacattcaaacaaaacagactttaaaccaacaaaaatcaaaaaagataaagaaaggcattacataatggtaaagggttcacctcaaaaggccagacttaactatcctaaatagatatgcatccaaaacaggagcacccaaattcatagagcaagtttttagacacccacaaagagatttagataaccacacaataatagtgggagactttaacatcccactggcagtattagacaggtcattgaggcagaaaactaacaaagaaattcaggacctgaatttgacacttgactaaatagacctaatagacatctacagaaatctccacccaaaaacaggagtgtatatattcttctcatctgcacatggcccataatctaaaattgactaatcagccataaaacaatccttagcaaataaaaaaaaatcataccaaccacactctcagactacagtgcaataaaaatagaaattaatggaaattaacctgcttctgaatgacttttgggtaaacaatgaaattaaggtagaaattcagaaattatttgaaactaattagaacaaagatactacataccagaatctctgggacacagctaaagcaatattaagagggaagtttatagagctgaatgcctacatcaaaaagttagaaagatcttaagttaacaaccgaacatcacacctagaggaaatagagaaacaagagcagatcgaccccaaagctagtagaacacaagaaatcaaaatctgcactaaactgaaggaaattgagacgcaaaaaaacatacagaagatcaatgaatccaggacttggttcttcgaaagaataaataagatagataaaatgctagctagactaataaggaaaaaaagagagatcaaaataaacacaatcagaaatgacaaagggatgttaccacctaccccacaaaaatttaaaaaaccctcagagactactaaaaacacctctatgcacacaaactagaaaacctagaagaaatggataaattccttgaaacatacaaccttccaagattgaaccaggaagaaattgaatcctggacagagaccaataatgagttccaaaattgaatcagtaataaaaagcctaccaaccagaaaaagcccgggaccagagggattcacagctgaatattacaagaagtataaagaagagctggtaccattcctactgaaactattccaaaaaacagaggaggagggactcctccctaactatgaaaccagcatcatcctgataccaaaacctggcagggacacaacaacaacaaaaaacaaaacttcaggccaaatccttgatgaacatagatgcaaaaattctcaataaaatcctagtgaaatgaatccagcagcacatgaaaaagctaatccaccactatcaaggaggcttcgtccctgggacacaagtttggttcaacatatacaaatgaataaatgtgattcatcacataaacagaattaaaaacaaaaaccacatgatcatctcaataaatgcagaaaaggcttttgataaagttcaacatcccttcacgttaaaaaccctcaacaaactaggcactgaaggaacatacttcaaaataataagagccatctataagaaactcacagccaacatcacagtgaatgagcaaaagctggaagcattcttattaaacaccagaacaaaacaaggatgtcctctctcaccagtccttttcaacatagtactggaagtcctggccagagcaatcaggcaagagaaagatataaaagccatctgaatagaggggaagtcaaactgtccctgattccagtcagtatgattctatgcccagaaaaccccataatctctgctccaaagctccttggtttgataaacaacttcagcaaagcttcaggatacaaagtcaatgtacaaaaatcagtagaatccctgtgcaccaacaacatccaagctgagagccaaatcaagaatgctatcccccaagcctgccaccatggccacctacaaactggtgcagatccagcacagcgagagtgagtggaacctggagaaccacttcagcggctggtacgacgccatcctgagcccagcgggccatgaggcggcaaagcaggcacggcgagatgctggctatgagtttgacatctgcttcacctcattgcagaagagagcgatcccgaccttctggacagtgctagatgccattgatcagatgtagctgccaatagtgaggacttggcgcctcaatgagcagcactatggggctctagccggtctcaataaagcagaaactgctgcaaaacatagtgaagcccaggtgaagatctgcaggtgctcctatgatgtcccaccacctccgatggagccctaccatcctttctacagcaacatcagtaaggatcacaggtatgcagacctcacagaaaatcacctaccctcctgtgagagtctgaaggacactattgccagagctctgcccttctggaatgaagaagtatttccccagatcaaggaggggaaatgggtactgactgcagcccatggcaacagcctctggggcactgacaagcatctgaagggtctctctgaagaggctatcatggagctgaacctgccaactggcattctcattgtctatgaattggacaagaacttgaagcccatcaagcccagcccacgcagttcctaggggatgaagagaccatgtgcaaagccatggaagttgtggctgcccagggcaaagccaagaagtgaaggccagcaaacaggcaccctccctgcccattgcatccatctgtccctccctcctgaacatgtcacactgaccacatctatagacatcttgagttgcagctgcagatggggaccggtggctcccattttcattttagccattttgtcttctgcacccactcccttcatacattctagtcagaatagcacttctagggcacaggttctcagtctaagctgtggaaaagccccccttatccaagagagttcaaagatagtgacttgggtttttgcaagtgctttgtttactaaggacttgtgaggaggagccatgctgagctacgaccaatgaggagaagcaagagagcctgtctgcccccaggagctagtcctgtgcttgtctgtagtcaggccactgcctgggggctctagtcatcccagtggaagatgaatgtaacctgcatggtgatgtgacaactgtttcctccctgaccccagaggaactggctctagaaggttgggatcaatcctgaatttagtttatgtgttacatttacttttatttaaaaaaaaaaaagtatagtgtatataaataatacaaaacaataacccttctaagggtttctcgtggtggttgaaatagtcccacatgtggtcatcagaacataagccattcctcataccaatatggggtaagctccttgacctttgaggggcaggagtgcttcatgctgtgtgttttagaatccctccctgccttgtttcatggcagtgaaatgcctcttggtcctctccaagtgtgtttttcactgatttctgaatcatgttgcagttgcttggccctgccacataggtctagtgttcatttgagcataactgtactaaatcctttttccagatcagtataataaaggagtgatgtgcaataaaaaaaagaatgccatcccatgcacaccagttagaatggtgatcattaaaaagtcaggaaacaacaggtgctggagaggatgtggagaaataggaacatttttacactcttggtgggactgtaaactagttcaaccattgtggaagacagtgtggtgattccttaaggatctagaactagaaataccatttgacccagccatcccattactgggtatatactcaaaggattataaatcatgctgctataaagacacatgcacatgtatgtttattgcagcactattcacaatagcaaagacttagaaccaacccaaaagtccatcaatgatagactggattaagaaaatgtggcacgtatacaccatggaatactatgcagccataaaaaaggatgagttcatgtcctttgcagggacatggatgaagctggaaaccatcattctcagcaaactatcacaaggacagaaaaccaaacaccacatgttctcactcataggtgggaattgaacaatgagaacacttggatgcagggtggggaacatcacacactggggcctgtcatggggtggggggaagggggggagggatagcattaggagatatacctaatgtaaatgacaagttaatgggtgcagcacaccaacatggcacatgtatacatgtgtaacaaatctgcacattgtgcacatgtaccttagaacttaaagtatagtaaaaaaataaataaataaataaaaatttaaaaaatgaataaaatacatagaaatacagctaaccaggtaggtgaaagatctctacaacaagcattataaaacactgctcaaagtaatctgagatgatataaataaaaggaaaagcattccatgctcatggataggaagaagcaatattgttaaaatggccatattgcccaaagcaatttacagattcagtgctattcctatcaaactaccagttcttcacagaattagaaaaaaaaattatttaaaaatttgtatgaaaccaaaaaaaagcctgaatagccaaggcaattctaagcaaaaacaacaaagccagaagtatcacattgtgtgacttcaatctatattacaaggctacagtaaccacaacagcatggtactggtacaaaacacatagaccaatggaacagaagagatagcccagaaataatgccacacacaaaccatttgatcttaaacaaacctaacaaaaacaagcaatgggaaaagaaattcctattccataaatggtgctgggataactggctagccatatgcagaagattgaaattggaccccttgtttataccatatacaaaaatcaactcaagatgggttaaaggcttaaacataaaacctaaaactggccgggcacggtggctcacgcctgtaattccagcactttgggaggccgaggcaggcggatcacgaggtcaggagatcgagaccatcctggctaacacggtgaaacgccatctctactaaaattacaaaaaattagctgggcgaggtggcgggcacctgtagtcccagctactcgggaggctgaggcaggagaatggcgtgaaccccggggggcggaggctgcagtgagccgagatgctgccactgcactccagcctgggcgacagcgagactccgtctcaaaaaaaaacaaacctaaaactataaaaaccctggaagatgacctgggaaataccactctggacatataggacctggcaaagattttatgacaaagacaaaagcgattgcagcaaaaacaaaaattgactaattttgtcaattaaactaaagggatctaattaaactaaacagcttctgcacagcaaaagaaactatcaacagagtgaacagacaacctacagaataggagaaaatatttgcaaactatgcatctgacaaaggtctattatccggaatctgtaaggaatttaaacaaatttataagcaaaaaaacaaacaacaccattaaaaaatgggcaaagtccttgaacagacacttgtaaaagaagacatacacgtggccaagaagcatataaaaaaatgctcaacattactaatctttagagaaatgcaaatcaaaaccacaataagataccatctcacaaaagtcagaatggctattactaaaaagtcaaaaaataacagatgctggcaaggttatggagaaaaaggaatgcttatatactgctggtgggaatgtaaattagttcagccggtgtggaaagccgtttggcaatttctcaaagaactcaaaatggaattaccatttgacccagtaatctcactattgggtttattctcaaaggaatgtaactcattctaccttaaagacatatgcactcatatattcatctcagtactattcacaatagcaaagacatgaaatcaacctacatgcccattgatggtggattggataaagaaaatgtggtacatatacaccataaatactacacagccataaaaaagaacaagatcatgtcttttgcaacaacatggatgaggctggaggccattcacctaagcgaactgacacaggaacagaaaaccaaatacacatgttctcacttacaagtgagagctaagcattgagttatatggtcacaaacaagagaacaacagacgcgtaagcctacttgaggatggaaagtgggaggagggagagcataaaaaaactacctatcaggtactatgctttttacctgcgtgatgaaataatctgaacatcaaacccccataatatacaattcacctatataacaaacctgcacatgtaccacagaacctgaaataaaagtttaaaaataaatcataaaataaaatgttgaaatgcctagaatgtttcatagcattaaattagaccatgctgtcttaaatgacatcttattttcatagaaatcatgtttctgctttttctgtttttctatgaaaatttttttaacaagcagaagttaacgaaatgtatattttaccacttgggtcaagaaacaaatgaaagtattgcccattaaggagcagttcttcatactgtgataaatgaatgtaagtattatgtttacatagatgaagtataaagagaccaattaatgtaaaaagccaatactgtacaaattcctgaaggaccattttttaaatctaactttaatttttagaaagtccttattcaagcaaactttactgagaccaatactaattatactttcctgctaaaagatacagataatgacattagttagagccttaaagtactactccaatggaataaaatatttaaaattgccaccaagacccagtggtgctttatagagagttgggtccaatattcatggttctaatgtgatctaaaaagaagtcgtttgttctccttaattcaacacctctcagaaattgccctattcttaaaactattctctaagactacttttcctccaagactctgccaaatgtctccccttggatcttccaccataaccaacaaaaacattattttctcaaagttagaaacaaccctgtgtggccaaaatatatgaatcccaacttcattctcactctggttgtaagaaatgctggaataattaattactcatttggaaaaaattaaagctgtatccatatctatcttaccagattccaagataaactccaaataaatcaaagatttaaattaaataagaccataaaatactgggcagaagaaattggtaaactctcttagaaccttggaatctggaaagattttctaattataactaaaaatacaaaagtcataggagaaaatattgatagaatacataaaatcaaagaatactgtatgataaactaaacagcaacgtcaaaagacaaatgtggaaaaatatttacaactcctactaaaaaatagaaactaatcaccttaaattataaggagctctagaaatcaagaaaaacccaacaacctaacagaaaataaaatggatatgaacagactggtcacagaataagaaatacatatatacctcttaaacatacccagtctcactcataaaaaagaaatgcaaatgaaagcattctctcacctatcagattggcaaaaatctgcagtttgaccacacactttattgatgagactgcaaggaaataggcactcacatgccacaggagtgcaaaggggtatcacccttatggaagagtgtcaatatctaccaaaattacttaagcatttactctttgacccaggaagtctacttcctaataatttcatcaatttgtagtaaatgttcactatagctgaataaactattgtaaatccaaacaataaaatacagtggaagacctttctgcacagctacagaagaatcccaagatatatgaaataaaagaaaaatgaaatgtaatactgcatatatagtgtgctacttttgtgtaagaaaggagaaaaataaaagttgactttcatattgcttgtgtttgtataaagaaacattgaaataatttttacaaaaagaagagaataaaaatgtttaactgaggatagcgaatgaggacagcatgaatggaaacgggtaggagtaagatttttcagcatttacctttttatgtcattttaatgtttaaaatataaatatgttaactattcaaaaactaaattaaaagaattattgcctggcacagatgaagtacagtttagatgttgactattattatttttgtatagcaatatttggatgggttaatgggctcatattatgtacagttgttccgaatctactcacactccaggcacttttgtcattgcaaagagggacaatgccaaagataatttaccataggatttccatgtgcacctcctcagttctaggctgaagtaacatagaatggcatttttaactcacgaaaaactctgttctaaaaggtgctttattatttgccttaatttgctcttcatatatttccttaattttaaacttagaattttagttgtaacttttcaaaggattgcccaagaagatgcaatgagatgatacatgtaaagtgcttagcttaatgcctggtgtttaatcaatactccataactcttagtggtagcaaacagaatcataaaagtgatgtgttcagtgaagcctctaatcaatcctagaatcgatacctacaatcagaaaaaaattatcaactcagaccatctttgtatgtttttgtttattatttttcctcaaaatatcttcaataaggcattcctagaatttgagagtctgtgtatcttaaataagaatgcattttattttaagaggtaaatggaaggagcaagaaccaagacaggtactttttgagtctggagtccttagatataataagtaatttcaggaatggtatgtatggtacctaaaggatgtggtttaattagaagggcttttgaagctttcttgtagactggttgttcattatggcttcatctatgtttctcccagaaggcttccctggcctcttaactaagttaattgtccctgcaatgtgctccttgtatttcttctgtcataatattcatcactcatgattgtggttactcgattcagcgtcttctatgcaaaccatgctttcagccttgtgcagacagaaggcatccatctggtccacaccagccatgccctttaatattatatgcccaggtcctagaagtttctggccacaatgaatgtgtattgaatgaataaaaaattgagaaaactgcaagctagtaaacagtcacatgagaagcgtcatccccccggcccccatcacaacccctacacacacaaagtaaaaacaacacagtcaacatgagcaaatagagaaaaaaaatgtggcaattattcaagcaatgcaaggtgaaaaatagcccctttgcctcagttatcagaggttttcaaaaggatattttttgcctgcattttttaatctaattgcttcaattattttatttggtcatgggaacatgattatattttttaataaagtgcttaatttgcatgcatgctttgaattgtaggttcttttacaggaggcttgtctactcccatattgcctttttctcaattattttacttctgccttttgcaaaatgttttaaatatttgattttagcccctaccacagactccaaatctgtgcttggaatttggagatcaaagtactgtagctaatccttaggacatttgccattgtgtgacttaagaatccatctcttatcaagtttctgtggttttctggagtatttacaggtcacaatgtcaaaatgtgcacatctgaaactatttttgaattatgctttctttatactcttccatatttagttaatgggaaaatatccagctcctgaatggtattgaactcgattaggccatctccagtctccttataaaagattcctaagttgtagtatcacatgttttcaataaaccttgtttttgttctcctttaaacagagcgtgtcttattcaaaaagctcatgacagtaggaaaggaattgataatgaaaagaaagtgagtccgaaggaggatttttcctcatagctttaggatttgttataagacaatgtgtttcaccgcctgacctgcagcttcaggagttggttgccatgaattctgatcctgtttctggaagtaatttatcgcattatcttgtacaagcttctctgggacactctttctttccttttaagcacagataagagcagcaatacactttgcagcgttcataaacagcaatacataaaagtaaatatgaaattagaaagttccaaaaactgctctaatctagtgccagtgagggaaaattttggtaaggattttataagtaaagatgggagttagatgcataattatatgtgacctgtttggttaataatcccactgaaatacagatagatgatagatagatagatgatagatagatagatagatgatagatagatagatagatagatagatagatagatgatagatagatagatagatagatagatagatagatagatagatataatagatctacacatggcaacaagcaagattttcaaaattataatgaatgtcaggtatttattcttggcttatatttactcaaattcactctttaaagtgctatctttttattcttcacaggaggaaaagtctattttcacaccccaatgtttatccctaaggattagccaagtgcctaaactgtatccatttcatatttccaaaaataggaaattgtgcattgaaaaatattgagagccaggtgaaccaggtaattctaaattttcccagataatacttagaatgaattcccatccataaatgtcctttgctaagtgacgtttcatctcaagtggcatctccattgtaacatccgagtaacacagtctattcaaagaacttcctgaagatatcctttcaaaaacttttagcagtaggtgatgattaatcataatctgtatgtcatctgaaaataagtatcaagtttcttaaagaaaaattacatatcccaacactactaaacataactggctgctaagtttcagagggtccatatcatttaactgcttagagtaagtgcaaaaagggagtattataaattaggtattgtagttttgctctgtaaatttaaacccataatgccattgtttggctgttgatgtttaaatattcaagctatgaccttgaataagatatccaagcatggaatttcatcataggatgttgggatttccagcagatgtttcaaatttgattattcattggtggaatccaaatctttttttttttaatctgcagtcaaatactggtatggggttctgtttagaaatcaaaactgactgcagctttgtcatttggtaggtgtgaaaataggtactgaagaaaattttaaacatctgatggtatcaacgtgcaaaattgctgttcctaaaagctgtctcaaactttctatataaaagaatataatataaagccactgtatcattgccctaaaccatgttctaaagcatcagaaaatacacatgacttttcatctcttcgatttattgaaaactgatggaattacacctaggtaatttactcaagatactagactatgccttaaataggatgtgcctcctactcattcatgatgactctcaggggacaaatgcttctttcctgttttataaatacagaaacacagcttccttacctccttcagtctgtaacccacatctgaaattaaatgtttgtgatcacactttgaagcaatttgtttcagtaggttactgatattgcaagggattcgtcctgtagcatgagaaaaaaaaaaaaatctactgcctgactctgcatccctgacctttcccccagactccagccccattcaccatctaccaaatgcctactagccatctcaaaattaacatggccataacggacaagtagttctgcccttcaaatagtgctcctcacctatccccagtggtatttccccagcttagtaaatagcactttattcacctgattgcttagaccaaaaaccctgaagtcagccttagactccctcgtttgtctcatcccacagtcagtccttcagcaagtcttggcctctccaccttcacaatgtgcaccaaatccagctcctttacagctcctcctgactttaacctcactcttgtaatgctgctctcaccctttgtccagaccacagcagtggcttcttacctggccttccagcttcctctctgacatctggcttcctttctggcatccagcctcttcctggttggtttcccaaaggtaaccaaaatgatcttgtgaaatacacatctgatcctgcactctgccaaaaaccctttccctgccgctatcatataatacttagaaggacatctaaagctattcccaaagctgtcgtgatctggctggagccttctctcactccgctcaagctaacttgatctccttgccttcccttgaacacactgaacacacttccacctcaaggtctttttatatttttttgcctggaaccatttttccttagatatgatcacggtcaccccttcacttcgttgggtcatggctcctctgagatgctttcccattgagacaaccgaaaatactaaaaacggccgggctcagtggctcacgcctataatcccagcactttgggaggccaaggtgggtggatcacttgaggtcaggagttcgagaccagcctggccaacatggtgaaaccccatctctcccaaaaatacaaaattagcctggagtggtggtgcacacctgtaatcccagctacttgggaagctgaggcaggaaaatcgcttgaacccgagaggcggaggttgcagtgagctgagatcatgccattgcactccagcctgggtgacagagactgtctcaaaaataaaataaaaactaaaatattaaaaacatgttaattataagatgtttgctaaattttacctgaatatcaaccatttgcaagtagttatattccctattcttaataatactttacttcttggaacttcacattaagatagagcacccgcccctctgtgactccaccctcatcctgctctgcatttccccagggtttttgtcactacctaacattatattctgtacttgtttattgctttaacatcagcctaccccaggagaacataagctccatgagggcagaaaactcttctcttttattcactgctctatacctcatgcttggcttatagtagacatgcaacaaaaaatatttgtcgaatgaactaatgaatgaataaataaattgccttaacacttaatttgagaaaagtcatatccaaaacactccttctgatgcttcctcgttcaaccagtatccaaaacaaaaaatgtaccacttagaatttgagaaattcaaagttagaaaggatccttgagacttgccagttcaatccaactattttaaaggtatggaaaccagccctgagagataagtggtgacaaagctagttaatggcgaacagataattaaactaggcatagttcaatgttctttatgcttccatgctttacatctctgtttcttttgaaagttccttctgtatacataagcaaatataatggaaccagaacacttctattccttcttatcttgctgctctgttggcaataaaacatctggcacatgatatacatgggacactaaaaaaattataaatttctgcagaaaagggctcacattgataaggcagattgacctctctgtctcaatctgctgtcccattgggacaacctaaaatataaaaaacatgttaattataatattttcgctaaattttacctgaatatcaactatttgcacgtagttatattccctattcttgataatactttacttcttggaatatcacatgtaagcctttgcttgactttctacatccctgtttactaggctttctatgacataaaagctaccaaaagagaaacacgggaaaaaaatatataagtgctctggaaacagaaattagtttgatttttggctccatttaccagctaaatgactttggataagattcttggactttcttagtatcaaattactaatctagaaaagtgaagggaaaggtatatctataaaacatttttttttagattgagagttaacatgataccaggcacactaaggcagactaaaggctttatatgtattatttcatttaatcatcccaatagccctgtgagaaaaagggatctattccctatttgcaggtgaggactccaagactcagcaagattaataggcccaaggtcacacaactaagaaaggacagaactagaaatacctgggctgttgcacatgaagtttatactcataacctctgtgcctccttgaagggctattatggagaaacaatgaaataaagtctgtgtactgagcatcccgcacagcctcatacatcagaggtactcaataaatgttgcccatttctcttctgttttcccaccactgactaaataaattaccttggccaatgtactaacctttctaggccatagcttcttttttaaataagttatggttctcttttttctcattacaaaagcaatacatggctattaaagatcatttggacaaaagatatatatatatatatatatatatatatatatatatatatataactaaaatttgtatggaatcttaccacctaaagataatcaccattaatatgcaaatgtatgtatttatactatttatttttctatatactataagaatacataatctggccaggtgcaatgactcacacctgtaatcccagcactttgggaggccaaggctggtggatcacttgaggtcaggagttcgataccagctcgaccaacatggtgaaacatcgtctctactagaaatacaaaaattagttgggcatggtggcgggtgcctgtaatcccagctactggggaggctgaggcaggagagacacttgaatcctagaggtggaggttgcagtgagctgagattgcaccattgccctctagcctgggcaaaaagagggaaactccgtctcaaaaaataataataataatacataatattttgggagagcaaaactgaaatcctgctatcctgctatgtaatcagttatttaaataatgatgtttagaaacattttatctcacaatattcttctaagacataatgttttgtggctgtatcgcatttgtggtaataataatagtaataataaattagctcaaatgtatgttagtattgtactgagatgtttcacagttaacttattcaattcttgcaaccctatgacataggtacctttattatctacattttacagataaagaaactgaggcacagaaagattcagtcacttaacaaggtaacccagctattaagcagcagagccaggattggaactgaggcacatgagcaccacagcccatgctctggaagggatatagcatgttgttttttattaatccatcctcattagaaatctggattggttctcattttttatactgctactaatagtgttaggtatgagctgggaggagaaaaaaacaatagtttaataagtatgctgctgcaaacttgttaacatctacaattttatcatacatccctacagtttaaattcctgaaataagttattcacattgttaatggttttgtcaaataatgtcaaattgctcccccaaaaaataccataccaatttattcttacagaaaatcttcatcaaataactttttttctctgccttgccaacattgacaattcatttttttaaactttgtcagtttgatagaataaaatggtacctttctagtattttaaatttcaaaactagaaattgtaaagaacttttttatatattaattagtcattgtttcttcttcctaggataaattcgtctatgtgccttctgtccaattttctactagcatgttttcttagtgttttatgtttatatattaaagatattaatcttttgttcatcatcatatatgttgccatttttttccaggtttgttttttgcatttcaatctgtgtagagttcttttttaatgtatggaattttcgtgtgttcgtgccttcacttctcaactgcaaaatatgggagattaaactatattgtttttaagacctttaaaattataacattgtattctatttctttcctaattactacaaacaaataacttatcaggtaagtatctatcaaataagttttgaacatctacagtatgatatgtacggagctagtcactgaggttacaaaaaaaaaagcacgtctgcatgcagttggtttcttatagcttactatagaagagaccagcaagtaaacagactactagtataatcatgggtaataagtgttatgacaggagcatacctcagacctctgggcacaagtggccttgactggttgatatctgtgctgagttccagaagcaagcagaagtgagccaggtaaagaagggagaagggccttctaggcagagcagcagcattttatagagcactttgaatgccaggtagcagaatttgatctttcttctatgtattggaaggccttttttaaatcacagaggtagtataatcatcttaacattttcatgtggtagtagaatacaaagtggtttagagaaaggaaaaacaggagagtgaaaaccaggccatacattgtagggatgaccaagagagaagtagcgtagcctgaactaaggaggagacaggataaatggaaagagaaaattagatatgaaacatactatggaagcagaatcaacaaaagtaaaccactcagtagatatgagacgaggaagacaataaagaaggagatgttaatccgtgaatttaatatgaggtctgtatcagaattttgttgtttaacttgattcatttattctgaaattcacttggtaaaaataaatacgtttacaataattgatactactttgaaaaagaataacatttgtgtcacacgaatataggaataggcaataaaacataatagaatcccaaaataggcttctcaataagtatatgcaaacatttggagaatgacagagtttttatttagatggtattgggaaaattgactttcatatgggataaaaagtaagattagttctctacttcaccacagagacaaacaaaaattccgttaaaactaatgattgtataagttagagtaatgcttagttattatataaatctccaaattctagtaactaaataaaatagaagtttatttcttacttgtgtaatagtccaatgaaggtgttctttgtttggggttggggtatatggtaaaggctctgttccatgcagttattcaggaacccaggctgacaaaagcactgccatcttcagcacatggtttctaagggcattcttagtaccaaactgcaactgacatagaaaaagagaaagtgataagccatatgtgcttgccctcaactgggaagtggcatacatcatttccattcgtcttcattaactagaattagtcacctcatctcacccagaagcaaggggtcccgggaaatgagacctctagatgggcaaccacttctcagagataatgctgtaccttagaagggaagcacatatctgtggtagacagctagctacctttaccacaaagactattctgaatagtaaacataaattcattaactaaataaggatgtaagtgtgccaaaataaaatataggaaaatatttttataatcttggttggacaaagtcattctagataacttaacttctgtgacttaaaaatgacatgaaatccaggcatctaaaacaggagggggatggttttgtttttcccactgtatttgcaaagattgaagacttataatatcccaggtaataaatgagtgtgcttagaaccatgtctatcacatagtgaacagtaaacattagatttactagtactatttttattattattagcattcctttttattagcaaggagagagaaataagtgtttccatacattgttagtgagaattggtaccatcattttgaaggcatcttgatatcaatcacaaatcaaaatatgccaagaattcagtctcaagaaatttagccttaaattccttatcctaaaaataaatgtacaggactattcgtttcagcatcattttaatagcaaaaccaaaagtaacctaaaaattcattaataagtgtcttagtctatttgttttataataaaggaatacacaaagctgggtattcataaagaaagtaggtttatgtggctcacagttctgcaggctgtacaaaaagcatggtgcctgcatctgctcctggtgagaacctcaggctgcctccactcatggcagaaggtgaagtggggccaacatgtgctgagatcacatgacgagagatgaagcaagacataagtgccattttctttttaacaaccaaatcttaagggaacttacagagccagaactcagtcattacttcaaggacggtaccaagccattcatgagcgatcctcccccatgaccaaaacacctcccattaggcttcacctctaacactggggatcacatttcaacatgatatttggaggtcaaatatccaaactatagcataagtaattggttaattaaataaattagtgtcctaccttatatacatttgtattgttttgatattttactttataactttaaagtgtatattttattaaaattattcaaaacttagcttatagtgaggccactagaataattcaaaaaactggaacaaaaaaatgtggtgggagagggggatataaacatcaagaacattgtatttgtcgtacttctgattgtctcagagagaacaagatgaagtgagtttaaagggaaagaggtaaatttatgttagttattagggaaaactttctgagactatagaataacttttaatttacaaaaattttaaaagcctgaagtctccagacagtttctagaagtcaagatataccctctttgtggcttacttacctcgagagggtttatctgtccttataactactagtttgaaagtgttcaaccatgctttgtttgatccagatgatttagttcttttcattgtgattttacattgagccatgttatactttctaatacatgcattatgcagtgtaattgtagcaacaaaacacagtccatcaggttcagatgtacaattggccttgctctaacccaatccttgagttcacaatagggaagctttggatgtaaataatgaaggctttttggtatttcagtgactaacaccttttagacagggtccatggtgatcaattcatattgattttgctgactaaataatacttgagcaaagttccagtggcatctaaaaataagctctttcacagtccttatgtgtcttaaatatcattatggtatttattttgttcaaatctttgcagtcacctcaaatttcaagaattcatgtgtaaatcattctaagtgatgcagtaaattagtgaacctacttcctaataccttgtaaacctatatttcacatttctactgggctgcttataatcaatagctctttcttcactacttcccaacttgttctaatttgtttcctttgagagaggtagattttaagagttctggattacatgcttttttttttattcatgtgacttagagctcctccttgtttattagcagttctatttctttctctagccccattttctcttgaagcagccataaaagtaccatctgtttttcagcatcattttatttctgctttctcctccctgcacttttctcttctctgaatgctttatgcgataacaatttattcctgatttattatccacctgctttcatagcctccccctttctgttcctcctccatccctatcccaccctggatggagtggtataccataattcttaaggacacagctttggagtcaagtaagggccagctcaaccacttatgcatgttagtgacttgaccactatgagcctcaatttcttcatttataagaaagagaaggttataatatcatctactacataggttggcttgaagaattaaataaaataatgtacatcagggtttctcagccttggcactattgacatttggggctgagtcattctttgttctggaggctgtcctgggcattgtaggatggttagcagcaaccctagtctctaccactagatgctcgtagcaacccccttcccagctatgacaatgcaaaatgtctccagacattgctaaatgtcccagggaggcaaaattgtccccattcggaatcattgatgtatataaaacatttagcacagtgcctggtacatagtagggacttgatcaataattgtgatggatggatggtcagatgaatgattgaatattcatttttaatacaagtgtctaatataattcttgacagtcaattaactacttaatacataaatggataaacaaatgaacctgaagccagtgagcttcaagggctgtccatagtttctaccttacaccaaaatgtgttatcttcactaaaaacaagcttcctatgtttcaaaaaatattttagacaattaactaactgcacagcttaagctactcccccaatttaatatatatgcatatactttaaataatagggagattttaaaataaactctaatggatgatagctataacaattatgttgctatagaattcagtgctagaaattgaagtgatcctttgattaacctgagtattttaggttgatatcccagtcaacaagccattgatgtggtaagagaacaaagctcagccaacttttaagtgttttttaatctaatttatcttatttaaatatttattgagtgcctactatatttcaggcactgttctaggtactcaggatacaattgtgaacaaaacaatgataaaacactgtggaaccaccattctatgaaatagtagatcacaaaaatagtaaatacataaatagaagtaaaaataaagactactcataacttgtaaaatactagcctaggaaatagtctaggtggtactgacagcaaaattccagtggatgactgtaacccaaccagaaacatttttgtgactgcactcactgtttgccatttggttgctcatctatgatttcagtttactgaactctaactttctcgtctgatctgaattacaatgagggtattaaatcaaatctgtggttacctttgcatattttggaacttcaaacatttagattgtgattcactgtgtgcataattttttaaattgtctcaaatcaacaatctttctcttacttttctaggttttctctaatgaactaactttatagcatactttttgtgctgtagtctaacaaaccgatagctgagtttttttaaaaatgaatacaatatatgctttttctgcctcgcttttttcatctgtaaaatgggatctgtgggatacctaacacataaagtcattgtaaggattaaataaggtaatgtttattaaaaaaaaaaaaaaaccttagaactgaagaaaatgccaagcacatagtaagttttaagtgtagtattttctgcacccctactagccatgtacttatttctagtatttccaatattttagcatagtaaatgaggtagtatatctttttcttttctttctacacttgggagaaagcaagattacaatgaaataaaagcaaaatgtatgtccaacagggtcatataagtaatgtctgtttgtaaaccactagtctcaggagtaaatccctcaacatgatgaaaaccaagagatgtgtttgcacataactctttttataaagtttttttaattgcaaagacatagtcgttgttataaacttccaacatacagaaattaataatttacaaagtgaaaagcccctttatgcatatattcacttcagctcactccctttagaaataattaatagtaataatcagcgtatagtctcacttttttttttttttttgagacgcagtcttgctctgtcgctaggctggagtgcagtggcacgatcttggctcactgcaacctccgcctcctgggttcaagggattctcatgcctcagccttccaagtagctgggattacaggcacgtgccaccacacccagctaatttttgtatttttagtagagacagggtttcaccatgttggccaggatggtctcgatctcctgacctcatgatccgcccaccttggcctcccaaagtgctgggattacaagtgtgagccactgcgcccagcctagtctcaaatttttttcctagtcatatactaatatatatttctattaaaataaaatcacattgtacatactgttttgcaactggcctttattcacttaaaatatgtctttggtgtcagtgtcaacacatttagttccttcttgtttccaacagctgccaagagtggtaactctctttggctctctgggtacttacccacaaaagcacatgcatttagagctggtggaaaaagtccttcagggcggacaccggtggctcacacctgtaatctcaactctttgggaggccaaggctggcagatgatgtgagctcaggagttcgagaccagcctgggcaacatagcaataccccatctctacaaaaaaatacaaaaattagccaggcgtgttggtgcatgcctgtagtcctagctccttgggaggctgaggtgggacacagaggttgcagtgagcagagctcatgccagtgcactccagcctgggtgatagagtgagaccctgtcaaaggatggaaagagggaagaaaggagaggagaggggaagaagccctttggctgaaacttgcactgccaacaactgaccccccctctctctcaaagcactgacccaaaaaggggcaccagcagagaggctcagaagatcttctcagtccacaccaggagaccagacctttctcagtgcagggagaaggatgagctgaatgaggaatactcacttatacagcagttaatccagaggatgacagaaacattacaaatgtgacatccttgaaatggaactcctctttggagtgtggaagcccagtcatgcacaacccacttggagcaggaaggaaattgtatttgaggatgttaaagtcaagctaacttttattaaaattgccacaggaggccattcatccccacttcacttatcccacttcaaagcctacttcccatcactcagatgtttacttatggagtgattaagttttcttttatcttttctatgctttcatcagatgctctttttctcttttttgcttagaaaaggcagattttttcagcctaatgtcaatatgtcaaacattaagtattcattcccttgcaatgcacagtgtttatacttacataccctattataacaaatgtaatattatttaattatgcagcaaacttacacataattggtgaacaggtctaaagaatactctatacaggaagcatagagtattcagcttagctgaggcctttgttaaacaatatgcaaagttgcaggtgccacattagggaattttgggggaaaggaaatgcaaacttatttggcaggaaaacaagagaaatgattatatctcacagcactttcaagctggacacatttacatgcctctgtcacatcacccagaagctgtggtgttgagggctgaggcaggagatccttttgccacaggaaaaaggatgaaacgagagacattgtgaaaggttgccccaaagtcttaaggctccctgaaaccttgggttttttgaacaccattgtccaatctgttgaaggttaaataatacgttgttcaaaattgcataggtaaagcgcagaatggccaaagggtcagaactacagcaataggtaggtcccattctctgccttttcattcttcagtcttcggaaatgccacagaggccaagtggcactaggtgcagctgggaatcaagatctgtttatctgtaccttaaataggtcaaagtgaaccttttggaaatattgttttggtaaataaaaattcctggtcgtgctaactgtggctatttcgacctgtttctttcagataccattgttcttatcgcttcaatagcagttgtttctgcaaaaactcagggtaatatttttgccacgtctgcactcagaagtctccgtttcctacagatcctccgcatggtgcgcatggaccgaaggggaggcacttggaaattactgggttcagtggtttatgctcacagcaaggtaagatttgctctctgaatttaaaaacacaatttttgaaactttttcattgatcgctgtaatagttaataaacctgtcacaagaaaacttagtcattgcagaaaatggttaaaacaattttgggacatgatgtacaatggattatttaagagccatcataaacatccaagaagtagtaaagtgaatagaatcctcatagaattcttttttcctttttcaaagatttcccacctctaaaaatctttcattccttttatatctaggaattaatcacagcttggtacataggatttttggttcttattttttcgtctttccttgtctatctggtggaaaaggatgccaataaagagttttctacatatgcagatgctctctggtggggcacagtaagtataaaaatacattttttatttattggatgttgtgaattgtttttttttaatacaacgtaatggttcctatggatggtttcaataaaaatattaaattgcgaaagagagttatatggaaaataaatactacttattattgtctaaaggctttccacatctttttaggccaactaagttgtcttgtaaaccatcattaatatttcttgagtgctagattgttgccaaaattaaaaatatataaaatatataaatatatatcatttttaaaatggtgattaaaacattgatagtttgtttatttgttttaactttgtggagcacaaatttaaatgatcaattgttgcattgattttccgctcttcaaaagtttatctggggttaaaaaatgaatggaagctgtgaataaaattgcagcacaaagaaatgaaaaagaagactggtaaccatctgtgagatcagagattatagtcacctaatttcaaaactttcctctcaaaacctactttttctttatattattaaagaataattttccaaataaataaagtaaaatcatgattcttacatagaaagaaaattaacacatgctaaacattcatttaactcattttaaaagtttaagtcattattaatgaagaaaccagtaagatgttaaaaccagttcaaagcactatccaaaggacagaaacatttaaagatcaggaatattgaaatcaatgtgcaaatagaggcaaaactggctccttccacagtgtgggagggaagtcagttcaacctccactaggcagaatttatttacatgtccataggcaagaattattttgcattgctaccagttatcaacaacttacagagttgtaaaatagctcaaaggctatgaaaagagcagagccccataaaatcagaatccaaaaacctggaagggtgtactctgaacaacgcatagttttccactgaagcaaaaattttccctgcattgtaaagaatttatgaaacagtcattggagctatgccgtaataagaatgacatgggatataggagtgctttatgcaatgtataaattacatttctttttattttattcctttaaggtattccaaaggggagttatatgaaaataatcatagccaaacatggtggctcacgcctgtaatccaagcactttgggaggctaaggcgggccagttgcttgagctcaggcatttgagaccagcctgggcaacatggcaagaccccatccctacaaaaaatacaaaaattagccaggtgtggtggcacactcctgtagttccagctacctgggaggctgaggtggcagaatcacttaagcctggcaggtagattataaatgcttgtctaaagaatgtccatatcgttttggttcaaaaaaccccgtgagttctcttttaaaccacccttagtatttcttgagttctagattgttgccaaaataaaaatatatcattttcttaagctgtgatttaaacaatgataggctttttatttgtttgtttagtgaagcacagagttaccaattgttgcattgttccactagtcatcaaaagctcatcagcaagacccagaacatttgtcagagagggggaaaatttgttagggctgtatttagcagaacttgttgtatttgttgattgcatagcagcaataaaatgaataaaaatgagaaatacattcacctaaagattcgaatttttttcttaagttatctaagtaaatgtctacaagattatgccattggtttcaaaggattccgttggtttaataatgtggtttccggctgctcttcactattcacaagcaataatgggcatttcgaaaaagagtggaagcttgaaagagagcagtcatctgacactcttaaaatactttttatatgtagagagcaaatgaaaatctgtgactcatgatgggataaactgtaaactgagaaaacaggaggcttttcttgccagcaaggggaagacagtttatcatcccagccttcaaagcaatggtttgaattcaagtttaatttttgcttctcttggataattctaatgtatttgacttactgaggcacccaggtgccccttttgccactgagatgcagttgttggtgagtttagcctgggagctcattatctttctttttattagtcttccatttctccttattacaaaaaagaattgctgtattgtgtgttaaacagtgtgtgggaaactcttaatatacctctcagttagtcatcagtttgtttcttttgccagaataacccacacggtaggttttcaaaggtcatatctgtgactttcaggggaagaaacattttcattgatttgcctttcagttctgctaatttgactgacatttaacccgtacttaacaggttcctgaatggcctaattatgtttctatttttaaaaaaaatctagtcttgaatatgagagtaaaaattttataagagatcaaacttcgaagaattttttaaggccttattggtccgtagcaggtttgttgatattaactgactcattaatgaaattgtctgaatcctaaaaagacagaagaagcaaacaaacaagagagctcattgtttctattcattttaagaagaacatatactagattcctagtgggaaataaaataaatttagactattataccttttatttatacattaatcaagaccttagtgaaaattatggttgggtatttcttagttaaaattgcgcatgttgcacctaatggaaaccttaataactatggaagtatccagaataaatagggaaatgatagcatcctaaatgagagtatttctaagtgttacactttgatgaaaaaaggaaatcccctatattaaaagatcccacagtatcaacattaagtatcaaaatataggttttgttccacagatacgctgtgccagtgaattttcaatactaactctggaactccttccattaagatagtgagatctgtcccctagatcaacatttggagggatatcatggtgggatcagtgctgcccaaaaaactttgatccctgaaagcagtttcatattagtgaatagcaatacctagttcattgagtaagtgaaatagatataaaagacctggtaccaagaacatagcaagtgcccaatcaaatatgagagctattgttggtgtagacatcattgctgtggaagttaaatgaaagcacctttaatacaaaaggaacaaaaaaagagctatgtgttttgatgcagacccacagtttgaacacagaagaggcttgggaattggaggttgtgatgaaaagatgtcctgggttctgatgtggcaactaaagttgcattgatggcagaaaatggaagagggaagtagctctagtagctgaggcactgagagttgctggaaaaggggatcttctgattgttggatagagctccatttattatcattttctattgttatttttctcatttttggttgttccagatttattctgaaataatttaagaatgggtttccctggagttattttctgttattaaatccttcctgttttgtgggagtgatttttctctttttgatctgctttagatttattttgaaataacttaagatcaggttttcctgcactccagcctgggtgcttgagtgagaccctgcctcaaagactcccttggggagaattataccgtgccacggaaatctaccaacagtatattgttcacctgaacacattagctataaactaatgtacatagatttactaaaaacataattgtatcttcaaaatcaggtcaataaatatttgttgatttgttgcctgaaagaaagaaggatttatatctcctgatttggaattaattctgctattgaaaagaaaaaaaactttagcctaaccagtgtcttaaattataatctgaccatagcctcagccatctcatttaaaaaaaaaatcaagaaaagtctggaccagagttttcatttgtttttcagtattatttctgaggaagaattcctgaatgctaaacacacgaaggtgcccccactccacctcagattttcctaacataattacaactttatgccaacatttccaacccacagattttcagaatgtattttctttcacctgtgtgactgtatttgagcataggaaacataagggccaaaatatatctaagctgtttctatctgcaagacgccttcaaataaatggtccagctgaagagatggtacaaaataccagggattcctgaggccagctgtggggaggtagcagggcaaagcagaccatccctgcccagatcctcatccgccttgttaccctgcagcctgaaaaggcagctgccagcttctcagtttaagaactgtggcaagaaatggcagcttctcacttaaggagaatactactctgcctagaactttactgaaagagatggtggacatttttgtcacttgtaatttgtttttaattttaaaaagtaaattcaaaacgtcatgaccttacctatgatattataaagatcatactcaaaagtcacgagtatgaatcacagaagatttttataataaaaatgtaatctatccagtgcatgttcaccagcatatctcttacaagctctggaatgaggaaaaaaaatggaattatgtccaatatcgtgatgtaaagatccatctctctattctcctgcttctcatctcttacacacacgtatatataagcaaaatgtcacgctcacatgggtgtgggaaatcaaagctcacgaaacactatttagtttacttgcccacttatgtaaatattgtatttgttttagaatagagtagaagctctcagaacttatttcctcttcactgactggccagattaaccaacactcctcactcccacaaaacatactgaggcttgcagagcacaaaatgctctttagtatccacagaattctgttctgaacattgtttgaatgcttgcaaagagtcagcatgttcattaccaaacctttttttttttttttttttttgagacagggtctcactctgtcacataggttgcagtgcattggtgcatttatagctcgctgcagcctcaacctcccaggttcgagcagccctcccgcctcagcctcctgagtagctgggaccccaggcacatgccaccatgcccagctaattttttactaattttttgaagaaaaggggtctcaccatgttgcccaggctggtctcaaactcctaggttcaagcaatctgtctgccttggcctcccaaagtgctgggattacaggcgtgagccactgtgcccgtcccattcctaaacctttttatgtcagttgtatttgtaattataatggcatggtttaattttatattattgcataaactgatgacatatggtacagaaagaaagatggatggtttacgaaaatagaatgctttagaaaagcttgataaatgcaaaatactaaatatgctaaaatactaaaaatacttcaaaatcaggggtgaacacacaactatgtgggggaaaaatcttaaatatttaggactctgttctcagatagctcccacaaaagttgagtttatgcaccactaaaaaaaaagttaattttaaaaaacattaaaattaaggaaaataaatgatgcattatgagtgagatttatgcaaaaaagataaggcagaaccccaattgcagaacacattcttcatcaagaatattacatttatgtgctttaggctaaaataaaatatgcagcatataagtctctttgtgattatctgcattagtcaaatttctgactaagcaaccaagtagccatcataaaagtttcaattaagaagacttctctgtgtattctcatgcattaatatataatatcagaaaattatctcaccaacagagaataacaaggctgtctcataagaacatttattttacattgattcaactgctttatggttctactaattcccttgcagcacatttgctatgcagagtaaaagtctgatgtattgtgattcacttttaacactgtatatattagaagagaattaaatgctttgactcaggaagtatcaaaaatatattagtacaaaaagaacccattaaccgaccacactttagttctttctgtcatcccaaacccacccaatccctgtcatccccacctacctagcccatatgtagtcatgaagcatcctcatggttcacccgagatgaacagagtcactgggtttaattccagcaccatcacccatgggactcaacccttgcaccctaatgccatatgcacatatagaactggcagagaattacacaacaaagggggcgggatgtgatggaagtatcttcaaaggagcaactacattatttatttaatgttggattcccagtctaaagatagtgtaaagggattatttatttaatgttggattcccagcctaaagacagtgtaaagggagtgtgttatttatttgtttttctttataacagtaatccattttttccaaaatcagctctggctctttaacttcatttggcccatattactgtgttaactgtatactgttaagtgataatagcaacctgcccttctgcctgggagtcactgacgtacgcagtttgtaagcatctgcaatacagagatgatgagatacaattgaataagtcatcttcccatgccatgccatcaggatgctgctgggttcttgaagatctgtgagaaatgtttctagaaaacgaactgactgcctcatcacccaattcaattgtgaagtctagatgtgatttcctccaagcccctaaagatcgcatatgcagcctctccaggttctctgaaacatgctgctattccagaatctccccacttattctgaagaacgggtgcccttgggttcttgtgtgggcctgccctttctccgaccctgaacctaaatgaaactaatcattactgggttctaccagtgaaaagattcataacatttttggaaggcagaaagaggtttattatttagcacaagcatgggagaataagaaccaagagggctcctgctactcagttcatgtacaaaggatcaactgataaacattagcagggcctcccaagtgctaggaaaagaaaagaaatataatgtagttgtacagttccaaggagactcactggtacttcaagggcagcttgacctgaaagtccagaaaaatcaatgaatatctatgcagcgctcatctaaggatggtttatcaaatgcagctggtccttgacttaaaatgtcaaagccagatcaagcagatgggtcagggtgaatacctggaaaaaattaacatctttttattgtaagcacatcttaaagacttcataattttatgtctggtgctatctttctgttcacatcatgaagcccaggtgtcctctttgccaccacagaagggaaatgatgcatgcacgctccaggcaaaaaacgagggaaacccacaccaactccctctctggcatagagggggacaaaactgccaccctgttgccagatccttcccaagcctaagctgccaacaaaaggcccctttgctttaaccaggaaacatccctagctcctttgaaatcagaggggagaaagttattgaggctgggggttcagttgctggctgttcaggtcccttgcattcagtgaaatgtgatcatcccggaagcctgaaccggagtgtagggagaaagtgggcagggtctttgctcacccccagaggaactccagagtgctgttctcagatttcacaaccttctattctcccccgcaaaccacccctgtaagagaaaggggcaaccctaaattcagaatgaaagaaagcaggcactcttttctactcaggatgaaacactgagcacattgtcacttggctgtgtcccattcttcagagttagagtcagtggtttaaaacccactctgtgagcactgggccgagcaaatgtattattggaatgaaaagcaaaggaaaccacgaaatgtaacatttttgctgtgaccaaaccatgaaagttcttcttcagtctattattattaataaaccgatgtaaaaggattaagctatttttcagaaaaagtatagtagattaatatctgtcccacatatataaagattaagaataaaattgacctggaaattttttttctgcattctcaaggaattcttttgagaattccatattaatactgctgatgacattagattaatttggctcctgtaaagttctactacatattccctctctctgacattgaatgagttcttccaaccagcagacctcttattaacctgtccttgaccccttctcagaccttcacagcccaagcctctttgcctattccaagcctctgactccccacacatgatcccaccttctccttgtctataattgaaaggacagacataagcattcctaatccttccctccactcacactgaggccacatcatacccccactgtggaagcgctgtcctttcacactgcctgggctaacccctccaactgtgcccttaaccgaattccttcttgggtactttaccccatcaggaagccgccaccccttccctcttcagtctcaccctctctacaaacatgcagaagtacatcctggaaagcctcccttcaagtcagagattcctgggagttcttgccctctacatctcacttcagttgttgccaatgttcttcaaagtattattcatttatttactaaatatttagtgagtttctctcactttgtggcaagcattatgctagatgttggggaaataaagagcaagctgaggttccactttctagttaaggaaataagaatccctacccaaagaaaaatacaacagactatcactcacgttaatgttattacgaaacaaggagctgtaatatagagtaatcagagtctctactgaagataggtaggaaaggcctctccaatgagggagtattttggataagacctgaaggatgaaaaggagccctgggaagagtgaggaaaatggcaattccagctgagggaacagcttgtgcaaaggccctgaggcagaaagatcctggcttgtttgaagagccaaaaggccactgtcattaaagtgcagtgagcaagggtaaaatcaaaatgatcttaggtaggtggagatggcttaattagtagcttagaatttattttgaattcaacagctagccattgaaggattttttagatggaaataagaaaatgataccccttgcaggtatatgaagaaggaactagaggaaagcaaaagcaaaagcagagagagcaattaagaggctactatagcagcctggtctaccatggtggcagcaaagacagagaaaagggggtgaatttgcaaaaacctaaggagatcgaatcaacaggacttgctgatagattccgtggggggagtgagggaaatgaatagttaggatgattctgaggcttctgacatgagcaagtggatagattggtggagctcttggttaagacaggaaggaatatatttggtagaaataagagttctgttttagacacattcagttaaatgactgtgtgacatctaaatggaactgtcaactgcagatatgtgaattgggaactcagaaaagtggtctggcctagagatataaatttggagtgtttagcataaaagtggcatttaaatctatgagaacatttaagatcacctggaaagagagaaaaaagaggggatagaaaagaaaggaaagtctaagaagaatacaatttttaaaagaagaaaaagacttagaacaaaaccttaaaaatccagtgtccaaaggttgaaaagggtaagaggagccacagaaaaagagccaccaaggaatacaaagagaaaaccatggaagtgaagagaagagtgcttctagaaagaggtggtcagctgagctgaatgcttctgaaaggtctggcatcatagaatttgtctccctctttatcaaacctgcttctgaattgttccccctctttcaaagcccaggtaaggtggcatgaccagagcaaccactttctcagtgattgccagtgaccacctatctccaccatattcagtctctttttctcaatgctcattgtccttgttttctttttctctctctctctctttttttttttttttccagatggagtttcactctgttgcccaggctggagtgcaatggtgtgatcttggctcactgcaacctccacatcctagattcaatcaattcccctgcctcaccctcctgagtagctgggattacaggcatgcaccaccacacctggctagttttgtatttttagtggagatggagtttcaccatgttggccaggctggtctcaaactcctggcctcaggtgatccacctgcctcggcctcccaaagtgctgagattacaggcataagccaccgtgcccagactcactgtccttgttttctattaggctgtgacatcagagattacctggtctttgtgaaactctccattctctattgagtttccatttatataaccctttcccgattgttctacttttgaaaaacttgaaaaacatgacatccaaagacattcttctctgactttcctttcccttccattccttaaatgtctgtgttttttgaggtgtccctggaccctttctgtgtaccttttgtaatctcagttatgcacatagctttaacatcaccctgttactgattctaaaacccaaatctcacgccaaaccaaatttctctctcaggactcaagctctcattctcagtttcctgctagacatttctgcattagtcatactgacatttgaaaaaccattatttgcaaaactaaactcttcacctttactccaaaaccttctctttttcattataatgcttttatttatggtgcaaccatcttcccacttaaaattttcaagtcactgttaacttagtctttccttttacctcaatcaataaatttatttctattgaacttcctaaacatttctctttactctccactctcatagtgtcttaactggtctctgcacctctcatttcttcctatttcaatctctcctgtacatttgctgccataatttcagcttctaaaagcactactctgatcacattatgtactttgcttacaaaaaccttccgtcagtatttctgggctgcaaaacaagagagcagaatcctatcccacccatagggctttcattcctttattcagtaaatatatattgagtgactactgtatgccaatcactgtgcaaggtgcttggattcagcagtaagataaagtcccaacccacatacaatttactttctagttgggaaggcaaacaataaacaatttaatcaatatacaatatcatttcaggtattgatacattctatgaataaagatgaacagaataaggatttaggaaacagttggtagggaagtagctttttttgttgttgttgattttcgtggggttttgttttgtctttatgagaaaatgactgttattattatacagtgtcccccagcgattatttttctgtaaattattggggaacaggtggtttttggttacataagtaagttctttcacggtgagttgtgagattttggtgcacccatcacccaagcagtatacactgcaccctatttgtagtcttttatccctctcctccttcccatcctttcaccttgagtctccaaagttcattgtgacattcttatgcctttgcatcctcatagtttagctcccacctatgagtgagaacataggatgtttggttttccattcctgagttacttcacttagaacaatagtctccaatctcatctaggtggctgcaaatgccattaattcattcctctttatggctgagtagtattccatcatgtatatatatataccacagtttctttatccactcattgattgatgggcatttgggttggttccacatttttgcaattgtgaattgcgctgctataaacatgcatgtgcaagtgtcttcttcatataatgacttcttttcctctgggtagataaccagtagtgagattgctggatcaaatggttctacttttagttctttaaggaatctccacactattttctatagtggttgtgctagtttacattccaaccagcagtgtagatgtgttccctgttcaccgcatctccaccaacatctactatttttccacttttttattatggccatttttgcaggactaaggtggtatcacattgtggttttcatttgcatttccctgatcattagcgatgttgagcattttttcatgtgtcttggccattcatatatcatcttttgagaattgtctattcatgtccttagcccactttttgatgggattgtttgtttttttcatgttgatttgtttgagttcattgtagattctagatattcatcctttgtcaaatgtatagattataacgattttctcccactctgtgagttgtctgtttactctgctgactgtttcttttgccgtgcaaaagctctttagtttaattaagtaccagcaatttatctttgtttttattgcattcacttttgggttcttggtcttgaaatccttgcctaactcaatgtatagaagggtttctccaatgttatcttctagagtgtttatagtttcaggctctatatttaagtccttaatccaccttcagttgattcttgtatgtggtgagaaatgaggatccagtttaattctcctacatatggctagccaattatcccagcaccatttgttgaaaagggtgtccttcgcttctcaaaagaagacatttatacagccaacaaaattatgaaaaaatgctcatcatcactggtcatcaaagaaatgcaagtcaaaaccacaatgagataccatctcaagccagttagaatggcgatcattaaagagtcaggaaacaacagatgctggagaggatgtggagaaataggaacacttttacactgttggtgggagtataaattagttcaaccattgtgcaagacagtgtggcaactcctcaaggatctagaactagacataccatttgacccagcaatcccattactgggtatatacccaaagtattataaatcattctactataaagacaaatgcacttgtatgtttattgtagcacttttcacagtagtaaagtcttggaaccaacccaaatgcccatcaatgatagactggataaagaaaatgtggcacatatacaccaaggaatactatacagccataaaaaaggatgagttcatgtcctttgcagggacatggatgaaactggaaaccatcattctcagcaaagtaactcaagaagagaaaaccaaacaccacatgttttcactcataagtgggagctgaacaatgagaacacatggacacagggaggggaacatcacacaccagggcctgtcaggggttagggggctgggggagggatagcattaggagaaatacctaatgtaaatgatgagctgatgggtgcaacaaaccaatattgcacatgtatacctaggtaacaaacctgcactttgtgcacatgtaccccagaacttaaagtataataaaaaagataaaattcagccttaaaaaaaagaaaaagaaaaagaaaagggtgtcctttccccattttatgtttttgtttgctttgtccaagatcagttgactgtaagtaccttggtttgtttctggattctctattctgttccattggtctatgtgcatatttttataccaataccatgctgtcttggtgactatggccttgtagtttgaaatcaggtaatgtgatgcctccaggtttggttgggtttgtttttgttgttgttgttgttgtttggttggttgggttttttgttggtttatttgtttgtttgttttggcttagtccttctttggctatgtgggctctttcctggttccatgtgaattttatcattgttttttctaattctgtgaagaatgatggtggtattttgatggaaattgcattgaatttgtagattgcttttggaagtatggtcatttttacaatattgattctacctatccgtgagcattggatatgtttccatttgtttgtgtcatctatgatttctttcagcagtgttttgtagttttccatgtagaggtctttcacttccttggttaggtatattcctaagttttgtggattttttttttgtttgtttgttttttgtttcgttttgttttgtttttttgtttttgtagctattgtaaaggggattgagttcttgatttgattctcagcttggtcgctgttggtgtatagaagagatactgatttgtgtatgtgaattttatatccagaaagtttgctgaattcttttgcaagttctaggagctttctggaggagtctttagggttttctaggtaaacattcatatcatcagcaaacagcaacagtttgacttcctctttaatgagttggatgccctttatttcttcctcttgtctgattgctctggcaaggacttccagtattatgatgaagaggagtgataagagtgggcatccttatcttgttccagttctcagagggaatgctttcaacttttccccattcagtattatgttggctgtgggtttgtcataggtgacttttattacttttattacattgttatattatgacattttattgtcatagatgtcctttgtgtaccagttttgttgagagttttaacgataaaggaatgctagattttgttgaatgctttttctgcgtctattgagatgatcatgtgattttggtttttaattctgtttatgtggtgtatcacatttattgacttgcatatgttaaactatccctgcatccctggtatgaaacccatttgatcatggtggattatctttttgatatgctgttagattcggttagctagtattttgttaacaattttagcatctatgttcatcagggatattggtctgtagttttcttttttgattatgtcctttcctggttttggtattagggtgatactggcttcatagaatgaattggggagggttccttctttatcttgtggaatagtgtcaataggactggtatcaattcttctttgaatgtctagtagaattctgctgtgaatccatctggtcctggactttttttgttggtaattttttaactaccatttcaatctcattacttgttattggtcattcaggctatctaattcttcctgatttaaactaggagggttgtatttttccagaaatttatccatctcttctagattttccagtttatgtgcgtaatggtgttcatagtagccttgaatgatcttttgtatttctgtggtgtcagttgtaatatctcccatttcatttcttcttgagctaatttgcattttctctcttctttttatggttaatcttgctaacggtctatcaattttattcatttttaaagaaccagctttttgtttcatttatcttttgtattttgtttgtttgtttcaaattcatttggttctgctctgatcgtggttatttcctttcttctgctgggtctgggtttggtttgttcttgcttctctagttccttgaggtgtgaccttagattgtctgtttgtgctctttcagactttttgatgtaggcatttatggctataaactttcttcttagcatcgcctttgctgtgtcccagagatcttgatatgttgtgtcattgttgccattcaattcaaagaattttttaatttccatcttgatttcatttttggcccaatgatcattcaagagcaggttatttaatttccatatatttgcatggctttgaaagttcattttggagttgattttcagttttattccactgtggtctgagagagtgcttgatataatttcaattttcttaaatttattgaggctcattttgtggcctgtcatatggtctaccttggagaaagttccatgcactgaatagaatgtatattctatggttgttggatggaatgttctgtatatatctgttaagtctatttgttccaaggtatagtttaaatccattgtttcattgttgaccttcagtcttgattatctgtccagtgctgtcagtggagtattgaagtctcccactattattatgttgccacctgtctcatttctaaggtctgttagtaattgttttataaatttgatagttccagtgttcagtgcatatacgtttaggattgtgatgttttcctgttggactaggccttttatcattatataatgccctctttgtcttttttaactgctgttgctttaaagtttgtttgtctaagaataggtactcccgtttgcttttggtgtccatattccaaaaatgtctttttccacacctttaccttaagtttgtgagactccttatgtgttaggtgagtctcttgaagtcagcaggtagttggttggtgaattcttatcaattctacaattctatatcttttaagtggagcatttaagccatttacattcaacgttagtattgagatgtgaggtaccattccattcattatgctatttgttgcctgtataccttggttttttgttttttgtttttgttttttaaattgtatttttgttttataggtcctgtgagatttatgctttaaagaggttctgttttgatgtgtttccaggatttgtttcgagatttagagctccttttagcagttcttgtagtggtggcttggtagtggtgaattctctcagaatttgtctgtctgaaaaagactgtatctttccttcatatatgaaggatagttttgttggatacaaaattcttggctggtaattcttttgcttgaggaggccgaagacaaggccccaataccttctagcttatagggtttctgctgagaaatctgctgttaatctaataggtttttatttataggttaccaggtacttttgtctcactgctcttaaaattctttcctttgtcttaactttagattacctgatgacaatgtgcctaggtgatgatctttttgcaatgaatttcccaggtgttctttgtgcttcttgtatttggatgtctaggtctctagcaatgctggggaagttttcctctgttattccctgaaatatgttttccaaacttttagatttctcttcttcctcaagaacactgattattcttagctttggtcatctaacataatcccagacttcttggaggctgtgttcgtattttcttattcttttttctttgtctttatggagtgcgttaactgaaagaccttgtcttagagctctgaaattctttcttctacttgttcaattctattgctgagactttccagagcattttgcatttctataagggtgtccaaagtttactgaagttttgactgttttttatttatgctatctatttccttgaatatttctcccttcacttcttgtatcattttttggatttccttaaatcgggcttcacatgtctctggtgctccctgattagcttaataattaacctcctcaattctttttcaggcaaatcagggatttcttcttggtttgggtccattgctggggagctagtgtgattttttgggagttgtaaagaactttgttttgtcatattaacagaatcggtttctggttccttcttatttgggtaggctctgtcagagggaagatctagggctgaaggctgttgttcagattcttttgtaccacagggtgttcccttggtgtagtactctccccctgttcctatggatgtgacttcctgagagctgagctgtagtgattgttatctatcttgtggatctagccacccaacaagtcttccagactccgggctggcactggggattgtctacagagtcctgtgatgtgaaccatctgtgggtttctcagccgtggatgctagcacagtatttagggtgtctcctaggtccttcaggagcaatctgcttcctgcagggggtctgtgggtcctctctattttcgttttaaaggcagactttgtaataggacacactagtgggcaatttatagttgtatactcataagcaaactgtttaaattatctgaatccaagtttcctcatatgatcacaagatgaggtcccacaacaggtcgtctgcaagctgaggagcaaggaagccactctgagtcccaaaaccccaaaagtagggaagccgacagtgcagctttcagtctgtggtcaaagatccaagagtcccaaaattgaagaacttagagtccagtgttcaaggacaggaggcatcccggatgggagaaagatgtaggctgggagactaagccagtcttgggaagtggcttaaattaggtgatctgggatggttttctgtggagctgacatttcagcaggtacctgaatgcaaacctggaagtaacagaaattcagaaagagaaaagcaagggcaaaggtccttaggcaaaaaaaaaaaaaaaaagagcttggtgtgctgatgaatagcaaggcaggaggggcagaagcagaatgagagagagcatggtagaagaccatatctgagaagttagctgaggtcaatcatgaagaaccctgcaggccatggaggagctgggactttgttctaagagatgtggggaacgcctggagcagtctgatcataggagaggcatgatattcaaagacattccctggcctagctttagcatatctagttaaccttctctttactaatcctttacttttctttcattgtaaattgagaaattatagttgtatatatttctggggtagaaagtgatgctatgatttacaaacacaatgtggaatcattacatcgtgctaattaacatatccaccacttcaaatacatatcaatttttgtggtgtggctgggtgcagtgactcactcctataatcccagcattttgggaggccaaggcagggggatcatttgaagtcaaaagttcaagaccagcctggccaacatggtgaaaccctgtctctactagaaatacaaaaattagctgggtgtggtggcggatgcctgtaatcccagctactcaagaggctgaaacaggagaatcacttgaacctgcgaggcagtttgcggtaagctgagaccgtgccactgcactccagtctgggtgacagagtgactcagtctcagaaaaaaaaaatgtggtaagagaatttgaaatttagtcttagtaattttgaaatgcacaatacacattactaactgtattcaccacactgtgcaatagatctcatatatatatatatatacacacacacatacacatattgttcctgtttaactgaggctttgtgtcctttgaccatcatctccccattcccccaacccccagcctctggtaaccagcatactactctcttctaccatgggtttcattgtttcagattccccatgtagtgaaaacatgcagtatttacctttctgtgcctggcttattgcagatcatctcatgagatgcagaaacatcatttgatcaaattttatttcataataaaaatcctcaacaaattaggtacagaaggaatgtaactcaacacaataaaaagcatatattataagccaatagctaacattatactccacagtgaaaaattgaaatcctttcctctaagatccagaacaaaataaggatgcccacttgagcaagatctagtgctgtgctggcttcaggtctaacccagtgcagtctcagtgatggtggccacaaggctgcttgtgtcgcccctcaccaagctccaggcacctcagcacagagaaagagagactcgtttgtttgggagaatgtaaggaagagaacaagagtttttgcccagtaatccagagaattctttcagatcttattcaagaccaccaaggtgatacatctacaagtctacaagaaccatagcattactgggcttggggtaccccttaatgcagaaatgcctgcagtgaccaaaaacttagatcataatactgaagtcccttcaaataccaggaaagccttcccaaggaggatggctacaaacaagcccagattacaaagactacaataaatacctaactcttcaatgcccagacactgacaaacaccacaacctcaagataatccaggaaaacatgagacactcaacataacacagagaatgaattcagaattttatcagataaatttaacaaataaattgaaataattaaaaagaatcaagcagaaaatctggaggtcaaaaatgcaactgacatactgaagaatcatcagagtcccttaatagcagaattgatcaagcagaagaaagaactagtgagcatgaagacaggctatttaaaaatacatggtcagcagagacaaaagataaaagaataaaaaagaaggaaatgcccaaaatatctataaaatagcttcaaaggggcaaatctaagttattggccttaaaaagtagggagagagagagaaagtttattcaaagggataataacagaacttcccaaacctagagaaagatatcaatattcaagtaaaagaaggctatagaacaccaaacagatttaacctcaaagcattcactaataaacttgcaaaattcaaggataaagaaaagattttataagcagcaaaagaagagaaataaataacgtgcaatggagctccaatacatctggcagcagacttttcagtggaaaccttacaggccaggaaagagtggcatggcatatttaaagtgctgaagggaaaaaatattttatccttgaatagtatatctggcaaaaatagccttcatgaaggagaaataaagactttcccagacaaacaaaaactgaggcatttcatcaacaccagacctgtcctataagaaatgctaaagtgatttctttagtttgaaagaaaaaaggcattaaggaaaaactaaaaaccatctaagggtagaaaactcactggtaatagtaagtacacagaaaaacagaatattatagcactataattgtgctaattatttatattttaagtagaaagacaaaaagatgaacttatcaaaaataactacaacagcttttcaagatatacacagcataataagataaagtagaaacaacaaaaagtttaaaagtgggatgacaaagttaaaatgtagcattttcattaattttctttttgtttatttgtttatgcaatcggagttaaattgtgatcagtttaaaataatgggttataagatattatttgcaagcctcatagtaacctaaaatcaaaaaagcatacaatggatacacacaaaaaaataaaaagcaagaaactaaatcataccaccagagaaaatcactttcaatgaaaggaagacaagaaggaaagaaaaaagcaagagaagaccacaaaacaactagaaaacaaataacaaaatggcaggagtaagtccttacttatccataataacactgaatataaatggattaaactctccaatcaaaagacacaggattgaatggattcaatggattaaaattaaattttaaaaagcaagacccaatgatctgttgactacaagaaacatacttcatctataaagactcacatagattgaaaataaagggataaaaaaagatatcccatgcaaatggaaaccgaaaaagagcaggagtagctacacttagatcagacagaataggtttcaagacaaaagctatcaaaagagacaaggaaggtcattatataatgataaaggaatcaattcagcaagaggatataacaactataaatatatatgcacccaacactggagcacccagatatataaagcaaatattattagagcaaaagagagagacataccccaagtcaataatagctggaaacgtcaacacccaactttcagcattggacagatcatccagacagaaaatcaacaaagaaacatcaaacttaatctgcacaatagaccaaatggacctaataaatatttatagaacatttcatccaacagctgcagaatactccacacacttctcctaaacacatggattattctcaaggatagatcaggataggccacatgttaggccacaaaacaagtcttaagacattcagaaaattgaaataatatcaagtatcttctctgaccacaattgaatgaaactaaaaatcagtaacaagagaaaatttggaaactatacaaacacatgtaaattaaacaatatgctcctgaatgaccaatgggtcaatgaagagattaagaagcaaattgaaaaatgtcttgaaacaaatgataatggaaacacaacctataacaaaaccaatgggatacagcaaaaggagtactaaaagggaagtttataactaaaagtgcttacatcagtaaagaagaaaaacttcaaataaacaacctattatgcaacctacaagagcaagagtaaaccaaacccaaagttagtaggagaaaggaaataaagatcagagcagaaataaatgaaattgaaacaaagaaaatacaaaagattaacaaggccaggcactgtggctcacgcctgtaatcccagcactttgggaggctgaggcaggcggatcatgaggtcaggagaccgagaccatcctggctaacatgatgaaaccctgtctctactaaaaaatacaaaaaaaaatagctgggcgtggtggcaggcgcctgtagtcccagctactcgggaagctgaggcaggagaatggcgtgaacccgggaggcggagcttgcagtgagcccagatcacaccactgcactccagcctgggcaacagagtgagactctgtctcaaaaaagaaaaaaaaaaaagataaacaaaagaaaaagttgttttttgaaaagataaacaaaaatgacaaacttagccagactaagaaaaaaggagagaagacccaaataaataaaatcagagatgaaaaaggagacattaaaactgatactacagaaattcaaaggatcattagaggctactgtgagaaactatataccaataaattggaaaacctagaagaaatggataaattcctatatacatacaacctaccaacattgaaccatgaagaaatccaaaacctgaacagaccaataacaagtaatgagattgaagccataaaaaaaattatcccagcaaagaaaaacctgaaacctgatggctttactgttgaattctaccaaacaatgaaagaagaactaataccaatcctgctcaaactattccaaaaagtagaggaggaacaaatacttctaaactcattctatgaggccagtgttatcctaataccaaaaccagacaaaaaatgcatttaaaaaagaaaactacaggccaccatccctaatgaacattgatggaaaaatccttgacaaaatactagcaaaccgaattcaacaacacattaaaaagatcatccatcatgaccaagtgagatttatctcagggatgcaaggatggttcctcctatatttagaacacaacaaagatgctcattttcaccactgttattcaacatagtactgaaagtcctagctacagcaatcagagaagagagaaataaagagcatccaaattgggaaggaagaagtcaagttatgcttgtttgcagatgatatgatcttatatttggaaaaacctagagtccccataaaaaaactattagaactgataaacaaattcagtcaagttgcagaatacaaaataaaatacaaaaatcagcagcatttctatatgccaactgcaaacaatctgaaaaagaaattgagaaaataatcccatttacaatagctacaaataaaattaaatacctaggaattaaccagagaagtgaaagatctctacaaagaaaactatgaaacactgatgaaagatattaaagaggatacaaaaaaaggaaagatatttcatgttcatggattagaataatcattattgttaaaatttccatatttctcaaagcaatctacaaattcagagcaattcctaacaaaaataccaatgacattcttcacataaatggaaaaaacagtgctaaaatttatatggaaccagaaaatacccagaagagccaaagctatcctaagcaaaaagagaaaaactggagaaatcacattacctgacttcaaattatactacagagatatagtaaccaaaacaaaatggtactggcataaaaacatatactgaccaatgggacagaagagagaaaccagaaacaaatccgtacatccacagtgaactcattttcgacaaaagtaccaagaacatgcaacgaggaaaggacagtctcttcaataaaaggtgctggagaaactggatatccatatgaagaagaatgaaattagacccctatcccttgccatatggaaaaaaatcaaatcaaaatgggattaaaaagttaaatctaatacctcaatctatgaaactactacaagaaaacatgagggaaattctccagggcaaggatttcgtgagtaatatcccacaagcacagtcaaccaaggcaaaaacgaacaaatgggatcacatcacgtgaaaaagcttctgcacagcaaaggaaacaatcaacaaaatgaagagacaacccacagaatgggagaaaatatttgcaaattatccatctgacaagagattaataaccagaatatataaggagctctcatgactgtataagaaaaaataaaataatccaattttaaaacgggcaaaaaatctaaatagatatttctcaaaagatgacattacaaaccacaaacaggcatatgaaaaggtgctcaatataattaatcatcagagatatgcaaatcaaactgcaatgagatatcatctcactccagtaaatgacaggcactaacaaatgctgtcaaggatttggagacaggcaataacaaatgctggcaaggatttggagaaaaggacaggcaataacaaattctggcaaggatttggagaaaaaggaaccattgtacactgttggtgggaatgtaaattagtataatttagccactatggagaagagcttggaggtttctcataaaactaaaaatagagctaccatgtgatccagcaatcccactgctaggtatattcccaaaagaaaggaaatcagtatatcaaagagatatctgcactctcatgtttattgcagcactatacacaatggccaagatttggaagtaacccaagcatccatcaacagacagataaagaaaatgtggcatatatacacaatggagtactattcagccattaaaaagaatgagaacctgtcatttgcagcaacatggatgcaagcggagctcattttgttgagtaaaataagccaggcacagaaagacaaacttcacatggtctcatttatttgtggaaactaagaattaacagttaaggattaagaaaatgtggcacatatacaccatggaatactatgcagccacaaaacaggatgagttcgtgtcctttgtagggacatggatgaagctggaaaccatcattctcagcaaactatcgcaaggacagaaaatcaaacaccacatgttctcattcataggtgggaattgaacaatgagaacacttggacacaggatggggaacatcacatactggggcctgtcatgggggggggggagaggggagggatagcattaggagaaatacctaatgtagatgatgagttaatgggtgcagcacaccaacatggcacatgtatacatatataacaaacctgcacattgtgcacatgtaccctagaacttaaagtataataattaaaaaaaattaacagttaaactcacaaagatagagagtagaatgatgggtaccagagtatgagaagggtagtggagagagtgagcagagagggaagcggagatggttaatggacaccaaaaaaaaaccagaaagagtgaataacgtctagtatttgaaagtacaaaagtgtgactatagtcagtaataatttaattgtacattttaaaataattaagagtataattggattatttgtaacacaaaggataaatgcttgaggtgatggataccccttttaccctgatatcatcattacatatcgcatgccagtatcaaaatatcccacataactcataaatatatatacctactgtgtacccacaaaaattaaaaattattaataaattattagtttgatttaaaaaaaacaaggatgctcacttttgccacttctattcaatatagtagtggaagtccatgccagagcagttagacaagagaaagaaataaaaggcatccaaataagaaaggaagaaaggaaatttttgctgtttgctgacaacataatcttatatatagaaaaccctaaagattccagaaaaaaactgctagaactaataaattcagtacagttacaggagacacaatcaacaccacaaaaatcactagcatttctatacattaacaacaaactttccaaaaaagaaatcaagagagcaatcccatttacagtagctacaaaaattaaaatacttaggaataaatttaaccaaggagctgaaagacctgtacacagtagtctataaaatattaaaaaaataaattgaagaagtcactaatcctttttaaatccaccatgccccagtccagctgaacaactcatacttttcagaatctactctatgtgttctcactgttctgcagctagccacctctttctcctccctagatcaccttctttatcatttctgcttctcaaaatgttacccctctttcaaagcccaggtatgatgacatctccctagtaaagctccctcaacacctcaagcttataataactaatctcttccttgaattcccatagcaggttatttgtacctccattataatacctctctcatcctgttttgcattttaattattcatgtgtggcatgtttctcttattaggccataaatatcttaggacaagaactatgccctcatttttgttccactacaaatcttaacacataccttgcacacaccagaccttcaggaaatgcctgctaaggtaacgaagggacagcctaaattaacataaattattatttgtgtactgatccagtcctaaatccatggtgctatcatttctgtatcactgatggttatccacttacttaaataatctttccttaaatacacttagaaaagacggaaaactgtgttataagggaggaacaagtatgtaggttattcctttccttaaacaaagagaagttctgtcatgcgtcatggaaaattaaagcacagtaataaaaagcacgaacaagatttgttgaataatgatttagtggaaacgttgcttgcctcctgttcataggtcctaactttcctctcaagtacttaagctgcacattctatttattttgtttctagattacattgacaactattggctatggagacaaaactcccctaacttggctgggaagattgctttctgcaggctttgcactccttggcatttctttctttgcacttcctgccgtgagtatctttgcaccaataaagcagtttaaattagatcttagagacttattagagtgagctctcacaaattcgtatgcttgggaacatatctatatcatttacaaatataatttttccgatataatgttgacttttctaaatatatctacttggataatttataaaatatggtcttcccttggagacacttaatctgagactttatttaatgtaggctcatactttgtgaccaaataatcattcagatggctcactttttaggcaacatgctactaagacatttaaaatatttgcaaagatttaaagctatattcttttaaaactgatccttccaatttggtttataatgtgtgctacttaagagacagatgtgcacaatggagtatttttctcttcagatccatttgagtgaaaagcatatgaccttaaagggtgttaaacatgtcagatgatttattcattgtgtcatcatcattgatttttttaatgagcagtttctgtatcttatcagaataaagggcacatttatctgcccccaagcttctgattattttctccttagtgaatgaagcctgcctttctcatacttttattctcttgtgtctttaaaggcagctgttcaaaatattacagtttgcccccatttccaagttcttgcttttgttcgctccatctggggtagggaaggaggagccaataaaaaggagggttaacgcggtgggagcagaagtgcttaaggaaaatagatccagtcttgctccagacacagctcaagctgtgccaaccagagaccccagagcacctctccaaagctcttttaggtggtagggcttctcctctgcctattaataagtgcagagaacacccttgtcccaccagtgcccaacttgagattcaccagatcgttctgccccagaacactcaaaatcacagaaaagagactgaaaaggccatgcatatgcttgggtactagacctcagtttgaatacatctttgtcacatactaactatatgactgctttagtttactagggctgccttaacaagtaccacagactgggtgacttaaacaatagaaaggtattgtctcacagttcccaagactggacgtccaaaatcaaagcattgagaaaccacgagagccatgagagaaagaactgttccaggcctctcttcttggcttatagatggctcttcttcctgtgtcttcacatcatctgtgtccaaatttctacttcctagaagaacaccagtcatatttgattagggtccatcctaatgacctcgttttaacttgattacctctgtaaggaccctattttcaaacaaggtcacattctgaggtcatggggattaggacttcaacatatgaattttggaaggacgcaattcagcctgaacagtgaccctgaataagtttcttttttaatagaatggaggaagaattattgagcccagagaaattttgtgcggaccaatgtaataatgtaagtcaagtgcttgtcatgaagagaactctcaataaatgttacttccctttgcctgtatgaatctagaaatacatgtttcctggaacaaaatgatgaaatccaggagaattaaaaaaaaaaaaatcttacgtatccaaggcaacttcatctggcaatctcaacaattcagaacagagaagagattcactcaataatcagattccctacaggaaaatacctttagaaacaatacaacgcagtcttgggttttttcccaaaataatggcacaaaataattgcagcttttgtgtttatatttatcctgaggccacatgtagagcaacctctatgattcagtgaaaaactatgaacaaggaggtaggcaacctctgggctgttgaaatagacaacaggctatgttctgtcctcataggagagccacttgagacctaattcataacctagtcttcattcagagaaaattctgataaactcacctatatggtttcacaattctttgaagattataaacaacaaatatagaggaagatgatagaacaaacactgcaacagaaagaaatggtaaaagactaacagcaaagaagggaaaaggaaatctgtgagtagcaagcagacatcagtgttcaaaatgtgtatcctgtcagtaaaaataaaattaaattaaaagggaaaacaaaatgtatgaagatctagggccaattagtgttagggtcaacaaacctctggaagttggctgcacccagcacagcaaaaaggcagtccccataatgaaactctaaactatcacagggaggttaaatatgtcactaggttaagttaaaggtcagagactaagtagtcattcttggaaatgtttccaataaagtaagtatgaaatttttatatgcaaattaaattaacctatgttggaaatctgaaaattttgctttcacagaaaattacatttcttaagaaccccaagaaaagtaacctctactaaggatcttttactgaaacttcacaatattttctgagtccttatttattaaatgaaagactgaatggtccatatatacctttagaaaaaaacaagattgccagagattttattatatcctgtgtatctgccaaccaaaagagttgtctgattgaaatttaggaagacacattgacattttgctgagaaagctagaggtggattgtgggctgcccctatgtagggttcctcccacccaggacacctgagaaccaagaaagaaaagagcctttctccatcttaccctcaaagcagaagggccatcctgcacatcacagagtcatacaagccacccatccaaagcgccactgtggggtcacttcccctggtgcccgctccatctctgggctaatgagctcacagaagaagccccagctcccctgtgttaccctgatatgcaggtctttctcctttttagagtgctcccttgtcttctgctagatattcctgctaagagtattttcattgatgaagaaattgagttttatagagactgaattccttgagacctccagctagtaaattcagtgcaagaactagtgctgtttgactcacgatattaaccattccattaaaaatattggccactgtaatccttaacaatattaactaaatgtaattattgcatataataacatgttaaaaaccgtttaaaaaaacagggcatcttgctgggcgtggtgattcacgcctgtaatcccagcactttgggaggccgaggcggtcggatcacaaggtgaggagatcgagaccatcctgcctaacatggtgaaaccatatatctactaaaaaatacaaaaaatcagccaggcgtggtggcgggcacctgtaatcccagctactcgggaggctgaggcaggagaatgatgtaaacccaggaggcggaacttgcagtgagccgagatcgctccactgcactccagcctgggcaacagagcaagactccatctcaaaaaaaataaaaaataaaaaaaataggatgtctttcagcattgcctatttgctatgtgtgggttacaaattaggttcatttaatccagaagataatgaagggtaaatttctttacatttattggtgtcagtatttgaagggatgacatatatgttcaaagcttaagccatgttttatgtgtgtatatacaaatataatagaccttattttcacagacttctgtttaggtgcaccaagctgtgtactaagagagaggtggaaaaaaattggaaaggagccatgatgagacaataagcagacctggtttaataactgctgtaatgtacagtctggcacaagaaatacgtagtgaacatttaccattcactaatatatgtttccgagcaatgccaatgtgattttcagcacattttagattgtttggcagatgataaatttgtgctatgtagggcctgtctttattttccaaaggggattaaactccgaacctcacatccacatcataagtgctcaaaatggtagctagtgctgttaattcaatgtctgcaaaatctaaattatgctccatacaagtggattatacacatatatgcacataaatgcatgtatatatactacatattataaatatatgccagaaattttggtatttcatattctcttacatgtctacactttatgaaaagtagtattaaagggaaaataaagaaatctttcctaaatgatcttacacagcagaaaaaaattagaagttacaaatgacttaagttgttctggatttagaaatggaggggcatttttataacacctaaatggagggaaatgttgtttaaatctataaaccagatcacagagaccaggtttttataaagcttagtttgtacaatcacaacctgtatgagatagagatcttagacagcgtaagacagtcactgaaaaggagagatggaaaacagaacctatgatgtaatttctaatttcatagtacagtcatttatactaattaataatggagtagatcattgctcacgaatagcaaatagtattatcagaccactgcgtattttaaacatgattgcattacttattgtctggttattgtcactgatgtactcagaagtgtggaatctcaagataagaaggaaggttaaaggttatctagagcccaaaaatatctcagccaagttgttattcagttgagacttaacaccttctagaaatgaaaaacccaccacctctccagacagcctatagcatctttgaaccatctttgagctactctaaaaataaaaagaaaagaaaagcaaccattccttacctgtagcaaatactgacttagtgcttataaaatgtccatctctaaccaaagggttagactccttgaagtttaataaaaaactaataatttatagctagcaagtaaaatccacagacttgaaagcagcagagctcccagccccatgctaataaactcaagagttaaagacaaagcccagagactgaatttagcaagctccaaaagccaacccaaggctgagacaaagcatcttgtttttacaaatgttagtagaccagagcaaattgaaaagagtgggggacatcaaagaaccagaattttggcagatcaagatgataagcagaagaaaagcaaactggcccaaaactaatgtaaacctagaagggaatactaatcttactaatcccaaaaactgaataggtgagccaaaataaaaaaggcaaggaatggtaaaagtgtgaattaaaatgggaatgtgctttgcaatgatccacgttcttgtctctagtgtacaaatgggcaaaatagaaaaccttctactctatatcttcaaaactgagtatccctgctctccattttacttttcttttagtaggtgtacagttataacattataaagaactacagctgggacagattttatacagtcctctctcctccatttcatgaatagagaatctaactttcagagtctcatcaaagtgctagaagtattcccatgttcacagcagtgagactttaactccctcagatttaaaatccagctctgtcccaagttgaaattcatgttctctacattccatcactggatgagaccattcaatctaacttaggcaaaaagaaatgtcacagagaaggccacacacacacaaaaaaattttattgtgattttatttataatcatggtgcctatgctataccacaaaagataataaatgacaatgcctaattgacttactaaagaacagaagttgtatctcctggcagtattgcccaacaatttgccattggctattggtattataatggagataaatactgcttattttaataagtaacatgtttatggacaggttacataccgtttgtcttctctcagactcattttagtgactttttaatatttgtattatttaacagtgcttttgaaatttttgagtgccatttttgtattttgttccagggcattcttggctcaggttttgcattaaaagtacaagaacaacaccgccagaaacactttgagaaaagaaggaacccagctgccaacctcattcaggtaaatgtcaatgtaataggtagatggcaacatttgtgtccatagtgcttgatgggtcattttccaatctctgtgcttcattgcttggtagaactactgctttgttcctttttataaaatgaagtcagaacttaatgtacagtcttggatttggacagtcttggatttgttcctcctctcccaaactgaaacacatgtatttttagcaaatggtccatgcattgttcagactaagtaaccatgtcagcaaggccatgcaaaggttagcagttgtgtggctcgtggaattatctaatatgtcttatgaattacttgatgaaacgtaattgatcattaagtgatggagcagaacagggcattgttccctgcattccaattactttctccagccagatgtatgttgctgttttaaagaacaacatatttgtttagaatgtcaaggtttaatacctgtgaaattgcttttagtgccatctagggcagttagcggaaatagctatcctattttgagagctgatgggactatggaatacatcagtgtttgagaatattaaacaataagtatataatttgaagctagctcctaatacataggttgttatttagtatttcattttcttttcactaactcaggattagcttcagcactaaaaggaatgcttctccttttgccatccatatattttccatcctagatccaggttaagaatcacaaaatatattttttgttagattcataatgtagagttgacatttagttatggacaaaataattctacaatctaaagtttctcccctcctgctagggaagtggaagctaccgaatttctaaactggagggtcttgaagtggtgctccaaggccctaggaaacttgccttaaagctgcagtaacgggcacactgttttgttgctgttgttgttttgttttattttttgtttgttttgtttttttttttttgagacagagtcccgctttgtcgcccaggctggagtgcagtggtgcgatctcggctcactgcaagctccgcctcctgggttcacgccattctcctgcctcagcctcccgagtagctgggactacaggcacccgccaccgcgcccggctaattttttgtatttttagtagagacagggtttcaccgtgttagccaggatggtctccatctctcaacctcgtgatccgcccacctcggcctcccaaagtgctgggattacaggcatgagccacggctcccggccacaagcacactgttttaatttagattgtaggtttgggtgggtgggttggtgggagataaccaccacaacccctacctttagtgtttatctgtgactgtgatatatgcagtgcctcccacagacatggagctggggaaagaagggggcagtatggttcagttatatcatgaaggagatctgtttatatctaatcattaaatgaggatattaatttttaaatcaagctattctgcaactgttgacaagaaagtagaccatcaggcatgacttccagtgcaaatcactgagaatctctatttttttacattattttttacaattttttttttttacatattctttacaggttttaaaaggtcactaaagagaaagtaaactctattttcttatatgaagttggagtttaagatctgatgccaaacaataatcagcagaatgaaaagaggagtcacacactttaggacacacgcaaaataccccaaggtccagaattcataggctttcatcctttagcactccttaactggttacacatgttccaatacttctaataagtttttctctttactgttcttatcctttaattttccttcactctagaacaacgttttccaacctgtgagtgcagaagttattgcatgggttcctttcatccgtctgagcaccaagctctgtctacatatggaaccaataatacattttacacaataaaacctcttggaatatcagctgttttgttagaaagtgagctctttgaggaatttctcatgcacatatcaattgtgatgatacaaagctgtgccgctcaatacagtaaccactagctacatgtagctttttacatttaaattaattaaaattaaaaaccaagtttgccaatggcactagccacttctcaagtgttcaatagctacaggtggctatcggctgccataccatacaaaagaaatatagagaataactgcaggaaatctcctgatctaacttgtcattattgactactaaactgtgcaacaataatttccaattgaacttgaaaataaattgttatttctacagcaaatcattggagcagaggcatttatatgtctacagtcaaaatgaggcaaggcctccctcacaggtaaccctgtggaggacaggctaattgaacagttttacctggaggcctagaattttattttatggaactgggttatgtaacatatattgtgatcagtaattgaacttgtacaaatgcaggtaacaatgaagtaaaatcgtgagtttttattttacttaaaactccaacttaaatgttgttcttaacaaaaataatgcaaaatggaatgcttgaagcattcaagagtacttttaaaatctaatcatagtttcattaatcaaagtagaatctactaattttaaaagcaagtgctccttcatttaaatgcaattaatttattacacatagaaataataatataattattaatttgttcattgttcttccttgctatagtctttagacagaattcaaggctttaagccttgattatatattatagaaatttatatttcaggatgtaatagattgaaaagcaaacttcatttaatcatcctttcaccttcttacccaataaacctgacttggtctgctgaacacacaaaccatcaagcccaaaagcgtctcatttattttaggccagagtcactatcttcttaaaagggcaactgagatgcccaaattgcttcatcatttggttggtgagagaactaaattaaccaacatttcagggttttaggaaaaaaatttaaaaccccagaagcttgcagcaaatttagctgtgtcaatatctttgcatgattcttttaaatttgcttttcatttcaagctggagcagtctggaaaaagaaattagctctcagtaatgttttgaatacctgcccaaatgtcacaacttttattaataatgcttaagactcatgaagtgctttttagtttgcagggtgcttctaatacattatgttacttgatcctcgagacaagcctaggaggagctaggactcaaatccctgctgtctgaatctgaatccattacccctttcaaaaagcagcatttacatcctcataaatatatgctttattagaaacagaaacagggaattaagtaaaagtttgtgaaataaatgttggtagggatagattagaagatgttgctttgatgccaactgacccaaaagaaaaatatatatatttgtcttgaaactttggcttcccctagtaaaatgacttagtctccacccaattaccctaaagcgaagccactagtcattaagctcaagccacttatatagagattttacatctttttagtgctccagtcataaataaaaacagtgccaggtgtggtgactcatgcccgtaatcccagcattttgagagggcaaggtgggaggattgcttgagttcaagatcagtctgggcaatatagtgagaccacatttctttaataaataaataaataagaacagactcagaaaaaaaaatcttagatgtgaaaaacatgaaggcaggaaaaaaaacagaaggtaagataaagttgtgaaaatttccctgaaactagaataaacagagattgaaaataaagcaaaaaagataagaaacatgaagtgtccatccaggcattccaatatccagctaataaagatgtctcagctcaagtgcagggaaactaagaggaagattttatcaaagaaatacaacattatgattctccagaacaggaggacaggagtggccacagtagaagagctcaccaagtgtccagcactgtgaaccaaaaacttcacaccaagattatcacagtaaaatatcagaaaacttaccaaaaggggatcctaaatgctttctgagcaggacagagccaaaggaacaagaataaggatgacataggatttctcattagtaatccaaaaattagaagacaatgaaacaatactttcgaaattatagaaattattttcaacctagaactctatatccagccaaaccaccatcaagtgtgagagcagcaccaaggcacttttaggcatgcaagatctcaaaaattaatctaccatttacctttactcaagaaactttgtaaatagaacttctcttccacaacaaggggataagccaagagagaaagagacatggagtcaagaaaacaagagattccgcacaggaaagagcaaaggggatttctatgataatagggaagggaagtcccaagacaacagctatgcaggccttgagaacagaatgagaaggaggctgagagctccaggagaaagatcttcaaggaagcgaaagaatggagttctcagatttcatgatgcatttgaccagaggaattttatagttctgttggaaagatctggaatgtaatcataacaggtacatatatgcaaatcaagaaattaaaatagggcaattataactccaaaaaaaccaaaaacttgtataagaaagaaagagcagccatagtacatcacattgctgaactgggaacagcagttacattgtcataataatattaaatagtaacttagctaagaattgtgatattaaaatgttgataggatgaaaggaggggaagagggcatgtaagtgggcaatatcattatcgttcaggataggaagttaattgataatgtctaaaattgaaaaatcaagaaatataactataagcataatccttaaaaataagcattcttggctggacgcaagtggctcatgcctgcaacccccgcactttgagaggctaaggtgggaggatcacttgaggccaggagttcaagaccaacctgtgcaacatagcgagaccccacctctacaaaaaaattttaaaaagtcaagtgcaatggcacacacctgtagtcctcacacacctgtagctactcaggaggctgaagccagaggattggttgagcctgggagtttgaagctgctgtgagctataattgtaccactgcactccagcctgggtgatagagtatgaccctgtctcaaaaataataataataataaataaggattcttaaaaatagaagcaacaactataagaattgaaggggttgcctctgaggaacagaaagtagtgtgaagaaagatgtggaaagggattgctggttcatagcctaaaactttcaggactttcacattttaaactctgtaccttgaaaaaataagctctgtgttcattattcctttggatggtcagctgaaaccttctaaaccatttccagtaaggatcaaacatgccataatggtaatacttgcaagacaaacaaaatactcccaaaaaaactgaattatactggccttgtacttattgagcaaagtccaaatctctttgactgcctagagcaccagcatcacctgataaatggcaaagttggctctcattttgcttcttgttgatttgtcctttgaattgtatacaccatgtaaattaaccataggaaatccctctaagtgttatttttctcttgccaactactgtgtgattttggctttaaatataggaacatcagctactggatcacagggatgtgggttcaaagttcagctactagaaacaatttgctaagagagacctaagaacaaaataaagttattagagtgtaacgggcatagagttccactttccaccttcatttttactgttaactaatatcagccatgtgacagatgccacctgcaccttccatacctctcatttaaaaggcatttttgggagatgagtaatgaagggaacaagagcttagctgttgggatcaatttgagagaaaaatagcaagacatcaggtctcattgtaaagaaaatctttaattttctcagagtggcctcttttgcccccagttctttataacattcacaggcaatgccttggtcccattcttttgttgttctgttgttttggattttttcactggtatctaataatgtgcagacctgccatatgcttctagttctacaggagtcttgctttcaatgtatcaaaaatcatatatgtgtgacatcttctatggaaattgtttaattaaggcagccgtctgtgtcatcacaacattagaggatctctgggcatcactactacagaagaagctgcaatcctaaatccatgtgttttccttaattattctaaatcactctataaattgtgcaggtataatatttgcaaagattaacatttcaagatgatgcaacaatagttgcattatataagatgtcaagatacttagcacaaatttccacagatttgtagattaaatcagcatgagccatgtaatgaaggcaaggaactttggttcaatcatttaaaccttcctcaaaaatataaaaagtccctcagtttctaccactatatttttctagtttttttatgtcactttctgaaatttcattgaagtacaatgtgcatgcagaaaagagcacatatcttaggagaactgagcacacctgcataaccagcactcagataaacagagcaggacctcctgtgtaccccttcgcaatcactatcccataaggataaccactgtgctaccttctaacagcgtagaatagttttccctggtttttgtacgttatggaaatgtactccttggtgtcttctttttctcactcaacgttattcacatgaagttcatccatgttgttgtgtgtagctatatgtactattgccatatagtattgtactatgtaaatggtgtcacaaattttctgtttattctactgtttctgggtattttggaatttccagctttagtttattagaaaccaacatatagtacatatcttttaatgaacatatataagcatatattttgaaaatatacctaggagtgtgtagttgtatcataggatacttaaatgttcagctttcatagaaacttccagttttcccaagtagttgtgtgaatttttaacttttatttagcatacatttattcaatgatattctcaggaaaaggaatattgttagatcacattttcttcattatggatttcacaatcatgactgatgtgttatgtactagggatgtggcccatttaaatgaattggtctgccaggcatggtggctcatgcctgtaatcccagcactttgggaggccgaggtggcagatcacctgaggtgaggagttcaagatcagcctggccaacatagtgaaaccctgtctctactaaaaatacaaaaattagctggatgtggtggtgcgtgcctgtagtcccagctactcaggaggctgaggcacgagcatcgcttgaacccagaaggcagaggtggcagacagccaagattgtgccactgcactccagcctgggggacagagggagaccctgtctcaaataaataaataataaataaataggtttgtcacataaaataaaatgttttgattaatctactataataaaaaagttttctctgaggggactggagtaaatacctggccattagagatgtttgcagactcattaaaaagaaagaaatttaccaaaatctatatgggaaagtaaggtcgggcaatctctcaaatgagcagttcagatggaagcttttccaataacagtcttcaagcagtcagcaagtctccgtggagggattctatgactgacagccaggcaatctgagatattgtctcaactccaccaactttgtataaacctcttcatttatctgagccctttttttctcacctacaaaacaggaatcttaattcacactttgatggtgaggatcacataaaaatactttgtcttatgtatgccaggtgtaattatatgaaatggagagagttgatgttttacatcaaagagctataaacatattcttagatcatggcataaatccgtaggtgttttgcagctatacacctagagagtacattttccccatcctgttttagttctgcttcttgatatcactatcttcatttttagcattagaagtattacatagttcaaggatttcattaattcaatcactagcataccctggtgttcattagttaactagttagcttactagttgcataatggattttcattagtcctttgcttctcccttatcaaatattgattaaagatcaatctctagaatgtatgctcatgctcaagtcgctcacctaactactatcttggatattagcatttaaccagtcaatcattactttttgttttggataatatagtatctttcccttaccaattcaaaaattacattatattgcactttttgggccttttgcttcttggtatgttgttttgaaaagaagctctggccaggcacagtggttcatacctgtaatcccagcactttgggaggccaaggcaggcggatcacttgaggtcaggaatttgagaccagcctggccagcatggtgaaactccatctctactaaaagtacaaaaaaaaaaaaaatagccaggcatggtggtgggcacctgtagtcccagctactctagaggctgaggcacaagaatcacttgaacccagaaggcagagattgcaatgagctgagatcgcaccactgcactccagcctgggcaacagagtgagagtccatctcaaaataaataaataataaaataaaataaaataaaagaagttctgatgtggtgcaatatgtttaacagccagctgaaaatgccaaagtagccttcttcctcctttgggtatttatcagggctaagtataagaggcaaaagattcttcatgtgtagtaacttaatcatttctctttttattttattctaaatcctgctctcttttttctttttcatgtccccatctatgccacatgcagtgtgtttggcgtagttacgcagctgatgagaaatctgtttccattgcaacctggaagccacacttgaaggccttgcacacctgcagccctaccaagtaggtatcagtgtgacagctgccactgtagttgagtcttttcaagtctgttaaacaaaccatacccacacacacaaaaaaaggtgttaatgtttggcttctcttattctctgttgctcctaaagagattcaaacctatttagtagcagttctggcacaaaactaaatggaatcagtatcattcctcacaatccacagactggggttaaagattaaaataatgtaaattttatagagatttatttttactatttcatgcttactttctaatgtctcatttcgtaaagcccaccagcatcctaaaggtaagcaccacagttcttgaaaaacaaggattatttattttgcacccatcgcctgaccccaagagatgagtgcttagagagtaatccatctttgtacgtttagatctctcaaagccatttctcatctggatcctctctggatggtcctcaagcttttacttgcagatcaaactcacatcagtggcaaaaaaagagaaaaataggagtcctaataggattatagtttacaatgaggcaatgggacccagcggattaaaatttggaatttgcattcacaattttaaagtaagactacttttcttcacatttcattggccaaagtaaatcactcagccatgcctaaactcaaagaaaatggggaagtacaattttaccttttaccatgtgcctagaagcaggcaagaaccaaggacattatggacagtcctaatgattaccacagagatctgtaattaaaaaaaaaaaaaagggcttagtcttggagtcttggaaacctggactccagttcaactatcacagaaaatgttaaatcatattcaccacctaattaaagaagtcctcattgaaataccgaagcagtaagtcatgagaaaggctttctgtgagtcacccagcttgattagcgtagtcagttcctcaggttgttcaaaagttattaaattgctcatccgacatttgagagcaccagctgcttttcttcatagcccaacaaaaccttaatcctagtggcttcatgggattcaggacacctaactactgtgactcacaaaaaaccacctgttcttactgatcttgggagatatcagctgaggaaacctccatgacattccctggcagtaccgtcttaatggaggtttgtgatgcagcagaatgcataccattgggaagcaccagatccatcattaactacattacttccctgttctgcccttggcctcagttttcccacccacaaagagaaggacaagagttgggcaagatgattcctaagctctaatgggaaatgcctcctggtgggtggtatctaaaattcttgtcagcacctaggacagagatattcatagcactccagggatttcagagaggatggaaccttagcatggatagaagcatggatgctgttgaatgcatgtttggattaaaatcctcttttcatttagatcttgaagtttagttgaactttttatggagtttaagaccctttcaacattttgatattaaaaaaccgaaaatagaacctaactcctgtgccatttattccttgggagtatgaaccaaaaataaaaattatatagaaattgtatttcttgtcttcatgaagtttgctaggtaaatgtaaaaagggaatctgagtaggaaaactgatagagaattctcaagtgacagaggagagtggtctattatcatatgtgattatttggcttcccacttactgcagtttttggattaaaagtcattaaaagcctggaaaaactgtttaataatgagtcaaattcccccagtaaatcaactattattttattcacataagttctttctactcctctgatattttccctgtcttaagtgggggtggaggtggaggaggatttatgcaaacacctgtgttcctcatgtcctactgtgcctttccctcactttccttttcctgcaaactcatgaaccatggggctcagctccattgaatgaagaacagttatttgtccagaatgacacagcagtcactggtaaagttcatgggaaactagatgtcctaacatctctccccttccagtgatgcttcattgcttcaaaatgcagaggttcttaatccttgttgatgttttttgttaaaccattgagaatgtgatggaaattatggggtctttcccaagaaagataatcaatgcacgagaaaatcaatactttgcctacaattttaatgtattcacagagtccctgaagccaagttcaaacttttgttttacaaagcaaacttgctttaatcaagtgacaataattttcagtgacttagagggatctttttacatttaagtggcttaccgaatggagagtgttgtagtaagaaacagactacaattactattttatttacattgtgtattttcctttagcattcagcctaagaacttctgatgggaaagatcatttattcagtcatgtatgcattcaacaattactcattgagcacctatgatgtgcaaggcatagttctaggcactgagaatgaagcagttggagtaaaaaaaaaaaaaaagttagaatctctggccttgggaagtatgtattcaagggatgttgggatagacaatataaataaataaatataggatatgttagatggcattaagtgctaaggagaaaagtaaaataaagaaggaatttagggagcatcagaggctataatttcaaataggtggccagggggaagatcaatttatcaacaatatcatcatcatcatcatcaatgttactgttatcattaaaaaacaccagccccatgctcttgttccccagttttaaagacatagtgggatgctttgattccactaaacaggatgaaagagaggtctaagaaacagctgtgcagggcagagagaaatgggaggagggacactcaaacctgccagggatacaaccagcagttccttactctctcttttcaggtctggtttgtctcttacatacactctagaggtcttagcaattctatttcaaagttttattttaataacagaaggatgtatagaagcaagtacttttcttgattttctcctcaaagagagtgaagctgcaaagggcaaaacacaggtaaatatgctatttagggaatgagtcagaaattttatgaggctatggggaattatcaagctccaaaaacaccttgtggtaccttaagaagtggggatttggagattatctaacctaaagcctttgatttactcataagaaaaccaaaacctgcaagcaaataaggtgcctgcccaaaggcacacagctcgtttgcaaagagtacagaccctacaccatggtgcttagacctacatttgctaaaatgagttattacaaatgccacccaacagtataggctaaaagagttttggtaaatattctatgtaccttatttactccaaggaaatttagattttatacgatacaaaaaaaaatctgcctcagcaagtgactgagatacaattcattaatgaatccaggtttagaaaccaaagtctgccagatgcacagagaacagttatgttgtaactagcaacattctaagagcccttgctaattctggttagatcagaaccactttttcttagccatggatagctttggctaatgaaaagtctattgttttttattctatgtgggcagtcttggctttgccaagtaaatgttgtgctatctctggtctgtatcacaaagaatatatgttagcaagttgagtacatttattataaagaacactgcttttgtggatcttgcatgaaaagagttacttaaggtatttgattccccaatctccaatttggccattatcaagtgctataaatatattcactggtttatcatcatttctcttctgcctgcacgcacctgaaggaaagaacaaggggaagcatcaagcaggtttgtgatttctctcttgctacatgtttgtttataaatctgatacctaccaggtgttttaaatgtgtctcatgtgagtaaaatcgatcaacaaatacaagatgattaaaagtgacctttcacaagattgcctgcaaagattgctattttattgatatttcgccccttagtatcaaagtgtctttccctaactcactccctgctttttcaaaatctgcagggcatggaacatttggaggtgggggaggaggggaactgatcttggattagtccttgctgttgttttcccagacagaagtcttatcaaagtattcaaatatggtaatctagagaatgaaagaaagaaattttttttctgaatgtaaaaagtccaggcagcagtctaggatacactccccttcactagggtccttcttttggagtgatatatatatatatatatatatatatatatatatatatatatatacacacacacacatatatatatcatatacatatacacatacatacattatatgtataggtatatatacctatacatataatctttttttttggcaagatgaaaccacctctctgtgacatctccagatctccagcccactgagtgctgaggtctactcaagtgactcaaagagccccatccccatcttttaggaagaagacaaccctcccaaaaattccccaaataatttattatcagtttcccatgacttagatggaatgagtcgtcagattacagcagagaattaaacctagagggaatacgaggtgaaagaaaaatttcttgatctgtgttaatgagtaccaggaagtgcctagatttgagagcaaagccctgaaaaacagagccaggtggaacccagtattaatgatgtgaagagtggcagaggcagaaccagcaaggagaatcccaggtgcctggaaaggaagaagagatacattttttttcctatcattgtcactgtgtttccataaagaaatgaaggcatccacctacccagagttggtccctaagtggaggccagtgtgggcccagggattgttcttttagcttagtactattataataattatattaataataatatatttatgcaatactgaagccagttttgaaagttcacttggtgtattaaggctctggattatccatttttgcattatgtttatatgtaaagataaacaaatgaaaacataaatgcattcgtctatgatgggagataggcacgataggatatacaacatcaggcacatcttctgcgtaggtaacctacccaagggatggcattaaagttctttctcttatttggtagctctaactaccaaataagccaagggctttggatattccttggagatatttccagaaaaaagtcattcttccccacctaagaaacgtttttgaccaaagagaggttctagtcattagattcggaatagtctttgcctagacactggaagagacaagctgaccaattctagacttttagtccattttctagattccatacagagctcaccatccttctgttgtgacaattttacttgaaaaaagttacacaaaataaatcatagccattttaaggtagcttatagttgctttggtgatattttaaaagctttcattgtctcaggagctttccatttactaattatctcaaagggtgatctgcctccaaatccaaaggacagagaccatctttggcacaaattccagagctacctgagagtgcgatcacccatcttagattcatcctccaaaacggagctgttaacacctaaaagagaagtttgtaaatgacatggaggtgcttgaataagtgtaaactctatggcaatcctgaaggaggggtcaccttgggctggcacaatgatattgtactgtttttaaatgttagcacagcagaaaacaaagacaaaattaaagtgtcactgttgagcttctgctcactagtccaaaaacaagcttcctattcagttatcactattcaaaaaaactaccaaccaaattttccacatttatgatgttcgcatatatctacgacatttacctctctgcatgcagcagactgaggttgtcaaagataactcacccataggtttaaatatgtacaaaaccactgaagtgggttgatgacttagagaatcacacatggaaatttcttgcttctctgtggtcattgaacatttggcaaaaaccaccttgaaataagtcctgcactattacttagcctagattcattatttaatatcttatatttcatacacttaggtgtcctatcttccaactagctgtcacatcaccctgggtaaagctattacagaatgtgctcaataaataattcttggatagagtaataaaatggccctgacctcaagtagtttgtgggaagagataaaacaccaacaaaaaatgggaagagaggagaaatataaaaagagaaataaaaaattaaaaacattgcaataatctaaggaaagtaagctgaagctcccatttaatattatgtaagctttcaccttgttgtgctccatacacagaatttataatcctgcataatgaatgcagaaaggctattgtaataacaatagcaacagtaccatcttagaaagtaacaaagttgtccttacccaagcaaaatatcacaaagtaaaatgcatttataatgagagttcttccttacagaagagtagatctgggtccagagtattgttaattaatgcttgaccccatttcaaaggaactaattaacaccacccaactgcagagtaatttactgcctttgggaccactgagttattgatggtgagtcagaaaggcagaggagacaagcttcagcccaagcaggagccaacattttcaccttttagcccagagcttggaatctcctaagtccttcttcatggtttttctttgtgttacaaactgagagaaacccaagtgtagatgaactcaacacagcagccaacatccgcctctgggtgcctggcactctcaccaaaggacggagccatgactgtagagtgggtcatacacagagaggcttttctttctgcaacattgattaagatgtcgaacacatttatagaacccttagttaactacattcccggctttggaatgttcttgttaaaaagggattttgtctttctacactgaggctagggtatgtttaaacaaaatttgcctacgatgtcttgggctaaggaaaaatgtcacattatttatgacagatccaaaacttttctttaaaaatacaatggccaagtgcagtgcctcatgcctataatcccagcactttgggaggccaaagagagtggatcacctgaggtcaggagttcgagaccagcctggccaacatattgtgaaaccccctctattttaaaaatacaaaaattagttgggcgtggtgctgcatgcctgtagtcccagctacctgggaagctgaggcaggagaatcacttgaacctgggaagcagaggttgcagtgagctgagatcacaccactgcactccagcctggatgacagagcaagactccatctcaaaaaataaaaaataaaataaaatacaagccattaatctgaagaagagctttttaaatatagctcaactgagcaatagtgaaaatactgtttcatcagttctttttggtacattcaggtacaaattactgttagtctcaactgagcctgctgttttttcctctactccaatcataaaatacttctttagcatcatttaatcactcatttcttttcctctgaattcccactaaaacagtactaatctcatatatgtggtggtaaatgtgtttattgatttcattctattaaaaaattagttggaaaagtcatttttaaaatgggacaagtttttttctgttttgatataaattgtcattttcagagaactgaatttacctgtgaatccatctgtccagaataagccaatattctcaccttgaggttttatgtggttctcccttcctccttgaccagattatcaaatagtagtcagtcatcacattgatacaagaaggcttttccttctatctacctaagttttattgctacaaaaacagattatattatctgaggttttgagattatctatacatcttgctgcctctagttactctgtcttcttaatcaacaatggttggctatatgcctgcttgatacttaagcttccttaatggcaattttaaaagctttgctagaaccctttcagatttctgagtagactaaagttgctttaccaggtacctgtgagactgttgtaaagatgcatgtcttaaacgttaaggcaaaaatgatatttttatattacattacactcttgtgctgtgagccaccgagtgctttttctgaaccactcctgtgtggttggcttttgggggaagggggagttctgaagctgtgtgtggctcttggagagaactctagaaccctggtggaagactgtgtgctcttatattttttctgcatttattttctgttatttcaattttctttcttctgtgtgcaatgaatgatctgcatgtgttgttaaactaaactcaataagactagattttggtttttttccaacatagtcaacttgtgtccttattggcaaaatgttccattgtttcaaaaacaatctttccaaaatggtctctccttctgttcacatttattgatagaggaaacggatttagtcttctaacaacacatcataggacttaaaataagaaacgtacttttctttcgtttcttacaaaccagcaatctagaatcttttcttctgttttgttgaacatatattctgacaattggttacctatatcaactataaatgcagatgtttcacacaaaccaagaacttacgttttcaaatttcaacaattaatgtcatgaatttattgatttctgtagttattctttgaagttctaaagtacgttattaatcatttatactatgtgttattgatatttattacaggggtagctatattctaaagtatttattcttacatgctaacacagagactatcatcatttgtatgtaatgcctagttcaaatccaatttttcaacctagccgttaagatcactggatatctttcaagcagcacaattaaacaacatagtactctctgcttaaatagtctgtgtacttctatattaaaaacaataaagccaaatggctttgtttttataaaagaatccctgagcactttcctattcgtgaaatgcttagtaatgtgctgctctatttccctcactcctagtaagttctgtagtaataagcagaagctcttcagaatgtacacctcacggaagcagaggtacccagcatccgggctattgacatgagatttgagaatgccaactaacctcaggtgcatgaccaggttacaccgccaccccacctgagccctgttcagagactcactctttctagggacttcttgaatgaggttttcaacccgcttgaaattttccttgttgcctgttgcctgctttgatactctccaccgctgggacaaatagtcggcgtcccgcgtagaactggcagtcagccctttggcgcctccttgtggttggacaactgctgagctgctgcacgcactggattgttatggctcagttgccatattgtgcctgaggcgagaatttgtagaatgcttatcccatgaagggctaaaaccctaattaagtataacaataactacagcattctaagtcccagaggattactgtggggttatgatgatgccacacagttgcctggcagagaacagccggtagtagactgcatgctaggccatttgaataacctgtacatctggttcctagagatgagagaattctctcttgcagggtgacagtgcaggctctgctgagcatggtcctcagctgtaactgtgggactgtaccctaagagagatgctccgatcaatgaccacagcaattttttttttactttctgcaaagcaagacctccttgttggtctcttggggataatccttggcattcttcctaaaaatactgttacataaatcttcaaaaatcatattcgtagatgtcaccaaaaaaaaggcaggaaaataatgaagacttcagtgtttcagtgaagagtctatatttttaatcaattcaatgtgtgttttcagtaacagtcacctgatcagcttaatagtcatctaatcaagacgctgtgttgattttcaaagggaaacaaagtagaaaaataataaagtgagctttttgtaagaggacacaagaacagatctttgccttggaaaagaaaattttgcctggttaaaaagttcttgattagaatcttattcttaactttcatataattatgtcaaaagagaaagtgaaaacattacattttttctaatttaacatgtaatatgccgagtttattttaaaataattcttgggaatctttaaaataatagacattagcaaatatccatgtagttgagaaggacaaaagggaaatgttacttagaatttatttttgtcaactttaagtgctttaaatgatactaagatttagagaatattattcacattttccaatttattcataaggtaatgtcaaaatggttcatagaggcaatttttaaaaatatttttataggtatgatttttaaaatacttttattataaacaaactatggtggattgaatgctaatactttcattttggatgtttttacttttttagtaattgaatttttttaatttttcatattaagtgtttttatgatggtttatccatttcttatgtatttagttgacatagaaaagagatatatcttgaaagttggagaaaataatttgatattaactaaaaccaaccttttatagtaattagcatctgttagttccagaaaaggtaatagataaaatcaaatatagtgaggaccaattgtaatgatatctatgtcaacttgagctattcattaatctgaataaaggtgcagaagtgagcatatgcttcctgaactagatcattgtaaatttaaattatggaacagatgtgttgaaactaaaaagagatttgaaacttttacaatttaaaaaaaaaaaaagcttgagaaaagtagatatttttgggcaccatccctttgacagatttgtttaaataattgaaggctttgggatgacatggaaaacctagcctgagaattaaaagatgcaggtttatgatgttattgttgctcttgtttaatgtaatctatcatttaatcacacatgtgtcaagcacagataaactcttccactgttgggattgttgtaaagaactcttgaacccacctgacctcatcaccaaactgccccgcctgttctttgcatgtgccttcagcgagtcatgctggacttagctgtgtctgcatttcagaggggagctgtcagttgcatggtcaacttgtttattgtttccagaactccctgaccaccagttcatgatttgatttgttttcatgtaaacacacataaaacgtggtgcccttttagaatatcgtttgttaagcaactaggcatggaaaaataaatgttactgtttcttgttagctacaaagcacatatccactaaacacatttgctgttggcatgctgcagttggggacagtggacattgcggtaagtggacaaaacaaggcctccacttcgtctcaaataagccttatccatgagaacgctgctttcataccccacaaaggctgcggctttactctctcagagtagctgctctgagagacttccctcagactcattgcccaggatttcttcaggccctgcagagtcctgggcctctcacattgatgacagtatcaccttctaatgaatggcataatttcactataaaggaaacaagaaaaaaaaacagaatgggtacacaaagcttcttacagttcatttgattcccacaagaatcccttagctgtgttgctatgtttatctccaagttagagatgagaaccctagcccccgtgtgtctgatcccaacctgcccttcctagcacatcatagcatatctcttgattaggaaagtgtgaagatgcactttggattttatgattgttgttaatgcttcttttatcagcccacaacaatttgatcttagccggcatcagagaactgaatgcctgaacaaatataatttaccagtagctgccacagcaaatcaataacctgtttactagcaggaaattgtgttagtgaacataacatctcattctcttcatcagtcatcacattcattatctgttggggctgttctatcttgtgtggttttcatctcacaagaatgaatgtaagcataaaagaaatctaatgttaagtgttgtgtgtttaatattatgtatgtggtgctaccaactgctatgagattgcatgaatttatggataacataatcttgcctggaatataaaatgcatgccaaatgtaggtatatatgtaactgtcatccctgtttacctgtagaaatgtctagaaattacaaagagatatgctcccaaacaaaaaataattttttaaatctcaaaagttgaggttaaagctaaaattacccaactgtttttcaagtgaattccaaaacagttcttagttatctacagtgtaattgtgtacaaaatgctgtatgacctcagtcttttctacaatgaatccaagaaggatgtatgtacctgtagaatgagattgatctcgaatgcaaatatagagattagataaagctcaaattttaaataagggaaaaataattgctatgctcctacgtgctgaaaacatcttgtctattgaaatatatgaccacatgagcttcatcaaattacttacccaagcaaagtggaagaaattgcttgaaatggaataatcatgcctctgttctccacagtcagaagctaagttttaaggagcgagtgcgcatggctagccccaggggccagagtattaagagccgacaagcctcagtaggtgacaggaggtccccaagcaccgacatcacagccgagggcagtcccaccaaagtgcagaagagctggagcttcaacgaccgaacccgcttccggccctcgctgcgcctcaaaagttctcagccaaaaccagtgatagatggtaagccctgtttttccataaccatttttaattggataggctatagtgagtgagattatgaagtaattaattctccatagtgccacttgaagaaagaagaaaacaaccccagagaaagaattgtttgtttgttttattggaagtttattcattgccttgggcaaatgtacagaacataagtttacttttggaaaccactttggcagctaaatttacattccaaagaagctgacaaaatgttgttaattcttcacttgtatctacaaatttatttctcagacaagggccacattaagatcaatgggactgtcattctgatgtatttgtgacgtctgaccagcaaaggtccaagacccagggacaaccaggtgcttgctctgtgaatatcttgaaacacagtaaggaggatgatcatttctggtcaacaatgaaggtgctctttccctctctcacacactccatctaccagcaaatcagagaccactgcttatcttccttagagaggttcctgttgaaagttatttcgaagtcttccaatgataagtaaaattcaagttcttctcccaagaggaattaacctattttatttatcatattatgtagcagacattcacttgccaacacattttattgagtgccacataattttcatgtttataaaataaaatattttatttttcatttaagataagcttggctttccttttaactaggccccctgggatctcttatactgggcaaggaaccaaaatcaaatagcatttcccattaatgcataaaaactacaaaggctatcagtccttctgttcccttttcctaaataacgtgtattttcccaggccctcaaagctcgaggaataaaattaacaaccaggggtcataatcacaatgatctgaggatccctgcagtgaagtccctggaaccgcagtccacgggtccctctcagcttactcaaaggtcctcagggatatctcttccacgctcaagtgagcaacacaagtcacctcttcacgcctcactccacacccctgtgggtgccatgctcttcagggcgacccctagtggctgcactgacgtggctcctcctggcggagcttgcaggtcccatatgggcgcaagacggctgatcctgccatgcttccccgcagcctgtcctgtgctaaggaaggaaaaacctccgccaccaacacgggacactcctccatcgagccacttgcaggatctgagtcacttgtggcacagcttttcagtgtcctctagtttcctcactctcctcctaggattttggctgaaagcccttgagcagctgagtcaagagttaccagtgacagggctttatgttgcactcaaaataggcttgctgaatataaatgggtacatcctttctggagggcaatttggcaaaatatattaaaagtctttacatatgtctaagcctagacacatcccacctaccaattctatttctaggatataatagatacaatgaaacaatgtcaggcattagaaatgatgctctaaattaaaaattattgacacagaaagatgataacaaaaaaatcattccatttatatatattatataaattcatgtatctataggaacaagtctggaaagatttacaagaatgtgtgaacagttacctttgagtggtgagatcacagttatattttgtttcttcattttttaatctgtatttcctaatatttctacaatgaacaggtaaagctcttgtaataagaaggcaataaaggattttcttttttaaaaaaaaaaaagccctcagtttagaaaaacaaaatgttagggggaaaaaaagaaaaaaaaaactagcccttcaagaaaaaaaattagcccttcctttcacacactgccctctcccctgcccctactctaggggcccttgccctgactgttactcacctaacacctttccttaagctgatttcctcccaagtggtagaaggagcagcttgtcttaatggtgggaaccagtctttgttgagtgcagacatagactatgtaatgatgtttaatagcttctactacaaatggaacttgtattagtttgctcaagctgctataacaaagtactagatgccttaaacaacaaaaatttattttctcacagtctagaggctagaaggccaagtttaaggtgtcagcagggttggttccttctgaaggctttcttcttggctttagatggtcttctccctgagtctttacatagacttttctctgtacccagccatgtgcaaatttcctctacttataaggataccaatcatattggattaggagccactctaataacctcattttaatttaataacatctctaaagaccctatctccaaacagtcgcattcggaggtactaggggttaggaccataacatatgaattttggagggatgcaattcagcccatagacaaagctcatgctcacccacatcacagcatccctggaaagctgagatgtgtccatatcttcatccccggccctggtttcacactgcattagaaatcatacattacatattgcaatggatccatattcttctaacatgtgcttcaaaaagcattcaactttgtagtgtaaggtccttactgttggctgagcatatttaaataaaaaattcatagaatctggatttttaatttggaaaacaaattctacttgtactgtttggccagaggaaaagaatttttcacagtatctagagtcaccactatctatcacaatattttcagtatctgcaaagatgtctcagaggtacagaaacagaagtcctattctctaccaaatcacaaattggagaggtctcctgtcatctattttctaggtcatttcatacgagtacagttttgtttgtttacaaaagaattgcttctcccttgttgatgcccattcaattaattctgagtttcccaagtgaccagaggaccaattgctgttctgttgaaattactttgttggctacccacctgcaagagatagtagctcctgcctcctcatttaatccaatagtccagaatctttacctctgattgaattcaatgttgcgtcttgggaaactggaagttctttttttacaagaaaaaaaattaagtagctgtcaaataaatgtagacttcagttatacatctttacttatagtacctctttaggttttaagtatttctaaaatcatctacttactaccatagaaaataatatataacacttatagccagttttcaattattccaggtctatttgcccattcacttctggggctgttttcttctcctctgctctcctcacatattttcagcattccattgcccattaacatgctcaggagaatagacaaataaaagaaagaataatggaaactcagatcaacctttaagttaataacaaaaagttatatttggaaaataatagacttgcaattgaaagatagtataatagagaaaaaaaaaatattcagggttaatctgtaaattttaataattcctgacaaatctgatactctttactacagacagtagtgttttcataatttaatgactctttaagaaggttattaaatatccatggcatttttctcttgctataatttttaataagattaatatgttacacttaaaaaggacgcagttgtctctcaatattccatacttgtgtgtaccagaaaagtagaaagtagcaggcagatgctgaagccacaaatgacaaacgaaagaaagtaaactctaaaggactgatgtggtgttatcataccaaatttattttgactgctatgatatgaatcatatttttaactgataaattctataataaaagatagaaatactctattcattgacagtatgtaaccctcttcacataattttagaaattaggtaatatagaaatatttttgtcaagtatatgagtaataataatgataaaacgaacatgtattgaattcttcccattggcatgtgttgttctaaattctttacctctattattttatttaattctgtcaatacccctatggagtagctgaggtattatccccattttatggatgaggaaactaagagttgaatctaagtaacttgcccaaggtctagcaggtataagtaaaggagccaccatgcacatgcaggcaattgaatttcacggtcctcctacaaacgtattctaagatgttctcctagatattatatcaatttccctttaagaatctttcatttcttcccctcccccaacccccaccaccctcttcttgccgctgctcttccaacttcaatcggtcagattccccttcccatataagccacttgaccatgaccatgccactatcccatctttctcccagcctcagctgccaaacctctcaactacatcatctcaaggcagccagagctagaagattaggcaaattggggaaatggcctttcaatgaccgttctctgttttgatcaagtatctgggaagagactcaggataacagccatactggtctgtgtctattttccctggagggaggccaatggtagggtcatctgaggcctgtttcaagatgcaaaagatagtgtcagaagatgcacaggtgttgccaacagacaagcaagtggaaggtggcagattgcaagcgagaaatggagcaagcagccaaaatccacaagaatgatactaaggtagagctaggagaaaatcttcggatttctggtgactagtttgctacgaaggagtcctacacttactgaaccccactgcatttgggagtgccttacagaattgcaatcaaagagtacaataacctggacagtgaaggagaaggacgtagctttagggagctccaccttacagtgcttgatattagctaaacccaacgttctgtagtaattagcatgttcgttccagaagtggcaatagatctgaaaatctgtctcacatacatgtataaccatgcatgttttaacaagtctaacattgtttctgcttaaggagaaattaccattcctgctgagcaatcctcagtgctcatgttagctgccatggaaggtacatcctcatcaggtgtttatgggaaaaactggcacagcctgggttcaggagatgtttagggttcaccagggtgggatctgggtgagatgaagatgcagaatatcttccgattgtgggggtccctcaaggctagtgcctttgttccaggcactgatggtaattcctctctcttcactacccttcatgttcctttctcctctcagccagtgtaccaattaggatgcatttagcagcaggtcacaaaagaagcagattcaactaccttaaactataatgcaatttataataccacatagaaagaggctcagagataagacagctctccacagagcctcagggctctggcttcatttctctgattctctgagtcttcttttgactttttccatctgtctgcctgcctcctcctcaggctggaagcaaaatggctacagcagttgcaatatcttctatagatgcaacactttcagaggcagaaagaggccatcttatgtttgtatctcttcttaaaagtgaggagaactgtccattcacatcttattttgcagaatcctcatgcctaaaacaatcaccagcatggaggatgggaccgccatcattggctgtcaccagtcaggacccagcagctggatctcggccagactcccctaaagcacatgatcaagtgtggggggaagtagctggataaatttaaggatttaggtttggggattgcatttggggaaagcaactttccatagtataatatttgatatagccaagaaacctcttccactttggggtgagggtaaggagtcagcatgtccttaaacatggtgctttctctcaaatattctgtctatatgtcatttctgttcctctaaatgtccgggcttttaaaaacataaaagccagatttataatttttttcacttttctctcatcacatcatttccatgaaacaacaagcatagactagactgtctccttgaatttcaaatgaaaggcaaagtgggtaaaggaacaactagcaaaaataaataaattagtatttcaatcatataatccttcctcacatacagtcagcccataaatgttctatcaccaccaccactaagggaaaactggtacagttcccttcctctccacctcctcagcagcttcctgacacctcgctcctcaagctgtttctcttggtgactccttcttccttctgaagttaataactaacccagtctcacctaaaaatagcaaaaaagtagaaatacaccatgtggggtgccagaaccctcaagtcttcttaaagatagttcatccccttcctctcttctcttaacttctacctaggttctaggcccaccagtctaccacaacccttgtttgaaaatatcaagatcactgaaaacagtgacaaaaaggcagcattttaatgcaatggttttgacaactatcctgaactaacagtctcttgtatccataatggcctattttcttccaagcagtataaatcacagactatcagtattttctatttgactaatttatgcacacgagctttcatcttacactaatcctcttttatgcttattttccaatggcatcttcctccctcatgtttttctcagtctccccagttgacatttttggtgtttccacaaaatgccaagcaccacgctgcacatagcatttttcctgactttccataatgatggcccaacttcagccaggccttgattataattttccacatgatgcttcctggcactttctgaaattgcctgataatgactctgcattgtgttgacagaaataattcttgttaaagcagtatcctattagggcttccacttaacctgtttgtgcagatttctggcctgggattctgactgagtagggcacccattcctgtcatcctctatttgtaacaaaatctgagggttttctttaatgttaagaacaaaaggatttattgagaatgactggatctaaactctagaaatttattcttcatatttaactctatattcagcgtaattgttggagtaattctatgcaaaaccctacaaagggtattcagtaggattctaaaacgcactttcagtacttccttaacttattggtaaaaaccattacctgaagaaattgtctcaattctgatccataggtgtcttttttctttagttgtccaggttctttattcagtccctcaggcatcttcattcaaagacatatcctactcctctgctgtgtttcatatgtactcttgtccccctaagatctgcttctcctattgggtggagagtgacctctcaatctctggtttcagaccccaagtgactacgttatttcttggatttctgagaagagttgtgtcttagtttgtttggactgctataaaaaacataccataaactaggcagcctataaacaacaaatatttacttctcacagttctggaagctggaagtccaagatcatggtgctggaagattctgtgtctggagagggcccacttccacgtgatggaaagggcgaggttcctcttgggtctctttatgagggcactaatcccatttattagggctctgccctcatagcctaaccatctcccagagcccccacctcttaatactatcactttgagggttagggatttaacatataaattctggggggacacaaacattcagaccataacaggttgcttcttccattactttttgtgaaatgcttgttcttagtttttagtgacggggaaatgcttttctattttgataagactgaagttccacctggctttctactctaatccaagtgctctttgtattatagaacaggatttctgtcagatttctctaggttctgtcccatggtttgttgttactctacagtgataaggaaaattatattctgtttctgttggtggataaaatagcttcctgcttgagctctgaatggatttcatctcctcccttccagcagaaactgagctgccaaatgaccttcgagtgctgccttaaccataccttttggcttctgtagatccaggtttcattgagaaacccagggttataaactggagccctatattttgtttcatcagcaaagtgtgtgtgcatgtccacattgatactttaaaatgaatctgaatgctgtattagttatctattgttacatagcaaattaccctcaatttagtggtttgaaataacacatacttataatctcacagtttctatggtcaggtatccagaagcagtttagctgaatggttatggctcaaaatctcatatgaggttgcagtcaagctcttggctggagatgctgggagaggacccattaccaagctcaactgagcatttgctagcaggccttttatttccttgccacattattcacaccctaggttgcctgaatgtccatatgacatgcagctggcttcccccagagagagctgagagagtacgcagagagaagctgcagtcttttatgacataagctcagaagtgttatgccatcgcttctttcatgtgtaagtggtcacaaagaccaaccctgtacagtgtaggcagggactatacaggggggtaataccaggagatgagggccactggggaccatgttagagtcaggctaccacaaatgccttcagatagattatgtcttttaaattgcagatttcaaccagtccctattgtctttccaggaacccaaaccaccaattccccattcctttcgacctctccgttacctacctgcctttaacgacatgggtttataacttctggtctaaccattttatgtccagtatcctttgtattatatctcaaaaaaaaaaaaaaatcctggcctcaacctatagctacgcaattatattccactcttagtgcagactctcaaaaggaatattaacaaaatattgagtatgtgattactgcagcaacaagttaaataaaatgaggaggccaggtgcgatggttcatgcctgtaatcccagcactttgggaggctgagggggatggatcacctgaggtcaggagttcgagaccagcctggtcaacatggtgaaaccctgtctctactaaaaatacaaaaattagccaggcgtggtggcgggcacctgtaatcccagctactcaggaggctgaggcaggagaatcacttgaatccaggaagaggaggttgcagtgagctgagattgcacccttgcactccagcctgggcgacaagagcaagactccatctcgaaaataaataaataaataaattgagggagcaggacatgaactagtcagttgcaaaaccaaagtgtcataacttctaacgcagctctctttcttgtacaatgtatggcccctcttcagcttttcaagaggttgaagatatgttcttggttgcttcaaagggcagaagcagaactaaaaggtgtgtgataccaatatttagttcaatataatggcagcttagcacttagagactccacagcaattgagtggattccataattggaagcattcaaatcaaagttggatgatcaacagtcaggaatttctggaagcttaaggagatcaaaccagaaaacctctaagaaattttcttccaaatctgagtttttataatctgctcttctggaccaatgcaaagtatcttccttagccattaactcgtatcctcactagcaattctatactaagaaatagaagaggaaagcaaggattggctgaggaatgccaggagtgagttttctgtccttaccctagtttcacgtctctttgataccgagaaaagtgctacccgctgcttcttgcctctcattcctcccactgtttcttttccactttcactgtcagccatagtcctttctgtcctaagaagtgtatcaggtgtgtcccacccaccattgtgaggtttatgtgtgtgctccatagcggctcattcttagaacttgaataagccctccactggatttcaattcatatcagaaggtatttgagggctgctactcagagctagcatgtttctgggcatttagaaggcagggaggaggcgtgacaactgtcaccccaaagaacttactgtttgtctgtaagttttaccaccccagcccacctcagttacagtattgattggcactgaggggaacaaaaggcaccttcctcattcttcagacttcatagttttcagaaataacctgtgggtgacgtccaaaattcgcacaaaataagcacaaaattaaccattacacaaatcacagaatttagcccatatttaagagaagcacttttcagctgcatggtgatttttccttcatatatctcaaattatttccttcaaagtcacacttagttgtctgctgcataaacagaaaccaatatgacacaattttaaaattatatttaatcgctttcatggtgtgctctacttggtaaagaaggggggaaacaaggttaagtaaaggccaggatcctttttctgcaatggatgactgacatgggaaagagatgagttacccaggctttgctttttgctacctgcagtataaaactccctgacattgtcccaaattgcttttacaggtattttattttcaacatctaatttgttcggcttttcttcccttgccatctttttcttcttttgccatgtataatgcataacaacaatttctgaactccaaaagcatagaaacctcagaataacattacctgggaaaaattaatctctctacctccagctaccaagagaatcatttgcacatgaaaccctgagatttgcgtctttcattaatctaatgcagtagcaattgttataccacatcgttctattggaattgatgactaatcattcccaaaactcttttgaaactattgttcccataattttgtgttttgattgaaaaatgtcatgaccctatatctcttcatgttatctgttgcatagctaaccctctccctcagatttagtggcttaaaacagcaaccatttgtttagcccacaattctgttaggcagttcttctggtcttaagtgaactgactcatgctctgtgttcagctgctgtgttggctggtgctgactggactaaggtggtctcagttagaattactgctctttgctcatgtggtctctcatcctccagcaggctgggctggttcacatggtggtggtgggttcccaagagcagtacattgatatctgaaggcctcttgaagttcaggctcaacctatcacagtataatgtccactatgtcctgttggtcaaagcaaatggcaaggacagcccacatgcaagagacagagaaagagattccacctcttcatgtgagaagctgcaagtgtcgtggccagtattgcaatctaccatcccagccatttaaagcttatttgcttttagtattttcaacatcctgttggttctatgaagacagtgtcagtgtctaattgacttttttatttctccctgtagtatccttcactcaaagagcctaagaaagaaaaggaaaatagcattgttagcacctcatgtatcgaggcattggctagacattttctatgaattggctcatttaatacacacatagccattttgcagataaggaaattgagactcagaaaatgtaaataacttgcccacataattcagtctaaatgccaaaactggggtttgaagttgcacttaggtctaagttcaaagctttttatgttctaccatgcatgctgcttagcatgttttctttcatataattcatgctgctaatgaaacagtataaaccagctgtatgttaactgctagtgaaatgatttattgtcttctttttcagtaaatatggcaagtctgctcaatttattccctttatcattgcatacactacaaatattctctccctataccttcacatgtcaattaaggtatgcaacagtaatttccattttttttaaacaatgcttatgttaccatctctagacaagttagtccagatgattttggggttaacatgttggcatttcctggcactattactgctagctgaataagagttgaaagttggggaaaaatttaccagatctgtattagttttttcgcacactgctataaagaactacctgagactgggtgatttataaagaaaagtttaattgactcacagttccacaacctgtacaggaagcacgcctgggatgcctcaagaaacttacagtcatgtcagaagagcgaaagggaaggaagcgtgtctttacgtggtagcagaagagaaagagacagagagaatgagaaagtgagagtgaagggggaagtgccacacttttaaaccataatccacccccatgatccattcacctcccacccagtccctcccccaacattgggaataacaactcaacatgagatttgggtggggatacagagcgaaaccatatcaagatctatttagaattctccagcagatttgattaacaatatagatttgtgattctgcaatttgtagggtcattataaaacatggctgccttgattgcaatcagatatctctgaatatggttcaaaggaaacagatctcgttcttgtggagataggattacataactccctctcagtcattttgccattgattcagaatgtttctccctaagatgaagtactgttttagcttagaatggtaacagcaattcatcaccaggcacagtggctcacacctgtgatccccacactttgggaggcccaggcctgtggatcacttgagcccaggagttagagactagcctaggcaacatggcaaaaccccatctctacaaaaaatgtaaaaattagctgggcatggtggcacaggcctatagccccagccacttgggaggctgagaaatgggaggatcttttgagcccaggaggttgaggctgcagtgagccatgatcgcatcactgcactccatcctgggcaacagaacaagtccctgtctcaaaaaaaaaaaaaaaaaaaaaaaaaaagcaattcattgatctcatctagtttgactagttcaattatacatgtgagaaggctatctgagatgatgtcaggtgtggagcagtgactatcccagtgatctgaatgtgattgaccacttggcttcaccaggattatctcactgtttggttctaataaaggcagtcattctagtctatgagtttacctcccttttgctacaaacacttcagtgatatactattgaaactataaaaatccataaaaattggtttttgtatgtgagttttaaaaaattgttttcaccaggctgtgagttttatgtctttgttttctattgggatactaatagtgctatgactatagtatgttctcaaggaaattcttatgaaaattgaattaatccgacacagtgcatggttttggagtaaaacagaacttgttttaaatcctagttcccccactaggttgggtgagatgagacaaacgacttaacctcactgccactttaatttgttctctctctctctttagggtggtagaaatgatacctacctaatagggttacgtgagtaataataagatataatgtgtgtaaaattcttgtacaatgcccagcacagaataggtgctcaatatattaaatatattgttattatttattaattaattaatgctgatttctgcattaattttgactaattgaaatcctggacttgcttaatttgcatgtatttgtcttcccttcttccagtacttgatggcaatttctacctgtggtaaatggaacgttaaaagttatatgcttatacaaactttagtcctttattccttggagtgagttttaagagtcctcatgttgaataattcatgtaatcacagaaataatactatgtatcagggaccgcttcctttattaaagataaaggcagtggaaatactgcctttgtcagaaatacttcagttactctgagagagagagacatttgtttactatatgacagcacagtgcatggcaaataatagaagtttggaaaatatttattttgaatgaatgaataatgaacacattgtgaacaaataaatggtttactatttaattattcaggaatcaattaagctttattaataaaaattgtttgggggttttaaaaagcccacacacaaatgagaggcatcacagaggcaaacggtatgacattattaaaatcgttattgctgaatcacagttcagcaataagcaagtgtttgaggcattcaaataagtgagtatttgagtgactctaagaagataatgaaactcctccactgttttacagttgcaataatttttaaggaacatataaaaacatattctagtgtttccatttgaataaagatagtatatataacatatgcaattaaaaagaagaaagaaaacaaattttaatgtgtttttcttttcaccttatgggcagttactagatgtatgatcagcaattttagcagtagagaccttattaattgtttttgaaaactctctagtgcttcacaccgtcactcaaaacagagaaattccttttaattaaatgtcaggaagtattccaagaaattttgccagcatttctgctagccagtaagtaaggttaattgacaatctttaagagagaatcttagagacattcatatcataattaatgtaatttaagatgctgaggatgcatgaattacctactcagtgtaaatggggtctttgattgtgaagagaaatactcaagtgcagtggtatcttacagaatagattccctcattagtgtgaattagtgtttctgaatgttgctaattagcaagcctgggaacaaacacaatgaaaaatcaagtttaccaaatcacaaaaaaagtactggttagcatatttggtaaacatgggtcgataattattttgattgaatctcccagcaacctagtttattgtggttgcaggccctgtgcacagtatgttttacctgccataggtataatcaaccatatactaaaagtttgtaatgactgttgagatcaaaaagtatttcagaaagtcactgagaatatagttttctgagataaggagatgatgttctatttctgatgtgactgtaaaaaggcatagaacttaagtgagaaaacaacaacagtgcctctcattttcccagaatttatttcaactggctgttgagcctgcccttgctctcttaggactcatgttacgtagaaatgcagactgtgtgcagttctggtcacctcctagggaagcactgagaagggagcaagtaataaacctcaggaaaaatagttttttgttttttgtgtcaaagagcagtgggtgatggttttaaacatctgagatagaactggtgataaagaaaagttaggaaagaagacatactgaaaagtaaaattgagggatgtgaaccaggtagaaaatactgtatctaccatgcttttcaagctatggtagagtgtcatgaaatcaaatgaatgggttatgatcagcattcttttagtgaaatgaaacaagatgggatgagaagttatggaatgagatgggcatatctgttgtaaaatgggataggataggacagaataggaaatacatattatagaatgcatcacaagtaataagagccagtgtcatttcttgagccttttaggttttactcaaagatttttggttttaccaaagtggtatatgtatacctggttttaaaggtcaagtaataaagattaacacaaaatgaatcacagatttaaatataaagcataaagcttttagaaaaaaagtaagagaagatctttgggatccagaactcagcagaatgttcttaggcttgacaacaaaggcactacccataaaaagaaaactgataggctgggtgtggtggctcacgcctgtaatcccagcactttgggatgctgaggcaggcaaatcacgaggtcaggagttcaagaccagcctggccaacatggtgaaaccctgtctctactaaaaatacaaaaaattagctgggcgatgtggcagttgcctgtaatccccgctactcaggaggctgaggcggaagaatcgtttgaacctggcaggcggaggctgcagtgagccgagattgggccgctgtactccagcatgggcgacagtgggagactccgaaaaaaaaaaaaaaagagagagagagagagagagggagggaggaaggaaggaaggaaggaaggcaagctgatagaatggatctcattgaattaaaaacctttgctctgcaaatgagactaaggggatgaaaaaacaagctgcaaactgagagaaaatatgtacaaatgacatatctgattagaatatataaagaaccctcaaaacaccacaggggaaaaaaaaaaaaacaccagttgaataagaaaataggcagaaaacgtgaagaacatttcaccaaagagcatataaacatggcaaacaagtgcaagaaaagatgtttaatatcattagccccatggggaaagtccagttaaaactacaggagatatcactacacacctgccagaatggctgaaacaaaaaaaactagggatgacacaaaatgctgggggagatgcaaagaagccggatcacttacacattgctggtgggaaaacagtttagtagtttcttaaaactattcagttagttactatctgaccaagtaattttattctcgggtatttagcccagagaaattgttatgttcccataaatcctatatatgcatggtcgtagtagctttctttgtaatgacccaaaactggaaacaacccagagtaatattaatatatataatatatattttattatatattacatatattattatattacatataatatattaatatattgcatatattatatatgtactatatatatttaaaatacagctgaataatattccgtagcatgtatgtgccacaatttgtttaaccttttgtctattgaaaagtttaaccaataggcaaaaggttaaacatatcgtggcacatacatgctatggaatactactcagcagtaaagatgagtgaagtattgatacacacaacaatgcagctgaatcttgtgagaattatgttaagtgaaaatataccaatcccaaaagatcacatatcattaattattaagtattactgtatacattaatgtagtgtgggaagtgtatatatatatatgtgtgtgtgtgtgtgtgtatatccatttatgtaacattcttgaaattatagaaatgcatatcatattagtggttgccagtaatcatggtgggagctgggagggaggaggtgtggctctaaaaggacaacatgaggactccttgtggtgacggaaatgtctatatcttgactggatcagtgttaatattctggcagtgatattgcactatacttttgcaagatgttaccattgtaggaaactgaatagagggtacacagaatctctgtattatgtcttacaaattacatgtgaatctacaattacctcaaaattgaaagttcaatttaaaataataaaagtcaaatgatataagccctttgttacagaatataatgattttcttcctcaactctcccactctatccctagaccacctttccaggagcagccattttctatttattttagttattcctcttgatatttacatatctccatatttttccaataatatgagtgtactgctaacttctgattaattcattttgaatactgtttactttctattctggtaaatgaagatttcactcttttttcactcttccttctgcagaccctcccaacctttcaatgtaagtcactatagttttttgagaagtcaaaattcagcatctacattatgtatacatattacactgcactatggttgtttcttaccttttgcttttcctgtagtaaataaataccttgttcattgttgctgttttcataattcttcccacatcttcaataatctctcagtaatattttccacaaggtaaattgcgtcaggtaaccaatcagtcccattgtgacttttctttgagaacacattctggaaacctccattctccttttacctgagctggctgctctctaagcctactgcacagccattatcttttgaattcccttttattttcttctagattggattctcagctttcaggatcttgtgtttttgtctttcttgattcactccattatttcagacagtaaaaatccaattttttttacataaaaagatgacatgatgacagaaggcatgatgatgacagctgtcaatgtgtctgtccctcaattcacactagtcctatctggaccaatttccctctccacctgacacactgctttcacacgggaattttccttccctgtcaccctgctgactcctgttgcgtctctctgtgtcaccctgttctgtggctgtgtctcccactctcttcgtttactttgccattttgatgaagtacatcctatcatacattcctgagaagagtgtctggaaggcaaaatttttaagagcttgtatgtctggaaatagttcgtatccattctagaatatcttattgggttttttttttctcccttcattttctctgaaagaagagagaaaatatgaagatatttctcataataaagatatgaaaatctgttatttgaaagttggacttgcatactggccccgattttcttatccttcctctttcattttctacctctttgtctttttgtcctactttctaggagttttagctaatattatcatccaaacctcttactaagattttcatttctgctatcatttctaaggtcctttgtttttgttgtttttgactaagggttcttttattttagtatcctatttttgttgcatggatagagtattttgccttatatctgtgaagatattaatgacaatgttttgaaattttcatttccttagtttctgttaccttctagttgcttttgagctccatttttgtactggaagatttccttagatacatagtaaattgaatgttttctcataataaaatgttggagactagaagggtgactggagtttctgagtgtattagagctgattaactttgatcttcaccataggttgacctgagtcaaccacttttgggggaattcctggcaacagtatctttagctcttttttcttgcactgatcagattccccagagagtagctactcaaactcctagagggaaaaggtcttactaccattattacgataacgagcaggttgtggtggatcctcaacattcaatctgtgtatgatcacttaataccccagcttttggtttaatacctgtcctttgactgtgttggatgtatctttggatgaaggggtgaactctcatctaaagatttctatcttctgctggaataggagaggaccatatgcccaggagtctgggagagattgcacgcaaccttccttatcttagttatcccctctttatgcttggatcaagaagtacctaacgttgccaattcctgagccttttgagttttccaaagtgtaaatcttgttgttcttagcttttctcagtgttggcatagggttttctctctggtgtcagctagtcagttacctaacttgtccatctgctttcccacttccaaaattatgttgttgtcatctcctttccttttctcttcttttatgggtttatgtctttttttaaagtatttcatcactatagttttagtgggtttttcaaaatgagcaagattagctgtatatgttcaatctaccatcttaacccagaaaggaacttctgtcttaattatatgtgtatgtgtgcatctttgtatgtgtgtgtgctgaatcacagcataaactataatccttattgtggatgaaagccaaaaaagtcagttagtccaggccaacaaaaagtaatcaagttcagtcaaaggctagtcatattttctctttgctatgaaagcctcccatagagctgagagagttttgaagacatatgaggacattttttcagaatgtggtattcataggaagctctaagtctatctctttagaaaaaaaaaaggtaagctacacttcctctaatactgcatttgaatgtgtccttcatttctgttttgagtactaagattatttattctaggtcccaaatttttatgtcaagaatgtcataatactaaataagtaaaataaaaaataataaaaataacaagtaatcccagtgctaagttatgcaatctgtatcaatctgtaatcttcaattccactaaaaaaaaaaaagtttgctctccaaattgcatctactttggcaaaaatgcatggaaaatgcaattacctgttcaaaatattaaaattagctctttagaatattgctttaaaagctcaaaaggatatttaactttgaaaccaatatgtgctgcagatatggatacctagaggcttttttttcaataaaaactaattttcagaatttttttcaaatattgtatcatttctacagcctaaaaaaaatgtagtgagagtgtgttcacagatgcatcaaaattgttattatagcattatcttttatttctatgggaactcagtgagatgatttttctaactcttaattttaaaaaactcacttgtaagctattactccaaatctcctaagattcagaattgagtaaacaatggtcacatgattgagattttacaatttgttgctacagtaccagcaatataaagtattgggataaatgtcagtttggaaaaggtgataggtgtgaaatatccaaaagtgacatgtgaagtaatgctatcttgctgtaaagtatttagatttccattagtgttacattgttcctgaagagaaaaactaagtctggattgccttcttttttatattaatatggatgatacagtgagagagagagagagatccctcttccttttgtaccaatgtgaacattcttctattatttactaattataaatatatagatccaagaatttaaagtgggcttacagattgcatttccacctaaaaataaacacgcagcatactatatttattcaacaaatatttcccaagttctactataaaagttactcattcttttactttaaacttcttttgcctcttaaatattttcatgggctaataggggaagattctatttaaaatgtttataaaaagtaaacattatgtggaaattttgggtttttttcacagtaggattttgaagtatacctagtcacgaatgatcacaaaaacaaaacaaaaaaattaaccatagtacaacagaaaataataaggccaaaatcccatgaatgacaaggcacggtcctgccctcatggagctcactgtctaacaaggaaaggggcttgtaaacaatgaaatataatacagtgtaataactgagaagacataggcatacatagtaaaggaaggactgcatcagtcttccttcagaggtggtagactcttgaaaggcttgtcattccagagctaagcctgaggctctaaactccatcacgccaccctgcacacttcatcctctgtgcttaggacctctcaaaataaaagaaattgctagactacaaaataaagttatggttttcaaagtgccacaaaagttacatgtaggctgaaattaaaatggtgtgttctaattattctgatgttctccacattgtgagtgtcccttgctattgttagtgccccatgcatattataatctgcccaccacaaattcagcacctagaaattaccagccaaacaaataagaaaagcaacgaggatggatgagggtgtgtagacgataccccttgggagaatgtccaatgatgatgatgcttgaacagcacctaggaaagcagttggaatttggtgtggctggagaatgggatggaaaggccattataagatgaggctgaatgggagcttctgggccatcagaaccaacttccttcccaaggcaaccagagatgtttaagtttccatctatgctgagaaatcgactttgacattaaacatcaattgatgtacaggaagagattggaagggaatataccaaaacttgataggatttgtcttagagtgttaaaaccacaggtgaattttttttctttctttgtgatttaatttaaaattcaaattttcaaggtttctacaatgcacatgtattactattataatgagagaaaagcaaagtgaaaataaaaactatttgaaaggaaaaacatctagagtaaaaaatacattatccagagtatttttctgggttccttattcatgccttgaggacctagtttgtctcttggttacttagcagcatctaacatggaacaggaagaaaagtccctagccaaggacttagtgaaatgaaattgtgctactgcatcagggcccaagcagttactctaaactctagttggattaaaggaattgtctttggactagcacatgtctaaaatggtaactctaaatctaggatgatatttaaggttttgagaaatgatagcagagggtggcagggggtgagtaatttaaatacaaccagcagcagaaagaaggaacccttggaaagtaaattataattcattacgggatgtaataaattagttatcaccaccattaatagtagccattttaatatgtgttccccatagcataatgaaatagaatcatcacatactttatttaaattcctaaaataaaaatgaattgtgaggttgggcgcagtgactcatgcctgtaatcccagcactgtgggaggctaaggcacgcagatcacctgaggtcaggagatcgagatcagtctggccaacatggtgaaaccccatctctactaaaaatagccaggcgtggtggtgcgcacctgtagtcccagctactctggaggctgaggcaggagaatagcttgaacccgggaggcagaggttggcgtgagccgagatcacaccattgcactccagctgggcaacagaatgagactccattcaaaaaaaacgaaaacaaaaacaaaaatgaattatgaacttctagccctcacactttcactgtaagtaacatatcacaataatggttgccttttttatgcgatgcataaatattttgttacagagtacaaaaatacttttcacgttttggttgattcaaggtttggaaagaatgaggagcagcggcaggcagagtgactgtggagaggtgaacagtacggcagagagggcattcctatgactgttggcgcatccgaggagataggagcagagaagcccaatttgaaaggaaaaggcaaatgccatctatctgttgggtggaggcaggcgctgagtctggaagcgtgtggggccacggggctgggggctcgggcctccctgaagcgtggtgggtgcaggggcgaggcgagcagagagaggccaggcaggatgaaccaccgggggccaggacctgttgctatggtgacagcgtgaaaacaaactgtacactcacatatacacaagcgtaagcgtcttcattcgtgccaggaaacatgcaaaattaaacgcctcgtttcctcgagcgggagctaccgaagcaaagttgggtgggaggtcaggccttgcagggtccaagtgatcctccgagctggatctgagcgcctcagcgagaaggtccccaaatcctcctgggaggcgttggagaaaggcttgagtgtgcagaaaagggctgaggaagaggaggaaggggaaacaggaaggagtccactgtgtcaggcttaggattcacaatttctggggggcagcggcagctctgcacaggccgcccgggggcgggggcggtgggagctcagggcgcctgtcccggcaccaccacagattcccagaaccaactccccggtgaccagactgaagaactaacagaactgacgatacttccatccttgctgggtggtgtcagaggaagggaaccagcgcacctggcatggagggcggcggcaacggtagtggcagctgggtaggtgaacgcagcatgggtgatggctggggtcagctctgtggtgtacaaaggataagggcccaggcctctgggcatgcaggcatcagagcagcccccatcaggtcataggggtcccgagcgatgaagtaagtgtgctcctaggtggggtgcatgttggtgggatttggagttgccattagcttgctcttggccatcttggtgttggctttggcaaactctagcctcatgatctgtgggttttcgggatctaagcgaatatcgttcagcgcatttttggccgcttctgctcctgccccgctgtcaaagatcacaaaacaggctgtctcgcggtgagcttgagtagggactcttcataccccttgaacggccggaagatcaagtagggttctctgggtttaatgtccatggggaggccgctgatagtgtccggacctcctcttccaggacgccgccggaacccgcgctggagccagtacaggtgctgccgccgcgctcgccctcccgctacaggttgctcctggtgcgggggagggggcggggcggcgggaagggaacgtccgggcgagcacggcggcggcgccggccccagcgttgtgtgggcatggttgcctttaagtcctggaattttggaagatttttttttttttttttttttttttttttgtggagacggagtctccctctgtcgccaggctggggtgcaatggcgcgatctcggctcacgcaacctccgcctcccgggttcgaacgattctcctgcctcggcctcccgagtagctgggactacaggcgcccaccaccacgcctggctaatttttgtctttttagtagagacggggtttcaccacgttggccaggctggtctcgaactcctgacctcagggatccgcgcgcctcagcctcccaaagtgctaagattacagacatgagccaccgcacccgtcctggaagattttttttcttcattctgttttcctatttttcaaatacttcatatcaaaaagtatacattatttttgtgatggaaaaattcttaaattccttaggaaactttaaatgaagtataaataatttataatctcatgcactagtacagctaattttatttttacatattctcttctagctacttttcttttcacatactattgtacatagttataatcaacataagtagtttcatattttaatttcattgcacatttttaaatattttcatgttattacatactattcataattgcctttttcagagctgtgtagtacacctgcatgatcaaatgctataatttactataatttgcagttttctactttagggcattgaaacttatataactatttttctatagtaggtgataaacattattgcattaagctacatttctattctttttgaacttattttacaaaggaaacttaccttgtataaaattgtaagattgctgattatatagcaaagacatagactcaatctaagtgcccatcagtgacagatttgataaagaaaatgtgttacatacacaccatggatactatgcagtcataaaacagaatgagatcatgtcctttgcaggaacacaaatggagctggaggccattatcctcaccaaactaacacaggaacaaaaaaccaaataccacatgttctcacttttaagtgggagctaaatgaggagaacacatggacacaaagaggggaaaaacacacactgaggcctacttgagggtggatggtgggaggagagagaggatcagaaaaagtaactgttggatagttcctgggtgattaaataatctgtacaacaaacctgagtttaccgatataataaaccttctcatgtacccctgaacttaaaagtttaaaaatcaaaaataaaaataaaaagattgctgattatacattaagtattttattgtcataaaaattaatccaatttatattgtcaccagcaatgtcaaagtgtaccaaattcatgtcaatttttattagttattattcttttgcaaattaaatcggtacaagttcatgcttttaatttacaattttaaaatttctagtaaggctgaataattttcagtcattttttgctagtctttcctgactgacttatttgtacatatatattttgaattgtgattcattcagataagttccttatacattgtggatattaagccttttttatattttggaattcttccctaatgaagaatttttggcattgtaatttagttattgtgggtagcaccatgttctgtcttcatgatcaaagctgccagctctctcctttataatttcttctattgccccaaatgtgaggacgttattattcctccacagacaaaacaagtgtttccgctatggttttttttgtttgtttgtttgtttgtttgtttgtttgttttttgagacagagtctcgctctgtcgcccaggctggagtgcactggcgcgatctcggctcactgcaagctccgcctcccgggttcacgccattctcctgcctcagcctcccaagtagctgggactacaggcacccaccacgacgcccggctgttttttttttgtatttttagtagagacggggtttcaccgtgttagccaggatggtctcgatctcctgacgtcgtgatccacccgcctcgggcccccaaagtgctgggattacaggcgtgagccaccgcgcccggccttccgctatgtttttgacaattgggttttatttttgtctgtgactgtgtaagctgcttgtgtttaaaagcagtagtgatttctttaaaagagaaagagggccaaagcctgagaagagggggttttttgatggctgcgagtagaagacaatgactggaattcagcaggctgaggccttcaagctcaattaaagatgactagaatgttgtgataggacaaaaccttgttcctgtatcaccaatttatcaaaggatttttaaattgtttttctgttttttatgatgtagtcatttactgctgtcttgtgaggcacgtatgttgtctcaaattgctcctctgcaaaatatatcagcagcaccaaggaacacaggatggcggattagccaaacactgctcagctctggctgagggagaccaggagatgtcatttttctacctacaaccagtggtctttgcccttggctatacatcgcattcttccagagagctgggaactccaacgcctgggtcctagcctttggtttctaatgttattggtcttgagagcatcctcattattgggattttttttttaacactccccaaatgattttaatgtgcagccaaggttgaaacccactgtaatcatttcatcaagaaatgcaaagaagatatccaaaagaaaagaagtcaatatattgaagagatatctgtactcccatgtttattgcaacactattcacaatatccaaaatatggacttaacctaagtgcccgtcagtgaatgaataaagaaaatgtggtatagatacacaatgaaatattattcatccattaaaaagaatgaaatcctgtcatttgcagcaacatggataggactggaggccattatgttaagtgaaatgggccaggcacagaaagaaatagatcatatgtgctcattcatatgtgggaccgaaaaaagtggatctcatgaagacagagcttagactggtggtttccagaggctgggaagagaagttggaaattggaagaatgggaatgaagagaggttaattaatggctacagtctgatagaagaaatcagtcctagcgtttgataggtcagtagggtgactatagtttacagtaatctgttgtatatttcaaatagctcaaatagctagaaaagaataattcaaatgtttctagcataaagaaaagacagatatttaagatgatggatagcccaagtacactgacttgatctttacaagttttatgaatgtaataaattatcacatgtactccaaaaaaatgtacatctatgtatcaatgaaaaatagaattatttttaaaaagaaatgcagaaagaatctaatccgtaaaagaaggtgactaagaaaaagaactagaaactacctgtccttcttccataaataccttcaatttgatggtaaaatttcatagtggaaatagaaatatggtttttggacacagcagaagtttccaaaatggtcttctttaccatcctctctcttcatcatctcaagtccaagtggccctttccaaacagtatagaaagtagcaattagcagtttttcaaaattcaaaatttggcttagatctttttattttatttttatttatttatttatttagagatggagtttcactcttgtcacccagactagagtgcaatggtgcgatcttggctcactgcaacctccttctcccacgttcaagcaattctcctgcctcagcctcccaagtagctgggatcacaggtgcctaccaccatgcccagctaatttttttttttttttgtatttttagtagaggtgggttttcaccatgttggccaggctagtctcgaactcctgatctcaggtgatccacctgcctcagcctctgaaagtgctgggattacaggcgtgagctgccgcacccagccagcttagctctttttaaatgtcagggaacagagtacttgaaagccaatccttaacactgctaatcaataggaaacaggaaaggcttggggaagataaacagttgtattttatatttatttttctccctaatgccaagcatggaccattcatggggctagatctgccagggaggatcccaagaggatccctcacagagagcaggactttggggaggaccttattccattggcattttgcccttttctgagtaggttttgactaggtgctcacatgagttcacggtcccataacctacatctcccaaaataccaggacagagaggcaaatgtgtagttggagaacagagggccagcctcagctggaaatatagcccctcctaagtaccttagcattcagaggggtttaagcccctaggagtaataagaaagacatttaatgtgttactaacttcactggaaataaaattgacaactcaagatatagcaggtccacaaataaaattgtttccttcatcatcgttttgttagatggatgaggaaaaaaaaattggttcttggctggaccactgtctgtgtggagttggcacatcctcctcaggcctgcatggattttctgcaggttctctggtttcctcccatatcccaaagctgtgcactgaagttcattgacgtgtctaaatgatcctcatctgagtgagtgtgggggtgtgtgtgagcatgctctgctctgagatgtgccctgtccatggctgttagctgccttgtgccctctgctgccaggatgggctccagccaccctcaaccctggactgaaataagtgggttggaaaataaatgaatgaatgaatgaatacaaattattgtaaaatcaaaatgtgtcagaccagactcagtggctcacacctgtaattccacaatttgggaggcctaagtgggaggatcatttgagatcaggagttcaagaccagcctgggcaacataacaagacctctccatctctgcaaagaattaaaaaataaaaactagccagacatggtgacctgtgcctgtagtcctagctactagggatgctaaggaggaaggataacttgagcccaggagtgaagttgcagttacctatgatcacaccactgcactctagcctaggcagcagagggagacgctgtctcaagaaatatataataatcaataaccatacatctggtagtaaaatgagtttggttaaaaataactaaataggccaggcatggtggctcacacctgtaatcctaacactttgggaggtcgaggccggtggatcacctgaggtcaggagttcaaggccagcctggccaacatggcgaaaccccgtctctactaaaaatacaaaaaattagctgggcatggtggcaggcacccgtaatcccagctacttgggaagctgaggcagaagaatcgcttgaacccggggggcggaggttgcagtgagccaagatcgcgccacttcactccagcctgggctaaagagcaagactctgtctcaaaaataaaataaataaataagtaaataaaaaatagcatacaataatcatacaaatacacaacaattgatgcagtaggaaagcactcagcaagcccaccaatatttgctcgtttttttaactgtatagtggtaggaggtgccccttctaattttcgctatgcaatcatttattctttgatttaacctcccgccattatgaccactgtcactcactgattaaccaaaaattaggtaaataattatcttacttgtttttattaatctttcttaaatgtatatgtagctcacatttgtttcagtgtttaatattgtgttttgtgtctttatgtagaaatttggtgacgtttttgtgaccagaaatatgccataggactttaactcttctttagatcaaatagctatggtaaaatcattttcattatatgtgatttcacttaaagtcacaatttccaagaacctaccgaagacattaagtgaggacttggtgtacttatgaagcagaaagacagcatcttgctcatttttgtagctttgaagcaagaaaaaaaaattccctaattcactcctgcctcaacacatgccagcaaagatatatttcctattcatttgctctaactacacctacccaaaaaaaagcagaattgagtgtttaatttatggcttaaacaatcaagttataaagtgctgtataaaactgcacaatcagatgcatttgagtataatgtaattgatgaccgactctcatcctctgtccagccctgttcctaaacaggatgagtctcttattggggtacaggatgttgatggggagtgcaacattaggctgggaggtaatgtcttgtaatcatctgggatgttcgcaggttcatttatgtgtgaacaatatagtttcactatctttacttttgtgcttattgtgacagtaaacatctgctgaaagaaagttttccattaacctcaaaattaaaggactctatattttatgctatttcattatttggacctgcattatcatattatggctggttatacagtgttttcaaatacagaaattattaatataggcttgcaggatctgtcttgtaaccactccagtgttccccaactttctgagatatgagaagagactaagatagaagtacctctcattcagtttcagatgagggaaagcagtcatatgcctctgttttgaaggacagcataaaacactcttgtgaattctgtactgggaatcttttttttttttaagagagtgggtctcactctgttgcccaggctggagtgaagcagtacaatcatagctaactgtaccgttgaactcctgggctgaagctattctccctcttcagcctcctgagtagcttgaatgactacaggcatacacactaccatgcctggctttttttatttttattaatattattatttgtagagacagggttgcccaggctcatatcaaactcctggccttaagcaatcctcctgccccagcctcccaaagtgcaggattaaaggaatgaaccaccatgcccagctgtactgggactcctgataaagtttgttattcaatatttcctttggggagctaacatctgggcatctcccagggctctataatgatggctggtggcttcagttttgtcagccacccagcctgtatatgagtcctctattccacctgacctttccacatcccttacacaacccccttgaatttccagggtctgtatatttccaaggctcctttgggtgtggcctggcccagcacatggccatggtgaccacattgctcaaaatcaaatctcctctggatttgatatggggtccacaccgtgccaagtgcaccagccctgtgaagaaaaatgtaatgcaggagatgggaacccagataccaataagagatacaagaagggcagccccatgtggtggttcacgcctgtaatcccagcactttgggaggctgaggtgggcagatcacctgaggtcaggagttcgagaccagcctggccaacatggtgaaaccccgtctctactaaatatttaaaaattagccgtgtgtggtggtgggcacctataatcccagctactcgggaggctggggcaggagaattgcttgaacccgggaggcggaggttgcagtgagccgagattgtgctactacacttgagcctgggtgactccgtctcaaaaaaaagaaaaaaaaagagagagaaatacaagaagggcaaatctggaagtggtcagaggtgaggctcagggtcagacagctccagaacccaactgctggggttaaagttctcattctgtcatttattctccaggtgtcgctcggcaagtttcttagccttctgttcctcactttcataatctataaaacaagaggtaatggtaaaacacactcaggccgggcgtggtggctcacgcctgtaatcccagcactttgggaggccaaggcaggtagatcacgaggtcaggagatcgagaccatcctggctaacatggtgaaaccccgacactactaaaaaaaatacaaaaaaagtagctgggcatggtggcgggcacctgtagtcccagctacttgggaggctgaggcaggagaatggcgtgaacctgggaggcagagcttgcagtgagccgagatcatgccactgcacttgagcctgggtgacagagtgagactctgtctcaaaataaaaaaaaaaaaccgcttcatggggttttgatacaattaattaaagttcttggcacataattagatttctctaaaaaaaaaaaaaactcttattactatcatcatcattattgtcctggagtaaagaattggaagccatcagggaaagttttcccagctgtattcatttcttgggctgccatcccaaattaccacaaatcaggtggcttgaaagcacagaagtgtattatctcacagtacgggagtccagaagtctgaaatcatgggctcattatggttgcttccttctggaagctctgtgggagaaaccatcccctgcctctctcctaacgattggtgggggccaacaatccctggtgttccttagcttgtagatgcattactccagtctctgcttccatcttctctgtgtccctatgtctttgccttttctgtttcataaagacatttttgctgcatttagggtccccgcctaatccagtgtgatctcattttgaaccttacataattacatctgcaagacctttattccaactaaggtcatattccgatgttccacgtggacataaatcttggggtgactctattcatcctactacagcaactaagagcaggttacaataaaatcagagaaaccatgaacaattcctggaaagaatgtcatcaaaccatgggcacgatgtttatgggctaaaaagactgtgttgtgtgggtggtcaatccagcaaactggctaccctgaaggtcatcactgagtcagaaccaactgtcaaacacagagttaatcaatgtactctcattccaactggggcaaatttctctggagaaaacatgtatctgacaggagcaggctgtacacatcaggcaacacacacgtgtagtgagctctttgccctgtctctcctgacatattgtagtcacaatttaaccccaaactcgttctgatactgcgtaatgcaatgcaaagggcatgggctttggagcctcagggaactggattctaatgtcagcctctgcaacttactagctccgcttgccaccttcatggcctcagatgaggtacttaccctctccaagccttaatttctgcatctgaaaattggtcataataccactaacaacttgtaaagttgctctgagtatgaaaattaatatatgcagaagctgcacctaagtacctggtgtaaatttcaatgagcagttgctatttgtcttagtctatttgcactactataaaaaacgcctgagactggataaccagtaaagactagaaatttatttctcacggttctgaaggttggaagttcaagatggcaccttgctactgagtctcccagaagagacaaatgctatgtcctcacatggtagaaagaccagagggtaggagggcctacctagttcactccagcccttctataaggtcgctaatcccattcatgagggctccaccctcataaatgaatcaccttctaaagttcccacatcttaatactatcacactggtgattaagtttcaacatatgaatacaggaagacaaatttcaaaaaataacactattattatcattattgtgaggtagtagtttcatctctctcctactaggcttaaaggcaagaaagccaaagggacctcgaagaagagctgtgaagatccatgtgtctacatgtatctcatcatctcttcccgcaccaccgcctgcattacagcacaaaagtaaactgcataaacacacagtaaatattcattgatgtaaatgacacacaaactgcattacaaatataagcactgcctcaatgaatgaacctccaatagcctttcaaaatttggagcccaaccaggacagcccatggcaaagtcttttcctttcatgacttagcaaatgaacactgcacagagcaaaggcaacacaaagtagtattagtcctctagtgtatgtcaacatttagagaggcttggaccatataaaaatggtatttggaggccaggagcaatggctcacccctgtaatcccagcacttagggaggccaaggcagacgggtcacttgaggccagtagtttgagaccagcctggccaacatggtgaaaccccgtctctactaaaaatacaaaaattggctgagtgtggtggtgcggtcctgtaatcccagctacttgcggggctgaggcatgagaattgcttgaacccaataggggtggtggttacagggttacagtgagccagatcgcaccactgcactccagcctgagcgacaaaacaagactttttctcaaaaaaaaaaaggtatttggaggccacataactcctctttcatgagagcatttttattactttactttgtattgccaaagtaatacatgttcattggagaaatgttagaaaatacaggcaagcaaaaacaataaaatcattcttaatttcagatatgcagagagtttttttctttaacaatatactgtgacactttcccagtcattagtcttcaacatcattttttaaagttgtctaatattccattatataaacctaccaatattcatttgacctatcctccatcacaggaattttaacttcattctaatattttgttactgaaaacagaaatgcaatgaaatgagcttattccttatttgctttacaaattcataataatttggcatttattataaccctgctgccttccccaaacatttgcaattaacccaaaagtaaatttccttggtttacgaaaaactgattttttatccagtctgaaaatcgccctcagctttggctgtatgatctgaagcaagctctttcctggctgcctgtatccagtaactaataagtagtcagcattcttggctccggctacttagcttacttgttcaggacataaggctaatggggtcagtgtcatgggatatgagcttgatatatacaggccagttagttacaagtccaaaaactatttctgtaactccagacagctgtcacttaaaagctggctgttagtttccaaggaactgggcaaaagagcataggtggatcaacacaaatccatcaccagtactggaaagataatgtgtcgatagcttcatcttgcccgtagaaaacagttcagaaaagtattcatatttaaaactggggaggctgtagaaaaagaagaaagaataatattggcaagacaattggctgaccttatacatatcttggtttatcagcttactctgtgagtatcccgccatttccacgtgagaaaaattcagcaacatgtttcaaattgcggatggtggtgttatttaactggcaatattctcttgcagctgacacagcccttggcactgatgatgtatatgatgaaaaaggatgccagtgtgatgtatcagtggaagacctcaccccaccacttaaaactgtcattcgagctatcaggttggtgaaaatcttgaacaacgtgattcagagacatacttatgattaattgaattactatgttgctaagttctttttctgcaggtaaatatcctggaataaccactttccctttcctattcatccatatgcctattgaattgtgaaatatttgtttcttaatacaaaattctgctgtgttcaacacaaagagttataaaacgtgggtgggatttgaaaagccaggtcatattagagagattacacgagtcttggcttgtcgtgtgtatttgctactttaaggacatttagtttattgatgcaattggattttttaattatttttatgacttgctccaatctgtattctgtacagaattgtatatcaaagaaaaggccttgtaggttatttcaaaatgggttgagttctgaaaatgggaaacctaaagtattttgcagtgacttagtcttattatctgaaatgtaattgttaaaggctgatcttaatttgcttcctctactgatggcagagagctaagagagtatacctagcaacttaaatttaccttttccatgacctttcccaccacacacacacacacacacacacacacacacacacacacacgcaatcaagatctggactagatgaattgctgcatgctcagctggcccagtttaacccttttgggagaatttgtatttgtcaaggaatgctgagtaactatattgcaaaaaaaaaaaaaagaaaagaaaagaaaagaaatacctctgcctgttggtgaaaaactagaagaaagttaaaaatatccaaaccaggccaggtgcagtgcctcatgcctgtaatcccagcactttcggaggctgaggggggcagatcacttgaggtcaggagttcaagataagcctggccaacttgacgaaaccctgtctctactaaaaatacaaaaattagctgggtgtggtggcgggcacctgtaatcccagatacttgggaggctgaggcaggagactctcttgagcccgggagatggaggttgcagtgagctgaaatcatgccactgcactccagcctgggcaacagaatgagattctgcctccaaaaaataaaataaaataaaataaaatatccaaaccaatttagctattcacatgtttggtctaatcttgaatgttagcatgattgattacttacttctgtttttagttggtcatttggcatcatgttagacattgatttgccctatagctgagagtcactgggaaagcagaaatgagttctaaagattttcataaatgtttgtgggggcaaagaaaatcatggtgtgatgaaactccagaagatgtttaaacactatctgtagcagcagcctaaaaaaaaacaaaagttcagttacttctcaatggaaccctcaagtcacaaaccctatgggtggagagattataccttcctatctggcctggacagtccagattatgcctctagtctcatcataagtgttaataatgctcccatctttctcaaagtatcccagtttggacaatcaattatatggtcaccctatctctagtgaacctagaagtcttgggtgatgtataagcccagataacccagaatatgtagtgaaatgatgtctgaagccttcagttaaagggatagaggatttagaactgcactgtccaatatgataaccactggctacttgaggctactgaggctatttaaatttgaattaattaaaatgaaatacattttaaaatttagtggatcagtcgcaccattcatatttcaactgttcgatagccacaggtggccagtggctacttcattagacaaagaaacgaaagatttcccatgtcacagaaaattttattgaacattactggtctagaagtcaccttgaaatttttcacatgttgagtatatccataaaagaccctaaagtaaaggtgggacaattcagtccacgaattaatctgacttgcaacaagtatggaaaatcttatctagtgagagcagattaggcttcctaaaagtcatacttaacccagtttatgtcatttcccaagaccttctgaagctttctgcttttgctttacaacctataaaaaggattgtgagctgcaagaaagaaaatgaaataggtttattctgctagctaagcacttcagcaacagcttaagatttactttgttattcttcttgaaacttgactgatttttgtgaagtctttgcagaattcccttgcttttcagaattctttcttggttcttatttttaatggaactttactatttacatgtctatctttttgtggattcttgacattttctgcttgctgcattgtggtacctgagggggatgtttttctcctccatatcctgattctgcctagtggtttttcatcacttctaaattccatttcaaattaacagattgtgtcgcttgaacccaggaggcagatgctgcggtgagccaagattgtgccactgcacttcaccctgggcaacagaacaagactctgtctcaaaaataaaaataaaaataaagagaatacaattaaattaacagattctgtaaaaacctaatagatacactcaatagcttaataacctaattgaaaatattttactcatggtgtacttaatttctaaagatacataatttaaaaaccaactaatacaattagcagctctaaaaagaagtttgcaggtataagtcctaaatcttatgcagaagggttcttttcctaaggtgtttaattatgttcgtaagttcaacatcagttgccggagggtttttgccagaacatgcccacctcttgcagctcccctgaagcagtatgtatatgtatattacagattgcaggtgtgaaacatctattattcatctcaaaatagtaactttgggcatttttcttgttattttttaattgttagaatatttaatacgaatatttaaatatgccttttgtatttcagtaactcttgcaatagtagtttttcctagcagccaaattaaaatgtgtaacaaaaaatatgtattctactgcaaggatgacagtatggaaaataatattactaccttcacaaagagcaaagtaagagttcttattttcagttatcaatattttttaaacatctgccattttctagagatgactaaggacactctctgaatttgtctggattctattatccaaatgcactctgacactttttaaaaaataaataatgtcactgttcatggtacatagtaaagaattactattcttagactatttccaaaatatgtcttttactcagaagaaaacttagttttgtatatttcttccagaattatcatagatttttctcaaaatattatttcagggaaatgcaaaaatgtgctggaaatgtgttttcaaactcacctttaggagtgaagattgtacttatttttaacaaaagccccatattttagtgattcagttcaaacaatgttaagtttctttttatccactcatagaaattagttcctaaatggaaagataaaattagcaggaaagtaaacaaacaaatggatagactctagaggattctacacactcacatatacctatttcgtagtagatcacccatttttctatcactgtcttaaaaatatagcccataaattacctagatatgttccttcaaaatgtcaagtatctggctaattgggactatctgaaggtaacagactattacttttcatgctagtacttggctttgtagtcattacatatatatacatgaatcttgggcaaagttttacacaaaaattaatatatgctgtttaaatttaaaataacagggcaggcatggtggcttatacctgtaaacccagcagtttgggaggctgagttgggcagatcactttagctcaggaattcaagaccagcctgggcaacatggtgaaaccctgtctctaaagggaaaaaaaaaaaagaatgacactaaaataacaaatatttgaaagtcatatacaactgcatatttatggaagagccccagaataataacttttttaaatataacagaaattgtatttatgtactgaacaggcaggtaatttatcagatatgcacaccaatgcaacgtataagtactgtgtaaaggattcaccatttggggaaagagctttgttaaaacagtgcaatgcaaagcttacctgcttcttaccggtattgttttcaatgaattactacatctaggatcaaggctactcttttttttttttttcaatttttaaaactatttcaacagatataaaattatcctgtcaaattgctattaaaagtttctaagcactaatctcttcatggattggtacccaagagttggtgaagcagctctggtcctcagatcacacttttaaggccactcttaataagatcctcagtgacagttgttttcctgtccgtttgttttatacaaccatgttttatgtcagttgtcaagaactgaatcaaaatactgtgaaacctgttctttttgtgaatatcaacaaaaccactgatgcagattattcattattctgaagagaaatgaccaagacgctatcgattgtgccttgctcttaccgtctcttactatctccgtgcaataatggtcatgcctgctatgtttcactttatgaaaccttttctttcccaggccagactagccttttagagaatcaaatgaatacatgaataaggtccagggtgaaaactcaaagaagtctttagttgaagctgacaaacgactttacactggtaccattggctaattctatcccctcctcccaccctccctgaagctgctagggagaggtagtccaagaaacaggacagcctctgtacatccttgagcaactcatattccctcttcaagcctctgtttcctcactggcaaactggggatggtaatggtattgacctcatagggttgtagtaaggaatgaataaatgaataaacatttgcaaagcacttagaacggtatacacggtcagcactatgtaaatgctaatattattacccttgagttgtctggactccttatgccttccagcatgctgcctccactgcccgtcctctgctctgggtcagtcttttcctttctgagctccacccgcttccatgatgagtcacatgagaagagcactttgttctgtctttgaatcagggtgctcccatcttccaaaacatacacagcctcacctgcttgcatctccttcacctggaagcacttgccattttccccttgaagttaccttcccactacctggactgagaaattactcagagttggaagagcagttttttttttttgaaacagagtttcactcttgttgcccaggctggagtgcaacggcgcgatcttggctcactgcaacctccacctcccaggttcaagcgattctcctgcctccgcctcctgagtagctgggattacagacatgcacgaccatgactggctaattttgtatttttagtagagacaggttttctccatgttggtcaggctggtctcgaactctcgacctcaggtgatctgccccccccttggcttccctaagtgctgggattacagacatgagtcactgcgcctggtctagaagagcaattttttcaaccatgaagagcaatcatgagccaatgttccaagtaaatctcacctcttttctcctcagggtgagcttgctgccttcccaggcaccctctgaagaagcaacaggataatgaaagggagaagttagctcttccctctccctccctgacccttgtcgaagcctgactatagactctttaaaactcttcccagcgttcagtgcatgcatttgaaaaataggtcttgagcttcaactgtgcaccaggcacagagataaacgttaacaaaaaagatggatccctgcttagagttgtgaggaactaccagaaaagtagagtcaattacaatgcagagcagcatattactacagtgacaggacggtttgggccaacctatatcggcacttttggggaaggtggcatttgggaagactctaaaagaaagaaaagaagaaatctggtagatatgtaggaactagccaggttactaaggaggatatagaggctgggcagagagaactgcaattgcaaagaagcagaagtgaaggtggcattagaaagcacgggtgatggttgaaggtggaggacaaggatgaggagagtaaggctgaagagaagagcaggaaccataagaatgagcaggaatgtgggggattctaagtacagaaatgaatttatcagatcagtgcatgatatggtttggatctgtgtccttgcccaaatctcatgtcaaactgtaatccccaatgtcagaggaggagcctggtgggaggtgattggatcatgggggcggatttcccccttgctgttctcataatagcaagtgagttctcatgagattggtggtttaaaagtgtgtagcacctccctcccgcttctctctttcttcctgctgctccggccacataagaagcctgcttcccttttgccgtccgccatgattttaagttccctgatgcctccccagtcgtgcttcctgcacagcctgcagaaccatgagccaatgaaacctcttttatttataaatttttcagtctcgggtatttctttacagcagtgcaagaatggactaacgcagtgcttcatttgaaaacttggaaagatgactctgattgcaatgtaaggaatgtattgggaagagagaactattattacaatacctggatctgctggggcctgagctgggcagtcatgatggagaatagtcaaggatggatttcagataggatttggatatttactgattggagaggatggagggaaagaacaggaggaatcaaggatggcatatctggaggatggtgagacaggctggcttgaggggagatggtgcattattgtgagtgttgagttcaagcagtcacagtagggctcagcaggtaggtggatctctggatctgacacccaggagagcagtctggaatatggacaaatttggtagctgtcagcacagagataaatggtttgtggaagtctcaccccagggagtaaaaagagaagatggtcaacacagaagtctaaggctcacaaacaggagctgcaaaagtaagaatgctctgaaggagatagattcaaacagccagacagatggaaaaccaggagagcgtgacagaagagaagccagaggaagaaagtgtttcaagtaggaggcagatgtcaacgctgttaaatgctgctaagaggtcaaagaagataaagagtgagaaggtcctttgaaagtggcaacaaggaggtcatctgtgacttcggagaaaaattcagtagaaggaaaagggtttgaagccagatggtaaatagaacacttttttaaattaccagaatctctcactctaatatgaacatagatgaagtgtcaagaatttctttgtaactagcaaaggctcatcaactcttctaaaatagctcagatctgatcagtgaactgaagaaccactaatgacatttcagagttcctgaggtggatatgcaaatcaggcctcactgttaccctgggttgggtgataaagtttttcagttttcttgcccctgtgttattcctgttctgaaaggcatgtatgggaccattatcttgaccatccctaaaatgcaatctcagctgtgaatccttcttgcatctcacttcatatttcaggcaagaatactccgcaagtaaagaagaggcacgtgtttgccattgcgggttttgttaaatctacaagctgtttaatcatcaccagttcttaattttgctgatggcatctctgctattttagcagaggtgatgagtctttgtttgcaagtcactattaagacattcttgacagccaatctatgacatgttacagtaaaggacgctgctaaagaacattttatggatcatttagcacatatctttaaaatcagctaatatactccctggaatgttgtttttgcttgtttttgttttgaaggtaattagttgtggctacatttgctccgaggctgtgttaaagtagtgttttcactgaagatgcacttactttgtagcatgtgagatattaaaccttttctttggctataatttaaactgagttttctattatttgctaaaaatatagaatctcctattccatgttaaaaatattttaaagtagtcaacatgtatagtcaatttatttatttacttattcatttcacactttattatttggtttttttttttacactttaaaatttatgcaagattttacactcctaggaacacaaaatccccaaatttagtcgccatatcaatgcttacaaattcctggcaggaaagacttcttcggatctggaagttcttgcttgggttttactactcttatacccttaaaagaaaatccaacaaaaatctacaggaggggccaggtgcagtggctcatgcctataatttcaacactttgggaggctgagctgggaggatggcttgagcccaggagtttgaaaccagcctgggaaacatagcaagacccatctctacaaacattaaaaaaaaacaaaaactctgcaggagagcctactagatcctgcatataaaggacaataatggcaagcattaggagaacaagtctactctcagtggtggaaacagtgtggccacagaatgtctgaatgtcctaagtgagccaaatggaatatctgcttgcccctacagtgagaatatcagacagactgtacacacgtggagctaatttacatttctctatcaagagttaaaaccaagaaaatgagacagatcagtgcatccagggactcctggggttccttggtcttgtctagtaacccgatctaagatgaaagaagagtagaggaatcttagatatataattttataacttgctttgcagattataaaactgtcagagtttaaatactgtaaacacaaatacaaatctatattgttgaattatgtttatgtattaacaagaaaacaacattaaaaagtattctaaataactaacacatatgccttcaatagtgacccaaattatcaagctctgcagccctagttgtctgctggatttgtcccgtgatcaatttcgagtgagggctgcctcaggggaaattctgtgatcaaaaggctctgggtcacctgaaggatgagccttggggtccgtgcttttaagacagataaatgctgtatttctcatggagagtcagaaatcagaagatagaattttccaaactggaagagggagtatttcagtctgttttctgatgtttataacaatatctgaaactgagtaatttataaggatgaatttatttcttacagttatggaggctgggaggtccaaggtgggcaggtgtatctggtgagggccttcttgttggtggggactctctgtggcaccctgaggcagcacagggcatcacatagcaagcagagtgagcatgctaagtgctaacttaggtctctcttccacttcttataaaaccaccagttcctctctcatgataactcattaatccattaacccattaatccataatttattcatacagccagagtcctcatgatctaatcacctcttaaaagttccacccctcaatactgccacattaggcataaaatttcaacatgaatttcggagggggcattcaaaccataacagagggatgtggaatgcatgtcggtagtgtaaattaacccaaataaccaacataaagtgaggggttaagggggagaaacccacatccaccccacaaacataagatctgcaatcacaagggggccattcagcaaccttcagaaacttaataatatccccataaatgagggtgcagagtaggtaaagcactgtcatctcctccagaaatcatttctgatcacctctaccagtctgggttaaacacccctcttctgcattcccatatcaacctgggcttcccaccaccttgcacatcacaaagtgaattttaactgtctgcctacttgtctgtctgccctactagactgaaagtgcccaagcaataggatttgtttcttcattgctgtatccctggcatctagcacagaagctggcatataataggcactcaataaatgtttgatgaatgaatgaatgaatgaatgaatggacaaattctcgagtcccactcatcaggcatcactaggggaggcagccacatggagcttatctagagagctccaagctctggacaaatgaaactctcaaatcctatcagagctcacagtcgcagcaaccattgtcttgcaccatgcttgtagagaggaagagaccaaggaccaaatgatcattgtcatcacgtaggaggcttctttaactctgccagcgcccagcagttaacagttcagagcctaacacaatactcagcacaacgtcataggtactcaatgaatattcattgaaagaatgaatgaatcagtcactttagcacttcctttcccttccaaggtaatcctttgaaaaattaatggaacttcttaactacttcttgcatgaaacttcagacctcactcaaggacggggaagcatttcagttctgattagaggtctgacaccaaggcacactaatgccatgtcaatgggtctgacatgtgcgacttagaagattttgcaagctggcatgaatcatgatcacttctttgcatgagagcagggattgttccacccccaacacactccaccaccacatgccaccatcaccccaatcctgtctctactccagtggctctcaaccttggccacacattagcatcacctgaaaagttttataaaatctttggaccatgccctggaacaattaaaacagaatttctggaggtaggacccaggcattttttaaagctccctaggtgattccaaagagcagccaagcttgggaagtactgctgtcttgacagtcaatcaaactgcctcttcagttcacagttggctgagccctctccgcccttgcacatggtttggctgctggctgggtccgtccatctgtttggcggtggcagcagtcactgctgcttctgttttctcatcgttcttatctctgcatattcatatgcaatatttttaccctaatttagaggattggaataagacttttgtaagattttagaactcatggcagcacaacaaatgcacctacatttccttataagtgcacatgtgttcgtgtgtatatatagatgtcgtctacccagagtttcactttgctttagttatttcttcatgctcagaaaattgtatgagcagacttcagtttcaagaggaggtactagtttaggtttgtgatgaatcttttacaccctctagtggtactgctggggcatatcagttttgtgcaatgggtttattagactcctagtctcttcataaccaacagcatcaaaggagactaaccttagaggtcttttgctctttgctgctgtattaatcccagtgatgcaatctaccctcatgaagaaaagaagcagatgagtatgtaacttattcctcagccttttgctggtcctccaaagggctcgtcataggtacttaatgaatattcatgaaagaaaggatgaatcagtcacttcagcactccctttctcttctaaggtaatcctttgaaaaattagtagaacttcttaactacttcttgcatgaaactttagacctctctcaaagaaggagagacatagtaaaaacaggacattcacttagcaaaagtgtattgaacacttactatgtgccaggcacatgtgagtaaaaacaatcatatcatatcaaagtgtctttttcattgttgttattttgtgttaaagtatgaagatcttaatgttaagacaatagaggaaccttatgattaagagctcaaagctggagccaaactggttcacgtcctaattccacaattactggatgtttaacatcaggcaagttacttaacctctctgtgcctcagtttctttatctgcaaaacagggatggcaatagtacccttatcataggattatactataaagtgctatctaatattatcattttaatcattaaatgtatcttaaaggtcctaatttaactctagaatgatttgcccagaaattcctttctagtaggaaatacacaagtcatatcaaacttcttttgtaagcatgtaagaggccaccaaggtcttctgcttcttccccaggccagttcatgggctttcatttattcttggcttcagggcattttctcttagctcttcttatctaaaccaggggtcagcaaactatagccaggggatcaaaatctaacccaaggggcttgtttttataaataaagttttattgaaatgtagttacactcattcatttatttattgtcctatggctgctcgcatgctacagtggctgacttgagtagtttcagcaaagaccatacaacccacaaagcataagatatttactacctggccctttatagaagaagctttctggcccttgtctagactctgagtcgctctgggcttgctcccagctgtgtttagagagtaagacacagaaggtctgggctagcctatgtgagaactaagcatgaaaccaggtttcactcttctacctgccaacaaggactcccctactcctctggtctcccctccaccccctcatcctgtagttaaagcccttagtatatgaaatgcaagtcttagaaaaaaaattgaagaattgaaagaccttttgaattcgtagttgatacctactttgggacattttcctcaattttcagcacccacatattttttcctggtgtctagaattattgaactctgagcttccttgctccctgcaagtaacaagataatggcctactctctcctcttatcaaaggctaattgggtagctttttgctcatgatatacgttgggaatatattacatatatttgctggaaaatataccctgtaaagcaaaactaacagactccaatgagactgatgtatatatcctacaaatgaggtaaagtaagcagacagcccctaaaatttgtgataaaagggaaaacattacaattactggaggtaggtaacccatattagccatggactgattcccagaagggaccttatgagagaatgcaggtggccaggttgaaaggcagatgttttccaagtatgggatcccctctggaaagacaaggacagagatgaataaatgactaatgtggccttggattcatttgtgtgagaatgtcagagcatacaaggcagagtaggaggtcagatccatagacagcctaaacattctccttaatgtttacaaggttgcctgcctgggattcactctgtgttgcagcactgtgagtggaatggtaaaaatgtgagccttggcatctgcagtaaccttgttcttactagttctgtgaccttgaacaggtaactcaacctcctgagctttacttgacccaaatgtcaaaggtggaaaattcttagagttttaagttgacagaatgcaggtaaagtacttagcactgcaccagccatccagccaagcacaactcttggagacccactcaacattaagttgaagagagcaagatctatgtcttgttcacctttgtatccccgccatccagctctgtgtccagcagatggatagtgggtgcccaggttaagttcattgcatcatagagacagaggcagttccaggcattccaatgatgaccagagaaataagaaaatgctgcagggggcaaggaggacaatactaaatactcagagatgctttctcaaacttagcttggacacaaattttcctctctctaccttctattttgatcatgaaaatcgtgtactgtcctgaaagaagtgagaggggattgggtggaaagagggaggctgagataattgaataatgtaaacatgtcaagttatgtgaccccactgacctggcatcttcattcacagagtatgatggctaaaacaggagccccagagagcatccctcacacctggtcctgcttagagcaagacaggcacacgtgatttttggaagcactgatagcaatctcctaggaatgaaaaactgaggttgtattctttttagactctagccacatgttttccactgttttcttgatggtcttataatactgtaaatttcattcaaccaatataattccatcccaacaggctcttccctctcttttccctggacagttttgttttgctattaggtctttctttacttttgctgcttatcatgttgtagtattacatatttcttgacttccactgttcttgcctttctccttatttcctcaaaatgatatgttgttgcttgcaatgctgttgctttgtgtgatcctaattacgttagcaatctaaggaaaaagaaaattatgttttcatgattttcagtagcagttctatttaaatgacttttctgaaccccacatggtcctaactattgaatgagtgaacatttcttttactttagaaagtttttttattcatggaggaaactcagaggcttatgctctttctgaaatgtgcctgaagaacttcaatctattctaaggcattctttttagaagatctgtacaagagtctgccttgtcacagaacacaaacatctttgaactatggaatagcaaatcctcatttatttcttcagctagcatttaatgaaccccctaatacttgccagggattatgcagatgctgaagtaaagagcacagttcctggcatgaataaattccagtgggtgagacacactgccacagatttagctacctcacagtgcatttgaaagcacagagaaagaccatctaccccagtgagggtggttaggaaagatttcctagagcacttggtgcttgagctgaatctggaacaattagcattttaggtagagtgcaaagagacagaatcctgatgaatgagcactttggtgacaggaaaatccagatgggctggagagcaggcagcatgcagaggaatgactagagatgagtatttggagagagaaggggggaattctcaccattcactaccctcttccttctagagttgcccgaagtctccacagtagagcttctaaacaaataaacctcccatgttcattaaactctgggccaagttttgggatatgaagagtagaagacataatccctgcattcaaggttctcacacagtctggtggaggaagctagaatatgagtaaataattacagtgtggtgtgttaggtactaagctagaggttaacagagaagtgattaactgttttgttggaatcataaaaatttctatgaaagaagtgagctttttttgagacaaggtcccactctgttacccaggctggagtgcagtggcaagactgtcaaggctcactgtagcctcgacctcctgggcttaagtgatcctcccacctcagcctcccaagtagctgggagcataggcatgtgccatcatgcatggttaattttttattctttgtagagacaggggtctcactatgttgcccaggctggtctcaaactcctaggctcaagcaatcctccctcctcagccccccaaagtgctgtgattacatgtgtaagccaccacacctggccaaaagaagtgactttaaaacagagttttgaaaacacagcaggatttcaggaaaaagaaatagcaaatggaagtaattgaagtatataattgattggctagggtttttgtggacctacacatactttattgttgctggaacctaaagttccaaggacgaagtggaaggtgatgaggcaagagagatagaggccagtttataaacagccatataggatgtgcttctaggagtttgatgtttatcctataggccagggaaaaccagtgaaggactttaggagggaggtaatatgcccttacttgcattttgaaaggtttgttctttctaagcctatagcagtggagatgcaaatgaggggacagctttgagagctattaggacatgcctagtcttcttttaacgaaagtataatgacagggtcatcattctttatataaatcattgatttcaaaaatatctatgggccaagtgcagtggttcatgcctgtaatcccagccctttggaaggccaaggcagatggatcacttgagctcaggagtttgagaccagcctgggcaacatagggagaccccccctatctctgcaaaaaatataaaaattaaccggtgtgggggtatctccttgtaggcccagctacttgggaggctgagatgggaggattggcagatctgggaggtcaaggctgcaatgagccatgattgtgccactgcactccacctggcgtgacagagtgagaccttgtctcaaaaaaaaaaaagagaaaaagaaagacagtctatgcttttaaacattccctccacacttataaaccatagaacctgatttagaactttcatatctcactttgaatctctttaatgtttttgttttcaacccacaacacagccagttgagaaaatctatttgatctccatcttcaaaaacttaatccttaataagtaagattttttttagcatcagtaatgcactggtaaatgctgaacaaccagctcttcagaaggaaatcctgatttgtattgtttgccaatttctgtagtgtaaatactcctgtcatagctgttttcaaactaccaatgtgacatcactgagcaggaattgagaagacgagcaatattacattattagatagaatttccatggtacagacgcaatagatgtgaacaactcaagagcctagagagtaacatacagtaaaataattaggaaatggtgaggtttgagtacatattacctttatttttaatataatgtacttgattgtaagtctatgtaatttaatttttagtaacagctgtatttaataaccaccaaaattctttttttaaaatactttaagttctagggtacatgtgcacaatgtacagttttgttacataggtatacatgtgccgtgttggtgtgctgcacccattaactcgtcatttacattaggtatttctcctaatgctatccctccccctgctccctaccccatgacaggccctgggaagtgatgttccccgccctgtgcccaagtgttctcattgttcaattcccacctatgagtgagaatatgtggtgtttaataaccaccaaaattcttttttttttttttttgagacggagtcttgctctgtcgcccaggctggagtgcagtggcgtgaccttggctcactgcaagctctgcctcccgggttcatgccattctcctgcctcagcctcccaagtagctgggactacaggtgcccgtcaccacacccagctaattttttgtatttttagtagagatggggtttcaccgtgttagccaggatggtctcgatttcctgacctcgtgatccacccgcctcggcctcccaaagtgctaggattacaggcgtgagccaccacgcccggcctaataaccaccaaaattcttaaaagtagtcagtgcttgggagtcaatgcaaggttgctccaggcaccactgcacatactcctcttttctaaataattgaaatgatatttattaatccaattttcactatttaattctcatacataaagtaggaaaatctgtaagtaaagcactggaaaaaaggcaataccacctgaagagtggtatgatgtataaaaataaatgataaacctattaagagttttaaaatctactctgttttgcatacttatcattatgtgagtatattgaaataacataaaagataatcagtttcatttttagtattgatcacaattataaaccatggattttaattttaactttagctagctagctcataaatagcaaattatgtaagtaaaaatgaaattatttaaggtttgcataaactatgactgcgtgagtgctagagtgcaatattatctatcaaatgccttcaaaatgtactttctgttaaaacatctctgaaaggaagagagaaaagcaacaagcaacttttgatgaattatctgaaagagctcacataacatcccaccaagaaaaaatggcagatccccattagggcaaaaaaggcagttggaagtatgtaggttcacatctgggcagatgcgtcccaaaccacaaatgtgtgagctacagccagagagaacacactgacgtatgctgtagcttgcgcctcttctaccaccataggaaagaaagaactgccaaagatcccactcagacttctcaattctccagaattgatgccatgggaaaaccaggaggtaatgtggcagtggaaaccagacagatctgggtggaatcctgattttgcctaataccagttgcttgttttggggggcaagttacttaagttctttgaacctcagtttcccaaaatataaataggagaaaggaatatcttatcaagtgctattgaagacatacaaagtacttcacataacaagtggtagacagatgttatgaaaacacaaacaaccacacaacaacagcaaaaccaccttgggatatatgaagatgattttccttttttcctgcccacccagtcatcattagctactttgaagacagcaaagaagggttctaggctgttagattagctcttctggttttattcttaatatgactcaggttagagatcttctctttatctctttctttccttcctcctcttattcaacaaatattttttactgtgtcagaaactgtgcgaagctctaagcacacaatgtcatagtagaagtggtaacaacaatagctaacttttattaagcactgactgttgaacaaaagacatctaggccgggcgcggtggctcacgcctgtaatcccagcattttgggaggctgaggtgggcagatcacaaggtcagaagttcgagaccagcctggccaatatggtgaaaccccatctctactaaagatacaaaaaattagcaggtatggtggcacgtgcctgtaatcccagctactcgggaggctgaggcaggagaatcgcttgaacctgggaggcagaaattactacgagctgagatcatgccattgcactccagcctgggtgaaagggcgagactctgtctcaaaaaaaaaaaaaaaaaaaaaaagacatctatgtctgcctttacctaattgacagtctggtatatggaaacagatatttacataattgctcaggaccagaaatttcacatgtaacatattttgttatttttctcagtttttttgatacaggacactaagactctatgaaacctaaatgctggtaaaccaatttggaaccaaagctcaatactaagaggttaaattaaaacactaattttctttactttctgctgaataattttgcttaaatggttttggggggaaatacaaaacctatactgaataaagaagagattggtgaaaaatatgtggttagagaaagggagtaagaatattacagataaatgattcaggaataattaggatataattaattgaaagttaataatacaattgcaaggtagggtttaggctttttaacctataaaacaatttggattccttgaaatcagctgtcacctaagatagacaatggatgttttctttttcaactttacatttgttcctaatcttcccactttccaccaagtgacaacaaattttgtctcttagtgactgattcccagcctggaatctacaagtgtgataatggaagtctatgggccatttagtagctgaaaaacaccaacggatttaaatttacctgcaataaggctacacaaactaattcaaatgttatgtttctctgctttcatcagaaattgcatcaagttattgcaggaactagttatcttaggcagattagctattgatggcatcatggaatttgttgatgaaatatcattgtaaaagatggggcccatgttgcaggaggcattgttataagaggtccctggttctgaaaagcttaggctcccaagcttagttaagaaatgtgttatggcaggacccagtggctcatgcctgtagtcccagcacttagggaggctgaggcaggaggattgcttgagcccaagagttagagcctgggcaacacagtgagacctcatctcaaaaaaaaaaaaaaagtgtattatgtttaaaacaaaaagaacttggctagctaatccagcagtattctgcaggaataatttatgggaaaaaaaaaacacaaatttccatattaatgtacatttctctagagagaatagagtgttttgcaaacacatttgtatctcaaaaatgcatgtagttccataaaagaccattttaacagcctttatattttttaagggatgctattactagatgttgtatcttggacttctggagattgcatggaaaagttagaattgcattttgactttaacttacattcagggtttcaacggacattaaaaaggcaaaacacttagtgttcagcctcttttttagtgtgtttttctattcttaaggtgttgtctcacatgagatgttcttaaattgtccactgtaatctcaggcttttatattacacatctgcagaagccaaaaataatttgatgcatgacttttccccccagagtttcttattatatttactggtaaactattttggtaacttatattaacagagttataaagattaatatgtaatatgttctcatacagaattatgaaatttcatgttgcaaaacggaagtttaaggaaacattacgtccatatgatgtaaaagatgtcattgaacaatattctgctggtcatctggacatgttgtgtagaattaaaagccttcaaacacggtaagcaatggaaatgtcattccttgtaaaggaatgggcatagaacctatctaggaagaacttctctttagtagagtaaacctctgaactccatatttttcattcatttttagtgggcaaatggaatttgctttaaacattgattttattttgcttttaacatagatataactcaggcattcaaagcatccaactgtctcattttccttatctgtaaaaatgggaagaaagttagttcttgccttatagggttgtcatgaggattgaacaagttaatgcatgtaattcataacatgtaacaggcctggtactgtgtctaataaacatcaatggttgttgctgatgtttgaattattactgctgctgatcctaaattatctaaattccatttattatctaaattctaatcatcctttgggaataacgtactatttctccttcattaagtttcatccaaccatccaacctgtgaagacgggcctttctctgacctttatacagtagcagagtctactgcagagcacaagagcactcagaatctcggtgtgctgggccaaagttgagacttggcccttgtgttgtttcctggttgcaagtgtgttcaccttgctctggactaagactgaggtccttcattcatgtcctgtacggttctacaaatatactatcctcctagtagcatcttattgagtgattaaaagaaatgaattccacatgttaattccaaccacatatggttgattgtgattatctcaaagccaaaatattcagtaaattcagttttttaagagccttgctttattaccagcacaaattaccagcatttgtgattgtatagtgcccaaaatgcaaggactgagacttgaacttttttttatgccccccagcacacttagcccagtgtgaggcatataatgggcccttagtaaaatacctgttcatcaattgttatagaaataacaatttgttaattcatttagcaggtaattattgagcccatcatgtgtgccaggacctgtggacatccagagattgataaaataatgacccagaccttgtagagtttgcagtttagtaaattagatgtcatggcaggaagtgagtactgcctatgtttctcttcagacaaagtaaactggaaagttgtctatactcttgataattcaattctaaacacatacaaaaaaagaagaaagtgattctcatttaggctggtcaagttctcttggaaattgctttaattcattctgtaacatctgtaacatgaccagagattgtggtcatattgcaatctctgcctagatggccatggccttctaagttctttaataaaactgtctacagctcccaaggttttataaagttgaactgctacagaatttatagaaccaatcttgggtttctagctcatgtatcttctccaacttgaactccgaaagaaaaagaccatggctttcttatctgcttatctttcacacatgtacaatagatgctcatagaataatctgttctattaatgtaagatctctatagttatgatttttgtcatattttgaaatggttaaattcaggaactgcctgatcagaggtagaaacatattactttgtagtttaggacacttttacttccagaagatcacccataagtgatttcatcttggaccagaataatgagaaaattaatttcatgtgtaatctcatgttcaaataagcatatcaactggaacaagttctttcttatttcatcttacataaattgaagataactgtatttaatttttttttccaaaactcttcattctgacctagggcaatctccaccttcagccctcataatcagatctcctctttctctgatagtgttgatcaaattcttggaaaagggcaaatcacatcagataagaagagccgagagaaaataacagcagaacatgagaccacagacgatctcagtatgctcggtcgggtggtcaaggttgaaaaacaggtacaactcaactacgctgggtatctttttagccagaatttttttaatcaaaatttattataggcaattgtatgtattccagtgattattttaaaataaataaaatcacaaaaagagtgaataaaattaaattttctttgtgtgtagacagtgctctctgaaacactctggatttccctttaaggaatagaaaatctcatctcatcaattaatagttaattggaaacaactatagatttccaatagttgaaaatcgtttaaaaataacaaagatctattcttcatttgtgtttcagttgtttttattgtttcttttttaggtcattaatttttttttttttttttttgagacagagtctcactctattgcccaggctggagtgtagtggcatgctcccagctcactgcaacctccgcctcctgggttcaagtgattctcgtgcctcagcctcccaagtagatgggattacaggcatgcgccaccaagaccggcgaatttttgtatttttagtagagacaggtttcaccatgttggccaggcttgtctcaaactcctgacctcaagtgatccgcttgccttggcctcccaaagtgctgagattacaggcgtgagccatagcactctgcaggtcactccttttaaaagtaaaacaaggccgggtgtggtggctcatgcctgtagtcctaacacttttggaggccgaggcgggcagatcacaaggtcaggagttcaagaccaacctgaccaacatggtgaaaccctgtctctactaaaaataaaataaaataaaataaaataaaataaaataaaataaaatataaaataaataaaaataaaactttattataattctgatgacacattgaatgtttgttaacctcaagtctgttgcatcttcatatacaaagacaattttccagaaatcaaatggctcccccaatttaataaaaaatacttcatatattaattccggagcattttgtacctttatttttttatgtaactttaaattcagaatcacctagattgatgcttaaggtattggtttcattatagaataagttccttactagatttctgtagagtttcagaatgtcttcatagaggagacttaggaaagacaatctgacaggaatgggaagtctttttttttttttttttttcagacagggacttctctgtcacccaggctgaagtgcagtggcacaatcatggctcactgcagcctctacctcctgggctcagtcaatcctcccaactcagccttcctagcagctgggactatgggcatgcaccaccacacctggctgatttttgtattatttttggtagagacgaggtctcaccatgttgcccaggctggtctcaaactcctgggctcaattctcctgcctcagtttcccaaagtgctggcattacaggcatgagccactgcacccagcctggaatggaaagtcttaaagttgcatttttatagtgcttatatgacttttaagaggcactatttaaagaagtggtgggggagagatgctaataaagactgtatagaagccaaagtgtccctctcttcctaagtcctcctctggccccatcattgctaaatgttacattcactaagggtcaagactgcatcgtactttatattcaatatttctttaaatgtgttggcacaccttgacttcatttttcaaaattaaaaaatgaagtccattcttaataacagattatactcatgtgtaaccattttcctcacttctaggtacagtccatagaatccaagctggactgcctactagacatctatcaacaggtccttcggaaaggctctgcctcagccctcgctttggcttcattccagatcccaccttttgaatgtgaacagacatctgactatcaaagccctgtggatagcaaagatctttcgggttccgcacaaaacagtggctgcttatccagatcaactagtgccaacatctcgagaggcctgcagttcattctgacgccaaatgagttcagtgcccagactttctacgcgcttagccctactatgcacagtcaagcaacacaggtgccaattagtcaaagcgatggctcagcagtggcagccaccaacaccattgcaaaccaaataaatacggcacccaagccagcagccccaacaactttacagatcccacctcctctcccagccatcaagcatctgcccaggccagaaactctgcaccctaaccctgcaggcttacaggaaagcatttctgacgtcaccacctgccttgttgcctccaaggaaaatgttcaggttgcacagtcaaatctcaccaaggaccgttctatgaggaaaagctttgacatgggaggagaaactctgttgtctgtctgtcccatggtgccgaaggacttgggcaaatctttgtctgtgcaaaacctgatcaggtcgaccgaggaactgaatatacaactttcagggagtgagtcaagtggctccagaggcagccaagatttttaccccaaatggagggaatccaaattgtttataactgatgaagaggtgggtcccgaagagacagagacagacacttttgatgccgcaccgcagcctgccagggaagctgcctttgcatcagactctctaaggactggaaggtcacgatcatctcagagcatttgtaaggcaggagaaagtacagatgccctcagcttgcctcatgtcaaactgaaataagttcttcattttctttccaggcatagcagttctttagccatacatatcattgcatgaactatttcgaaagcccttctaaaaagttgaaattgcaagaatcgggaagaacatgaaaggcagtttataagcccgttaccttttaattgcatgaaaatgcatgtttagggatggctaaaattccaaggtgcatcgacattaacccactcatttagtaatgtaccttgagttaaaaagcctgagaaaccaaacacagctaatgctatggggtgtatgaatatgtcaagtttaggtcatttagaagatttgacactgtattttgaaattatgggagtaaacaccttcaaatttcaggcatttctgctttgtgactaaatacaaactacattttcaagattaggccataatgtatatttaaacacaatggctatcaacagctgctaataaggtatcaactaaagcagaattggggaataatagaaatggctgcttatttcaagatatatttgccaacccattcctattcagtcattttattattaatgtaatttgaatgtcaatttgtgtgcttttggtgatttagcgctgtggcaagcaattttgcacatcattttcatgttgttctttatgacaagaatgttcttcaattagaaaatgtgcaaataatgaaattcagggccagtgaggcaaatagactatctgacatatttgactttatgaaaacatattgcctgatggcagaatcaactttataagtggtcaacttctacacaagcgtatgaaatactggtcagtagaacagccattgtgattggactggtttctctgcaatggcgccaaccccaggcttgccaatactgcctatgtaaagggcaagtgtgagaagctattctcatttcgctgacatacaggtaggactatgggggatgggacatttgagtgggactgagataggaaaggcttgaaaagaacccagaaacaccaccaggaagttggcaaagtaaaagaaaatgacttccccctcaaagggcaatgagagggagagaaacaaaccaaaatagaagaactagactttttagaaaatgagtattgctagggaattcaactacctaatcttcccttattcttatatataagcagagaatttttgcaaggtatttattttttaatatgccctgaatgtcttttgctattatgtgtacattttgcatatgaaagtctaaaacgaaacttcctttactttttatactgtagtgaaaattttctattcttcccaagaatgttgtcccaaatctgaaattactggttcaatttcctgatataaacatttacaattagaagctagatagtactggcagagtctgcaaatcagaacacttaaatatatcatggcagcaaaaagaccaagggaaacaaaatgacaaatgtatttatcagaaagcaagcaatgctgactgcttgttagaaacccatctagctatcttaggtcaccagaacttcagccaacgtaatgacattcaaaaaaaaaggacataagagatagcatttcaattcaattaaaccctagccacaggaggactcaagaaaggaagttgtttccttggcagacataaatgctgcctccagaagtacttctccagcagccaagcagaatgagcagggttatcaagtggatgttcaaaggaagaaggaggccctgaactccaccaatcctccccagccctccccaacaggctttctccatcattgactctcccctgcttttcttcttcattaactccttattcattccctgccagtattttgcttctgaacttcaccaggccttaaccagcctccatccccaggtcaaccagttctccgctttacctaaaatgtgcttctcaaccttttagaaccttgtcccttttgataaacatggaaatttttaaagcttcctcttcgcatcccacttggattctaagacaattagaatcatttagaatctttttggctgctggaaatgtatagaagatagaggctaaattttacacttcagttaagacattgtcaatccttttaagcaattgttttcattttcaaaatacagaatgttagtaaattatgaaaatcaatttttcatcttcattcaacctgaagttgtgattcccccttgcaagaatgttgcatacacacacacacacacacacacacacacacacacacacacacacacacacacacacacacacccctccactgacctaaagccagacacctgccgtgactgggcaggctctctcccattattaacagaggaagaggagggaggcagcaactttcaggtagcactgattcttggacatactctgtcctgggtcaaaccccactggcagcaggaattctgaatgtattggggacccctccttaggcctcgttaagtctcaaacacagtacagctcacccagcattgctgacgactgaagattcagaaacaaaacctacacacagcactgaggtcttaatcatagcaaaatgtgataaaccatgttgtgaaaaacttttatacattgaagccatgaccattttgtgtctatcttactctagcacaaaaattgggggatgttaaaagatagttgtgtggaagctataaggttctgtctgtcgtgttactctctgtggaaatgagaggggtctcccatttacactaagcaaatttccattggtcaattttaatgatgtcttgaagcacaatttagctgagcactgagtagccatatgctttctgagtacaagtgtgtctgccttcttcaacatgtagggttgatcaagctaatacttaattgcaaatatcccttgtatgaggttaactaaaaaaattttgctatgtctgatctacatgtttgcattttgttcaactaaattaatatttgtagattgcaagttttgtttaaaataactttattgagtttttaagtcctgatctgttctaaggtgcctttctcacctcccattgattcagtgattctgaagttcttaatttgcaagtaaaataagtctactagagaggaggaaatcaggcacaaattgaccaattctcatgccatttgcaaagcaaaactgtaaggatgatgaaacctggctaactaaattaatggatcatttcactaaatcagatagaggaaatatcataaatattaacttgtctccctagaagctgagatttttcgccttaaatgacatggttgtgtttttgtaagagaaacttaatctaatctaataatgtgcatttaagtaagcagttctaagtcatgtatgacaatgcaattgtctgtttcctgaaaacaaataaatcgggaacaccatatccatttcaagctatcattaaagtgtaatttcctttgctctcttttactgggattatttgttttaaagtaaaacattaaaaagatgtctataaacagctagtgtgactatttttatctggaactaactagttggttctgaactgactggaccaagtcaaccaaactgactgtatacagattttggactgaaatataaaaattatctttttgcagtgttacggaagaagtctttggtattttgggaaggggggagatttgcatatgctcctggggtttttgtgagaactattaatttgaaattgattgtaactcagataccacgcatgtgagttttgtgttatctataataaagggatttgctaaacaatgttaagaaatgggggccaggtgggtgcccaaatgttgcagcctctggctactcagaactaccattttaagcacctacccagctctgcctcaccagggaagggcttctgctccaaaaggacctttttttcttcttccctaaaaaaaatcccattttttctatttcactagcaattttgcactaagtgccaagggttaatcccagtggaattattttcaaagagatacagaatgttaaaactctggaatacaaagcaacaaagcccgatagagatgttttagacaggaggaagaattacagagtgttatcctagagggaagaaagggcttcccactactgctctaaagagatcaaatagttatgtgcctgttctatcaacttctagatgagggaaaagaaaattgtgtatggtatatgcttgcttgaccaacttaaaaatgttaaaccgcttccaaacatttttggaaatactttagcagtacttcccactccttccatttaaagcaaaatatacttacaacagttattctatcctaaccattcatgaaaatgggctgccagatcttcaagtgacaacttctatcagtctagattcaactgctttgagaatctggtacaagtaaaaattgtttctttgaaaaacttaaattttatctcacacagctctgagatttgaaaacaaaatagaaatctaaaaatgtttttaaaataaaaataggctgagcacagtggctcacgcctgtaatcccagccctttgggaggccgaggtagttggatcccctgaggtcaggaattcaagactagcctgaccaatatggtgaaaccccacctctactaaaagtacaaaaatcagccaggcgtggtggtgtgcgcctatagtcccagctactcaggaggctaagacaggagaattgcttgaacccgagaggcagaggttgcagtgagccaagattgcagagatcacaccactgcactccagcctgggcaacagagtgagactccatctcaataaataaataaactaattaattaaataaaacaaattttcattaactgcgacaagacttctccctctagcccacctaattccaaattactgaagtttttgctacatttcaaaacagaaacgtagcagatacattatgcacaaactatcgatttaggcactgctctggaaatcacagcaccacaaaaactggtgaatggcaaaactttcctgttcaaataaataggaaggtcaaaggtacattgatatgatatattactctttgcctagtcatatgatttacttcttttctgtcacaatgttggcgactattttaagtccagtatgctctaggatagatatcagggttctagggtttccatacactgtcataacacctgcacctacttttagaacttttcacttgtatgcttttttaggtttttttggttttgtttgtttgtttgttttgtttgattgtttttggacacagtctctctctctgtcacccaggctggagtgcagtggtgcaatctcagttcactgcaacctctacctcccaggttcaagcaattctcgtgcctcagcttcctgagtagctgggattacaggtgtacaccaccatgcccggctaattttttgtgttttagtagagacgaggtttcaccatgttgcccaggctggtgtcaaactcctgagctcagaggatccactcgccttggtctctaaaagtgctaagatttacaggcatgagccaccgtgcacagcagctttttttatctttggtgacactcatctctttccattacttgctgcttcttccttctctgttcctttgcctgcattgctgtgactcacttcctgtatcaccaatccctatccattcctgtgccccccaagtaactaggtactcacaccctccccttgctgcagctcagggtgccactcaccctcacttaagccatgaggacatcacaccatgcacacccccaacacatagatgcttttcagaagtgctggcactggcgctcctcatctgagccctctggccaatgctgcaatgcccagttctacccccgctaccagaaatccctctgcttgcttggtgggagaggaggcaaaccccactccaggatgggagctccttgctctctttttttttttttttttttttttttttttgagacaggctggggtactgtggcacgatctcggctcactgcaacctcaacctctcgggttcaagaaattttcctgcctcagcctccctagtagctgggataacaggtgtgtgctaccacgcctggctaattttggggttttattttttgttgttgttgttgttgttttatttttctgagatggagttttggtcttgttgcccaggctggagtacaatggtgcaatctcagctcactgcaacctccacctcctgggttcaagcaattctcctgcctcagcctccggagtagctgggattacaggcatgcaacaccatgcccacctaatttttgcatttttagtaaagacggggtttcaccatgttagccaggctgggtcttgaactcctgacctcaggtcatccaccctcccccgcctcccaaagtgttgggattacaggcgttagccaccacgcctggcctaatttttgtatttttaatagagatggggttttaccatgttggtcaggctggtcttgaactcctgacctcaggtgatccgtccacctcagcctcccaaagtgctgggattacaggcatgagccaccacgcctggccactccttgcctttagggtaaactaactcttccactctgggttcccaagcccttggttgtcacctgctgcccctccccttccccatatctacagcatctcaccctttcccctcataagtatgcttaagcctctcccatgttaccaacaactttccagtaccctctcttcctctttttttttttttttttttttttttttgagacggagcctggctctgccgcccaggctggagtgcagtggcgcgatctcggctcactgcaagctccgcctcccgggttcacgccattctcctgcctcagcctccccagtagctgggactacaggcgcccgccaccacgcccggctaattttttatatttttagtagagacggggtttcactgtcttagctaggatggtctcgatctcctgacctcctgatccgcccgcctcggcctcccaaagtgctgggattacaggcgtgagccaccgcgcccggccgtcccttcctcttttttactctatacaccaccttgactttagaaacaaactgcatcttataaaataaattatataaagtacttccatttccacagcatccaccccactaaccagcacatgacagtcagactcacgaccacccagcagcacagaaaagctgcactagaagttcatctgtgacctcttagaagctaattcggccgggcacggtggctcacgcctgtaatcccagcactttgggaggcggaggcgggtggatcacgaggtcagaagatcgagaccatcctggctaacacggtgaaaccccgtctctactaaaaatacaaaaaattagccgggcgaggtggcggacgtctgtagtcccagctaggcgggaggctgaggcaggagaatggcttgaaccccgcggggcgaagcctgcagtgagccgagattgcgccactgcactccagcctgggcgacagcgagactccgtctcaaaaaagaaaaaaaaaaaaaaaaagctaattcaagggacaccttcaaccagcatcccttttggcttttctttaatagtggacactgcaatcactctttctttctcttaaaatttctcatcttttagaacgccacccctttccagtttgtaagttatggagaaaaaaaccaaagtattttttctaaactttcactcaacaatcgacacagaagacttctgtgacctctggtcaccaaggcgttgtatggggatttctctccgctgtcaaaagacaaaattacaacacaatttagtttgaagatcttaattggtttttgtttgcaattttaaaattgtgcaacacctccttctatacaattgaatgaatgttacagtgagtcaagcagaggaggctggttttataaactgacaagagctgagaaggtcagaaacagtaaacaaaatgcagattggtttcagttaatttcctcataaaagttaaagcaaagggaacttccttaacatgttggctaaaactggcctgtttggaaatttagttattgtctctatctctcttgatttcttgaaaggtcaaacaacttagttttggcttggtgatgtgtaagtttagcataagtgattcaactgtggtttggtctgttgggcctggcagtagtagttcaatccacatcaatgggctcctataaatttcctttaacaccaccaacagccaaacaatcagttctgcagtggacacagctgagtgtcttctaattaaattcaattctgggctgggcttggtggctaacacctgtaatcccagcactttgggaggtggaggtgggcagatcccttgagctcaggcattcgagaccagcctggacaacatggtaaaaccccgtctctactaaaaatacaaaaattagccaggcatggtggcgggcacctgtagtcccagcttctcaggaggctgaggcaggagaatcacctcagcccaggaggcggaggttgcagtgagctgagatcatgccactgcactccagcctgggctacagagctgggccctgtcccaaaaaagaaaaaaaaaaatcaattctgaattatctacctggaggtagcattagatcccacatgttgatgactcagtcccacaagactgccctccacttcggatgccaatcacaagccccaggttgttttacctgggcttctgaccaactagggataaatcgagattcctacaacccattcctaggatcggactcatttgctagagcagctcacagaactcagggaaacacatttactggtttattataaagaatatttcaaaggatatggatgaagacatgcatagggcaagtttatcagggaaggagtgcagagcttctacctccttcccaggcatgccaccctccaggaacctccgggtgttaaggtatacaggatctccacaaacccagtccttttatggttttatggaagcttcattacatagacgcgatggattaaatcattagccattggtgattagctcaactttcagcccctctacccttcccagagttagaggtggggctgaaaagttccaaccctctattcacatcttgaccttccctgtgaccagtccctgtcctgaagctacccaggggctcccagccaccagtcgtctcattagcatactaaagacactcatcaatttgcagattccaaaggttttaggagctgtatgtcaggaaacaggactaagaccaaatactgtacatattttacactgccacagtcctacctctctgacttggtcatctttatagacttctccaagctcctattgtttctcatttctttttctttttttttaatttgctttttatttttgccaggcccctccatcacacagaaacatttcattttttaatctatttgctgagtgaaggagaacaatcaattcagccacttgagctgatttaactttttttttttttttttttttgagacagagtctcgctctgtcacctaggctggagtgcagtggcatgatctcagctcactgcaacctccgcctcccaggttcaagcgattcttctgcctcagcctcccgagtagctaggattacaggcatgtgccaccacgcccagctaatttttgtatttttagtagagacggggtttcaccatgttggccaggctagtctcgaacttctgacctcatgatctgccagccttggctttccaaagtgctaggattacaggtatgagcctcagcgcctggcctgttttgcatttctttttttttttttttttttaattgatcattcttaggtgtttctcgcagagggggatttggcagggtcataggacaatagtagagggaaggtcagcagataaacaagtgaacaaaggtctctggttttcctaggcagaggaccctgcggccttccgcagtgtttgtgtacctgggtacttgagattagggagtggtgatgactcttaaccagcatgctgccttcaagcatctgtttaacaaagcacatcttgcaccgcccttaatccatttaaccctgagtggacacagcacatgtttcagagagcaccgggttgggggtaaggtcatagatcaacagcatcccaaggcagaagaatttttcttagtacagaacaaaatggagtctcctatgtctacttctttctacacagacacagcaacaatctgatttctctgtcttttccccacatttgccccttttctattcgacaaaaccgccatcgtcatcatggcccgttctcaatgagctgtttgttgggtacacctctcagacggggtggcggccgggcagaggggctcctcacttcccagaaggggcggccgggcagagacgctcctcacctcccagacagggtcgcggccgggcagaggcgctcctcacatcccagacggggcggcggggcagaggtgctccccacatctcagacgatgggcggccgggcagagacgctcctcacttcctagacgggatggcggcagggaagagg

SEQ ID NO: 1272 - DNA, 596089 bp, Homo sapiens
cctccagagaggggctgctacctcccagcaggcatgggaagagcactggtgtgggggttccaccgagaaggggacctcatctagaaaagaggttacaaacctaccattaaactatttttcctaaaacggaagcagttgtgatgtcctgtgtcctttcaggtgggggaaggcatgggacagggtgtggcagtgggcaggcttgttagaccagagcagggcatggtcactcaggaaataatgacttattgagtccagtgttgggtgcccggtcatgcattatcaccctggcatagcaggagagtgagtggtgctcacagcacccgtctgcaggcacccagcctggcacccggcaccctgggttactgcccagaggagggaggggctggaggatgccagacgagagtgccagagtcctctcccaccttccttcctctcttccccaccattcttcagttacccaaatctcatgcttgggaggtatgtgttttaaggacaggggtggggtcagacaaagaaagccaagtttcccttctcagattaagtgggaaccagaaaatggagtttatggaaggtcttgccagcggcccaggctgccaggatgggatgggcaggcctggagggcagtgtggaagggatttggcaaggcctaacagccagttgctgggccaggggatgaaacggcttctttcctaggtctttagcatcctaacaatcctgccgtttgcctgtctctcccgccttcgttctccatcttcccagatcctgcttagctgccaactgggcttcctgccaccccacagctgttcctttacatctggagccaggagggagagttggaactccccacttggggaatggaactggcagctgtattcctggctttctcggaaagagttgcggccttgaggttttgagacaagccaggctgggacaggacagataaagaggggcagcagtttgggaggaacagaggaagatgacatggttctccacagagcgttggaatggccttgtggacacccacttcatcccccagaatggccccaaggaccctcccagggaacagaagggctgctctctcagcagcctggctgctttgccaggggagaggggggttctgagagcgagtagagccccagcatctgcagccccaagcccactcccctccacacgggcaaactttgtcttgaaggctgtgtcctggggagcgagcttgcagacagcaggggttgtgagcgtgtggggatctcaactctgctcaccccgatgcgtccccagctgccgctcatgtggagatgcaagggagtgtccgttttcccatccggggccattgagaatggctgtctgcatacatgatccagctggcctggactgaggccactgcctgttactgaacgtgcctaaactcaagctagaatccggcacacaggggtgggtcagacccgtctaaactccacacacgcacacatgtagatatgggagcattttacattcttggtgggttgtttgtgattctgtgtgcggacagtccttcctgctcacatactgagaagactgtgaatgcggggtgtgtgtatacccaaatagaccattgtttgcttgggggggtggggatagctttctccagggtgcccaacatcctacgcagattgaggcaatactggccaagggtcggagctgagaatggggctttgatgtggggctgttggatggggttctttggttttctgggaaagggactttcagtcttcaattagcccaaccaacgggaatgaactgcctgccagcctgcctgggactgattaaaccataccctggaaatgaggaggggaaagagcacagtagggcacgtgcttgagggcaagtcaggagatctgggttctccaccagcctctgtcgcctttttctgtaagaacgtgggccagtcatttctctgcaacaaaagggtgggtccagctaaggagaaccgcttgtctcagaattacctagggagacttgggaatagagattcctgggtctcacccaggctgctggggacagcaggatcatcgcacgggcctcttgactctacggcctgcgtgtaaagcctgcgctaagccccagtgtccttcagcggcgtcaattaggcgcacgcgcagtttcctctccggaggggcgggcagggcaggggagggaggagctactgatgtagctcgccccgccctggcgtcagggccgtgcaagcgttgtccgcatgggcgccgcgccgaccctcgcggccgtgggaacccgcccggaatctcgcagggcctgtcgcgcttcgtccaggttgacggcctcctccccgcgcttttcgggatgctggccccggcgccccgcctcaggcgaggccggcccctccctggcaagcggctcaaggcttggcgacggctcaggggaggctgggcggactagggggccgcgcccctccgaactctcgctgggcctcggtcatgccacctgctttgggttcatcgcagaggctggggtgaaactgccttaggttgcgagggagtggaagagctctgtcccatcgaatttagatcctggaagtccacagaggggaaactgaggcccggaggagagaagggactccccgcttcgtcaccttgctgggcaggataagagtcaaggtctctagtgcgggaacacttataaatgttactctgtgttcacatcacatggtgtgccttaattttggatgccaaggattttatttacattttccaaggacacaaatgcattccgttgctttcctccagaggctgcctagcctacgaggagtttgagcttggaacaggtttttgtgggagacagtaaggtgcgatgcacaccaaatagggacagttggaccgtgagttcaactccctgctctgtcgtttagccgagtaaacctctgcttctccatctgcaaagcagtgatcatgcatgtctctctcacaatgaggttttaaagacctaatgggaaaatgatcataaaaacattttgtagagtgtaaagtatgatatcaatattaattggaaagctgccttgcatcgtggaaaatgccagagggtatgaaacaggttaggtacatttgtagggccaaatacttggccaggtagtgagtaacatggctggttacagaaaagtctttgtcttcaaatcacccacaaggtaggtaggggaaggtaagacatcagtgaaatgactgcaacacaggctttgcataatcaaacgatgaatagtgtttaaactgctttatattggtggttttctttttctttctttcttttttttttttttttgagacagagtttcactcttgtcacccaggcaagagtacaatggcaggatctcagttcactgcaacctccgacccccgggttcaatggattctcctgcctcagcctcccgagtagctgggattacaggcgcctgccaccacgcccagctaatttttgtatttttagtagagatggggtttcatcatgttgaccaggctggtctcaaactcctgacctcaggtgatccacctgcctcggcctcccaaagtgttgggattacgggcgtgagccaccgcgctcggctattagcggttttcaagttgaagtcggacacctttagggattcttggggaaagagatttcttgggagacattatccatttcaatggtacctagcatgccacagtagattcctaaacaaaggttgagaagtataacctgagtttgtcagctctattctaatctctccaacctttttgaagtcttcattatagcttcggaaaactgttagtttccaacattcccataattctgtactagatgtggttccaagaaatcagacctttctgacttaaaagtttaaggaggggtatgcgcgtggtgtgcgtgtgggtgtgtgtctgtctgtagttatagctggttttcctgtccagttcaatctcattgagtttatctctcttgttagagatttttgggatcctgtgcccaataaataagaagagatgaaccttgagtctcattagatgacagatttttgagaagctcaaatgtatgggaaggctccacttcttcacttaaagggactgcagatggtgtgaagcaggtgggagagaccccagtgctaagagggttattacaacagggcttggcaagaatttttcagggaaaaatgaactttgggaggcgggtgctgttttttgccccattttgggttcccagggaaaggtaacaatttaaacacacaccacctgaacagagacatagcttcctctcaagagccttggaaggctgggagagtggtgttgggtggagagaatgagagcaggctcagatgttgaaacaaccctaggggattggagttggaattgctgaactgagctagtccagagccatctatcattctgagtcttcccaaaacactatttacacagatcaccaactttcacacttaaggagtgtctccccgtttctcttcttactaagcatggagctggtggagtctggttggagatagccttcaggtctgtgctctttttctcagtgaatttatgttgcactgatggagcccttgcatggcaggagagctagataaacttttaatttctgttaaaagtcaaataggaagctcttatctgaaaattctgcttaaatccttgtctgcatcactttatctctacttgccttcttcttttagtatttctctgaagtgcaatgcccattaatgtcacaaatgtacttcctagtccttgggcagcagagcctggccctttattttccttgcaaaggaggtgaaagtggtaacttgaacttagtccacctggactttgtctcatagaaagtgatcttcaggccggggccagtggctcacacctgtaatcccagcactttgggaggccaaggcgagtggatcacctgaggtcaggagttcgagaccagcctggccagcatggtgaaacccccatctctactaaaaatacaaaaaaattaactggccatggtggtgggcacctgtaatcccagctactcgggaggctgaggcaggagaatcgtttgaacccgggaagtggaggttgcagtgagacgagatcgtgccattgcactccagcctgggcaatagggcgagagtctgtctcaaaaaaaaaaaaaaaaaaaaaaaaaaagaaagtgatcttcagagggatgaatcccttcctatattcagcttctatccagaatagtactttttctcttgcataactgggtatagatttcagataagctccatttagttaaactccagttatttccaggaacatctggactccctgagacctcactagccttctttttgagcattaatagtttagattcaccataaagaagacagttacaaagaaccattttttgaatgttttcagcattccaagatattgccaagggccgtaaggttaaggaacagcggaaagaaatgctatttcttgtctggtattctccaatcagggaactcaaggaagctctctactcaggggatgaggctgtctcagccccgtgggtgggctaagtggactgtttccgagaaaagcactgggaacatggagtggcaggcagatattggcagaggcataaatataaccagggatgtagatgacaatttgatgacgtatcttgtgaatggtgtatattcacagaaggccttttaaagatggaggctgtgggagtaggaagacttatagggcttgtagtaatgaaagctttcagtgtatgtcaaagaacttgctgttagcgaggacgggaggagggccaaggaagaatggcggttagagagggaaagaattaatggttttgcggcaaacatggacttggccaggaaaacaattccttatttctagaaagaagaggagcttttaaattttttaaaatttttctcagtttatgacctggttaggaacactgaaacataaggagttggggaaaggatggttggaggctcactggaaatgagaggcggctatcagtgaatgagctctttatcagtgactcccagagactgctgctaattttgatttgaaagctgcaaattgctggtatgtggttacagttcctaagaacaacttagataagagattttcaaaagccgttttgaaaggggaagtgaaatttaagatttagttgtcattggtctacatctaagtgtttgtttctttagatgtgcacaccaaggagcatttaaaataaaaatctatttgcaaattaagatagtctttatttacatttttatatttttatttcaataaaaagtgtgttttatagagaaagctcccagagaagaaactaatctcaagactcccttttgtctttttttttttttttttctggtgccaggacaaaccgcacacataatacctgggaagaactaatcaaacgtgtgtgtgtgtgtgtgtgtgtgtgtgtgtgtgtatgtaccttgtgccttcggttctgattccataatagcaaatgacccaagcagcacatactcctctccaaccaggaagtgagaaatggaattttggttgactcctttctcttgttctaagaaatctcccaaggactgcaccatgtttgttttcatttccctggctcctttccattctggaaacttaaaatcggcttcatggcctcttgctttatagaatttgttcaaaaaggcttcgtcagaaatggatttgatgtgacatttttgctcttcacgtgaaagtacttcctattccctgaaagtggaagaggtggtggaaataaccctggccttggccgactgatcttgaacctgagaattagagactgggcctccgtccagtgactctgagccagtaatgaagtttaaagctatcggaagactggctgccgtccttggtagaggtgggggtgatttgatacacagaagagctttgtttcccagggctttgtggtctttccgggtcatttggggacttagggtggaggacgccagtcttgccttcctaatggagctgtgcttgtcctcgcccggcctgccccagagcgcatgctagcacagtcttgccttcctaatggagctgtgcttgtcctcgcccggcctgccccagagcgcatgctagcagatggcctttaccatcagccacttccagcgacattctaggatgaatgtgtgtataaagctcatgtttgtcactcgttagcgcttgacgctgggcaagttttctggcttctttaagcctcaacccacatctgtaaaatggtgatacttcgtagaattgtgagcattaaataagattacaaatgtagagcactcattttatttaatgtgaaatcacctatgggggaattcggggcttcccactgcctttgtttttcagcacctcccttcaccagcttttctgcacccccactcatttgtgagaaatagatagtgctggagacagctgagggatgtactcagctcagttcaggcttctcaatgccccagagtcctccagatccccctcattttttccctccatgctcttgtctctcacaaagatcatccttgtgacctcctatcccttgggctattctttgctgcattgggcattggacagtgctaagagggttgggcaccgtgcagcctagtgtttgcagctgccccggtgcgctctgctcagtccatattcttaccctgggtgtgccgagggacaggacaaagggcttattttatagaacatatttcttccccattcttctcgtttataattttggtttccaggaaagaatggaagaatgggcacctccaccctattagtgcacactctgtgtgtgtgtgtgtgtgtgtgtgtgtgtgtgtgtgtgtgtagcaggagcaaggggcagggtcagctgtgctgaggactaggaggtaaatggtctacgcatatccaaggtgggaagaccaagagaaataagagaagtaaatgaacagatcctctaaagtcatcttttccttattccagcacaccaaggcattgtgcatatggtcttggatccttattctctgttagccaatggaaaacatatatggaaagaaagcaagcaagcttgctgagattaacctagagagggcaggggccagcatcctgatgtctatgctaggccagcatggtaccagcagcagaatgtgggctgtggacatacacttaacatttctgatcagtttttactccctcaggcttaggggctacaaaggaagatagccaggtttctgggaaatttcgaagcacttggaaatatgatcgaagcagaaaattcctctgagtggaggagctgtgtaggctgtgtatagaatctgtggattgggaccatccaaggaatcagtgtctggaaagaagcacaaactggtgtgatgaaggttcccatgatgggtaagaactaccagggaaggttggagaagaaaggtttaaaactgacaaggaacctccaagccaccttagggacaatttgggttctttaaagttccatttgaatcccactccctcaacgagcactctaacttgcccctgtttatccaccccatctgccatgaccacatcaaacttacccacaagcgaggcccttcttagaacactatttgagttgtatattaaaatgttagggtgcctggtggtctagactctttccagcgggtcttgttctctgaacctctagaggagggaactttgccttcagaatattgctgagaggaagggtccagaatggcctggccagtatctagtgtgaccactctgcctctgagctatatttggctgagtcaggtggctggtgagtcccacacgtcctctggattgaatccacccacaggggagaggagtcagcctgtaggtttaattgccaccacaatcagagctatcaactgcctttattgtctaggaagattgaatcaaaggagggcagagaaccttgggttcccaacgcattctatgagctcttgggttcttcctgtggctttgtaggaacaaaagaacagaacaaacatgttggagtagtgtccctaacatttatttcaggtggtgactaggagggttgaggtgtagatatacttcctctcttctcgtggagccttactgaagacaggatcgccgttcttgtgtttatcagctgagaagggcagtctcgccatcttaaagacctgccctccagccccttcaaacgccacacttcccaggaagcactctctccataagtgttcagagaaccctgaccagagaagctcccgcacttcttatatgaactccgattgtgctgagggggaggggaggagtacacaaagcaggaggtgggtggggaggctggggtcacacagcccaggaggggcacacccggcgaggtgctccgtcagcacaggctccctcctccctccctccccccagtacaccaggctctgaccggaccggtcccaccgcagagttcagcggcatcaagtccaaggacagaactgcaagagtatggacacaaaacaccaaacaaattgggggtgggctcccggccagcctggtgagagagaggctcctttagccaaggccatttctggcttgtcagcctccagggtatgggctatgagcagcagtggggagccggggtttctggggcagctcagtgctgggaagacgtcatccccttctccccagggctgtatgggagcacaggcacaggggtaggtagagcttctggtcagcgaggggtagagcccacagagagaccagagagtggaccgcagtttcatgaaagcagagttatagctgccacttgtgcctgtgggcagagcaggtggtagaggggcctccaggaaagggccggggacacgggtgtccagcactaagcacagcgcactcagccgcagcctctgtctgtctccccacccgcccacctctggcacacagcacctggggacccagatttgtgcttgatcagagcttcgaaggaaggcagtggcagaggcgctgggaggctgtcctggaagtggccaattctggtgtcctctgcaaagtacccctcgtccctggacaaccagaacgtgccctgacctcttccctggcccgtccccacccgcggtgtgtgatccttagacgtgagtctgcatccgccgctgcaggggtcgactggggtcagagttctgggacgaggactgggagtggtgggaggaggaagcagaagccttgctggccttgtcgaactgcacatagccatcctgcttgccgctgctgctgacgctgctgtcacactgcgtgtccaggaaggagctgctgtcgctgagggagcctctctggaactcccgctcacaaagctcgatggacgagctgcccatgcccagcacaaaccgctgcccgtagtcgtagaggcggccctggccgctcagggtgctgtagatgttggtgaaggacatgcctgtgggcacacgctgcttgcccgcaggacgcaggtcgggctggcagctggagagggagatggtcggggttgagtggtgctctttgaaggtgttgacgctgtagtagccattggtggggtcctggatgggcgagaggaagaggagcgtcacctggtggagtctccactgagcgtggctggggtttccaggctgagcccgtccccttatgcggggagggaagagggaaaacaggaggaagggagcaacctggtagggagcaaactcaggggtgaacagctgcagggaaggtgcaggggaagaaggacactgaacaggagatggcagaagggggactgcggaccccaggaggggagggacggcaagggtgagggctgagggccgaaggagggaagcagaggctcttgactgggtttatgtcagggcaatgcagggtcatttgaaagtcaggctttttaattgtttttatccagaacatggatgcttcattttgaatctacatgtgaggaggctgtggaagagaactggggagtctcagccttagctctctcagcctcctcagcgttggggtagggagaggaggtgccttaggcagggacgggcacctgccaccaagctggcctctgaccttttcttctctgacttgctgtcatttgttgtatagatttggggtttgggccatcagagctaaagaccagattccatggctgtgtcttataacccggggcccttcttaccttcaggttctgaaactctttctcctcttctttgaggacctccagctgtttcaggactgagtcttgctggaattcaccccggtccatctgcaacccaaaaaaggctgctcagtagataggaggtggctaaacctccacttcccccaaggaaaagatgagatcagaaactcaaaagattgccctgtataacccccaccacccctcactgcctggaccatgtgaaagagtcaagatgagttcctggagccccatcctaggagacagggaagcagttgaggggggtgggtgagtaggtgaggtgaggggcagttaggggaggcgaggggcaggtatccgaggccatactttcctcgcttgggcgagggcatcaccagagatctcccatggctgattcaattccattgactgaacgtttattgtaaaatgccggccagttgctctgctaaggaccagagatccacagattaacgtacattaagatacagctctgctcatcagggagatggacttgtagataaataatttcagaatgtcagtcactgggcatggcaaggctccttagggcagtttcttttccagcgtgcaggcctagtgcaggccttagggagtcacaaggaataaccatctgtgagatgctggcgacatgggccacacctgttattctcatgaaaagttaacttccttagagatgccaaacagcctgagggcaaggatcacttcctgcttgtctctgggtcctcccacacctggttcagtgctttgcatgttgtggtcactgaccttgcctgcttttgggatggaatctcttaattatttgatttgccaatgcctagcacagtgcctgatatacaatagagctgcttcaaatggtatgtatatgttgaatgaataggcaaagtggcttagctctaaattactgaaaattaacaaaattattagacataagatgaaaaagcatactccacacacagtgggcatatgaattaatctgaataaccacagtgatgcttaacctgtgacacacgagaggcttgccatgtgtctctgctagttgcacggtataggtagtaggttccctcctactctctgggccgggatgtttcttctcccttgcaacctgctttcctcgtttctttttggagccctgtagaatcagccaaagtgcggccacccggctgcctcctcactaaggagaccatgcggttcatttttccagtaaatgctctggcactgtctggactggagaccttctttcccatcagattcaacttctaagtctgccccttcttgcagatggggctgtcttggggccaggaggtgaagggaatgcgagaatgacgatatcctcaaggggtggcttagcccagagccctcagcaagtcccttctgctcccacctgacactgagctgcccccactcttgcctgtggatttggactaagggatgtggagacagtctgaggcaaacagaatgtttgccgatgggagagaattcaaggtcccgtttgggatgaaggacacacatgattaagcttaagtatagagacgtcatcccttctcacatctaggctgtggtttcctccctcgtaaaactaaacactccactgtgttaattttaacagtgtcaggccctgtgttaggccccaggggaaatagatgagcgtagactcagaaacatgacctttgcccttgaggagctctgggataactggggaagctgacatggaattgggggaatgcactataaaggaggcacatacaaagtgttttgggagagcagaaggtgcacagctccgccaggggtggggaggacaagcccggaacatcttggagttgattgttatgggagaatgtgagattcaacagacaaaattagcaggcagagagaacagccggtgcacaggcctttgaagtccaaaagattcgaaggccaggaatcaagctctttggcatgtctggaaggccagatgtacttggccggaaaatggagctggagaggttggtggttgcctggcactgaggagccctgatggcacaccaggaagttgggctttgtccagcagatgtggggagccaccgagggattttaagtgggcaagtaacaggaccagatttgcattttagaaaggctgctttctcaaggctctcgagggtggattgagaaaagagacaaaagactacaaggctgagaccaactgggaggctgctgtaatcatccaggggagcaatgatgaggcctgaagtaaagaagtgatggtggaggacaggtggggcacacatttgagacactttttgaagtggaattgacaggacctgaaaatcaattggagagagaaagcgtagccgagggaaaagtcagtttgattcagtaaacgtctgtgagcctctaccagggcctgtgtaaggctccgaagaccccgggatgaacacagcagcagctgctcaccctctagcaacataaaccgctaatatttcttgagcacttattgtgttccatgggcttcaagcccttctgagttttgtccacttcaccctcaccacagccctgtatactgtggctttcagacccatctcatggatgaggacatggaggcaccagaaagcccatctactatattccttgctctgctgcctccactccaacatgttacgaccgaggcaaccagaaacttctagcatggttgtccaggtttctgcttggacaactaggtagatgatggcccataaatggggattcggaagaggaggagcaggcttgatgtgcctggagaagtgatgagttgactggcaatccagtccccaaggaggaacctgtgtttcttgcagactgttttggtggggtgcgggggatgagggagagggacatgtattgaatatctataatagctatgtgtgtgtgtgcgggggaggggaggggattatatgttatataacaacatattgtggcaatttatgcatatgtcttttctccttactgaagagccaggctctctgaagggtagactgcatttttgttgttgttgttgttttgagatggagtctcgctctcacccaggctggggtgcagtggcctgatctcagctcactgcaacctccacctcctgggttcaagcaattctcctgcctcagcttcccaagtagctgggattacaggcgcccgccaccacgcccagctaatttttgtatttttagtagagatgtagtttcaccatgttggccaggctggtctcgaactcctaatctcaagtgatccgcccaactcggtctcccaaagtgttgggattgcaagcgtgagccactgcacctggcctggactgcatcttagatgtctttgagtctgccagaacacaagcacagtacagcaggcacacactcacatttgttggctgagagtgtgtgcctcacctattgtggggtgggcagggggcatcttgaacgctgctctgctttttggaagcatctagttcattgagaagcctctagtcccaggaccttctgggaatggagtcacgggatgggatggggcgtaattgcattcttaccatcagctgcttgatggtggagtgctcctcaccctcccgaccagaggctggttccttgtggacaatttccactcggatatcatttttggctgacacaacacctttgagatctggagataaaatagtaaagtgtagatgatagatttagttcttacctttgagatgtcaagctcccttgcagtcccctgcccctgccctgccaccctctgcatttcccctccagcccctgaactcagcagcttcaccagccccccaccaatagaacctccatatggagatgctgtgggtgtttgggcctcagaggaggctgaccccatggccggcctgcctcctgtcacatgcccctcagccatgcacccttggcttgaaagatcgtcttcagccacttgtccgccttactgagctaggtccttttcatcctactgaattctcacttccttctagaagtcttctctgacctgctctaccaggcgggctccaatccctccattcatagaaccataaatctcagtgttggaaaggacctcaaagtgcccatggccaacccccatccaaagagaaacgcccctgaggcagtgggcagcttctctgtcgacgcctccgtgatggaagctttactgctacttctgcaggaggcaggctgtttctagttggagagctctgttagaaaattcttggctgggtgcggtggctcacgcctgtaatcccagcactttgggaggccgaggtgggcagatcacgaggtcaggagtttgacaccagcctggccaacatggtgaaaccccgtctctattaaaaatccaaaaattagctgggcgtggtggtgggtgcctgtaatgccagctactcgggaggctgagcatgagactcgcttgaatgaacccgggaggcagcggctgcggtaagccgagattgtgccactgcactccagcctgggcaacaggatgagactctgtctcaaaaaaaaaaaaggaaattcttgaggagctggtgcggtggctcacgcctgtaatcccagcacattgggaggccgaggaaggcggaccacttgaggccaggagttcgagaccagcctgggcaacatggtgaaatcctgtctctgcaaaaaattaaaaaaatagcaaggcatgatggcacacgcctgtaatcccagcgactcaggaggcttaggcacgagaatcgcttgaacctgggaggcggaggttgcagtgagctgagatcgtgtcactgcacttcagcctggccaaaagagagagaccctatataaaaaaaaaccgtatatatatgtgtatatatgcgtatgtgtatatatttgtatgcttccctataatttccactgagacggtggtgatggaggtcctgagaccacatcattgctggggtggtcttgagagccaaggctgcttagctcggagtgcagaaaatgcaaggggaacagctttcttcaaacatgtgcaggctgccgagtggcagaggagcagacccattctggtgattcattttttgcattacacttatataatgttagtgccagatggggccatcagagtcatatcctcattataaatgaggagacaggcctggaataactgtggctggcccagggtcatgtggcagaagaggtgggactggaacactgtgtctccattgtcttcacctgttctctgccatccaatctctcacacgttatctcctcggtgcacgcaattcttcaagcgtgcacaaacactagaattttattggtaatcactgaagacctttaaaagttttctcaaagcaattcctttattgcttccccacccactcccccacagctgtgtgagtgacctgcttttctggtgagactagcagctctttatttttattttgttgtagagatggggtctctctagactaacagctcttgtagagcaaggatcaaaccacaaaccgcttttccccctatctttctgtacagttcctgactgaaagagctatgtgttcaatccaaaatgctggctgccctgcagatgaagttcagtctagtccaggtcaacctcagcctagcgcccactctgccaggcgccatgttgcccaggctcacatacaccgatgcatcagacccactccctgccccaggagctcacagcactgttaggacccctgttcattgcactcctgcttacttgctctccggggcagcctaagcctggcctttttctctgtccccctccctgagatcccggatctccctcccgtacttctctgggaacgggcacagcagaacgccacgatggttgccataaggacgaggaaggccacaccagctcctacggccaccccaatgatgacggccatcggcacagactctgtgggagagaagcgggcacagctgatgacggatggggaatggcctactatccccccatgatctcaccccgttcctgcgggggcagcccctgccacatggggccctcctgggaaatgcctcagtggggcctgggcaggcacaggccgagtccaactggggtcagctctagctgggactgcaaagaccagggtggaggacacaggggcttggtgggtggaggagagggcaggggaactgaggtaaagggcagaggaaggagagcgaggcaggcagacacggagaagggagggccaggggacaggaagaccggagatgaggggtggggctggcacgatggagctctctctggcattaaacaggaatgctctatcacacagcggccagtgagtcataggccctggctttttttgaaaaatgactatggtcactgcccttgtttgttccgtatgttctctccttcccttccctttctcgggtgaatatagaggacatccggctcttagtgtttgcaggtctaagtagcttccccgcaggtctgctgggcatcagttgtggccctcaggtgtccaagtctcagggtccagggagcagggttacagcttctccactgccacctctctaaggagagaggcccctttccctccatctccaggtctgcagcttctccctcaaggctgcccctctgagcatccttgcacccctcctggcaagagaggcccacacactgggcaggcaagccctcacccctgctgagtctctgtggcctgtctcctgcccaagccgagtgggggtagggacagggagggtaaggatagagtcgggggtgatcttccacacagccttggcccttctacagctgcaagtggggtcggagcacatgatttagggccttgaggaatccatcaggaatagaactagagaatgctggggcagggagagcttggggctctcactgaggtccggagaagtcaagtgatttggccaaggacacacaggagctgcccagccagggtcaatccaggtctcctctcactgctcccacccctccactcaccccactcccaccccgtccagctccacccacagagtgacatgtgagatcccccacatctcatgtgctcggtaccgcccagactgctgctgctccgagtcctggctccatcccttctgctgagcaactgactttgcctctcttatatctgtaggatggggataatggtaccggcccctctgagggttgttatgggcttgagctgggtgaatgtgggcagaggccttggagcagagcctggcacccagccctgtttggtgtttgctgttgttgttacccaggaaggggtcaccagcagttcacggtcttttatttttgggatggagtctggctgtgacacccaggctggagggcagtggcacgatctcagttcactgcaacctccgcctcctgggttcaagcgattctcctgcctcagtctcccgaatagctgggattacaggcacatgccaccatgcctggctaatttttgtatttttagtagagatagggtttcaccatgttggccaggctggtctcaaactcctgacctcaggtgatccgcccgcctcagcctccgaaagtgctgggattacaggcgtgagccatcgttcccgatcagcagttcacagtcttaaaggccaggaaagttcctttgaaagactgagcccctccccagcctaccctgcgttcgtcagtgtgggcgagtggggacagctaggtatcagttctgggttgtaagcctcttgctgtctttttctttaaagggaggagaaagacctcaaaccctggcctctgaagatgctgctgggaggaggtatcaaggggtgggggtagggtggcagccatttgccctccggccagagggagctggcgcccctggctggcagtgttgctggttaagctggcacatccctttgccaccccaggacttgcacacgaagccattggttacctaccaattagtggccaggacagctgtaggggtgacagggaggggaccaagaggaggtggaatggtggacacttagggattgaaacgggaggtgctcgcattggttcaacagtcagactgagaaaaggggctgggcctcagcagagcttgccttgaccaatagacgacaacgtctctaggtttagttccatgaagaaagggaaactgctgtggcagctcattggttctctgcttttgaattggattgatttgggttggtttctcctcagattcctagtaagtttccttggaaaaacacagggcttgtctcagcggaactcagagccaaagcatgtccatggaaggctcttaacacctctgggcctcagtgccttgtctgcaccctggagagctgggcagcagcattgaaggtgccttccgatcctgggatccccagcccacgtttccacacgctgctgacggctgggggaggggtgccctcttagctggacaacggtcaccagggaggtgggcagggggagagcagggggtcctgtgggggcgagtgccccggggtgccatctcttcccagtccccagcctgcctgtgtgtgtttcctccttgcctggcttcctgaggtttggcctagggcgatgtgcaggcccctcctctctgcacagagccttccctgcatggctcctggagagggactggagggaggggctgtccccactcagcctcccctccatccaaggaggtgtgccaggcaccaggagccaccgaggggggaaggtgttggggagctctggatgagtgtcagcagacacaggagacacggagacaggagacaccaccctcagcactagcatggacccggggagaaggcagcgggaggctggcagctttctgggttgccccagtgtgggctgcaggggcctctgtgagcaacctgtgccctgggttggtgctctgataggggcatgtctgccaggaggggcagaggcaggggcatgaggatcccacgtggagcttgttgaggaggtaacagaggccaggggccagtgtggcaggaggcctgggatggaggaccactcaagtcttcagcatggccatagagcctggcttgctggtcctgattctcttttctggttttctgctcggggtggggttgagagcaactccgcccagggggcctgatgactgctttgctgcgtgtgcctggggagggaggcgctgccctgcagcctcagcttggggtgagatgacacttccatggggactgcaggagtagggaggggtggcaaacagcaagcatggattgcacaagccacagcaggggctgggggcccccggtgtcctgggaagcagtggccaagctggtgatgatgtggagaagcgggaagggtcggagagagcctggaagcagaaggcagtcaggacaggggccagctgaccccagaggccaggagtcagggctcctgaagagaaaggatggaaggaatggagcggggacgagcaagagccagtgtcccagagaggaaggagttgtgggttccggcggcaggcaggagacaggtctctggggtccctaggcccaagctggctgggacctcctctccccactgctttgtctacactaaaccctcaggacgggggagggcggagacactagcggccagcacaggcctccctaccccctgctgggttccctccccagctagccaggaagtcccttccccccttcccagggccattctcatcatctccttccgtacctgcttccagcccggctcccgacttcatttccgaacctgtttggaaataaagcaagcgtctacagccagggcctggctggccagggtggggtgggactgggaattagctgcttgagcggggctgggtgaggggctcctttcccagtcatgtctctgggaccccccaacagatccaggctagcccagctgaacttggagttcattcaggctgacttagagactctggaggggctagggaccggagagagatcacgtctcggaggggtctgggagggttggggtgagaacactcgggggagggcatggggatgggggcaccaaggggaagacacggagggtaggcaacaggggaccaggaaggtttgggatgatgtgtggatgatattatgcaaattatgtgcaaagcattatgcaaagcagcacctattagggaagaggtgttgggagatgctgtgtgatttgacccataggtgtgatcctggtgtggcccactgaggcctgggggcccagctgagaccacccacttggcctagaatctcttgctgggcctgacagcctgcgaatggacctttacctaagagggtgtcagagatcgtcaggactgaggcctcctgggcctcagaggcccaggcccagctgagcacgaatccctggtccaccatggcttagcccctgctggcaaaagggcaagatcaactgcccctctcagaacccggcttgctgctggctgtggtggggcttctggagccacccctccgtgcccctccaaggctccccatcctgttgtctgtgcctgagagctctgagcagacgctggagatctgagcctctttgaccaggagctgggacgtcagcgcacgggggcacagtggggtgaggcttgttcctcctgcctcctccctctcacccacccggctgctttgcccagcgctgcctttgaggtacaggggtccatgtgcctcctgggtctgcaggtcatctgagcccagcccccgaccctagggatctggacaagcaagcctaaccccttagctttagcctgggtgccctctgtgggacttgtgtctgagtaactggatgggcttgtcatcttaactgtgactgggccaggttcccagcacacccatgccagtgtatcccacgctccacccaggcatgacactttggtgtcagaccagggcccatggcagagggcagggcacagaagccagggcctctggaggctactgggcagcttgtcactgccaccagcctgctcactgttgtggtcacctcccactgaagcatcgccctcaagggctgcccctctgagctgtgttcttccctttcttggttcctggtggaggctcgtgccccttgcttcagcgagagcctggctgaggaggctgctggctggctaggctgtgtggtcagccaggaagagcactgtggcttgtccttgggccctggcccaccttgcagccacccgcgccctgacctaggtgaggagagggccctctggttccatcgttcgttgttccctcatggccctggcagctctcaccttgctccttgagccggatgatctcagtgtcggagccgaagctgttccaggccgtgcagttgtagatggtctggaagtcggcccgcacgatgttgctgatggtcagggtggagatgacgccctcctcggtgctgatggtctccaccgtatagcgccccgatgtgcccgactccagaacgttctccttccaggaccaggcctgcccgggggcgcagaatcaggaggagaccccaccagaggggcccaggacacgcccacaccagagtcacagtgccactgtcctgctcatgttcatgctcactgccacacactaacacatgtgcacacgggtatgtatgcaggcacacatgccacacaccacaaatatgcacacatgcaggtgcacacacaacacgcatcaccacacatgggcatgcacagcatcccacacggcacccacatgcaggtacacgtgtgcacacacaacacacaaacacatcacacgtctatacacagctccccacacatggccaacacgtttatatacatactacacacaccacaaatgtgtacacacagctctgcacacacacaagtgtgcacccactataacacacacatcaccacgtacacataccaatgtatatacacacaggtttgtacacacacaccacactacaaacatgcatatgcaagtacatgtaccacaacacacataaacatgcatcacaacacatgcacacaccaaagcacacaacacatcacagtgcacacatgcctgcacatatgtgcacatgtcacaacatgcatacacacatcacagtacatgcacatcacacttcacactaaaaacatgatacagacatgtacatacacatggcagacacgacaccacatctacacgcaacacacagccactccccgaaatacatgtacacatgcacacacacaccaagatgcacgcaccatatgccacaatacaacacacaatacaagcatgcttacacacatgtacataccacaacacacactgcaacacatacacacattcgccatacacaccatcatgtgtacttacaggtacacacactatgacatacacacacaccatgtgctcacacacacaagtacacacactaccaacagatacacatgttcacacatgccatgacacatgtacacggtaacacacccacaccacacatgtacacaatccacaaacacatgtacacacacatactctggggcatcctcagagggtctttccatcccagaaaggggcctggggagcatctttctgggcaaagtgggtgccctgttggcctgcgcactgcgcctccacacaaatgccccccgggactgtggctgcctgggtgggtgtgagttaggacagcagccccatgaacgcgtctacctgtgtgatgttgtatgtctgtgtgagaaatgtgtctacagagctgtgtttgcgatcaccttcgtctgccttagtttacagggctgctggttaacagttttcagagccggccacatacactgtctgcacctcatcgtgtaagcgcctcgtatatcctggttcggggctgatgagagggactgagtttctcaagcttgctgctattgtcacgctggactgacccattcctggccgtggggctctcccaggcattgcaggatgtcagcagcaccctggcctctacacacccggtgccaggagtatcctccaagtgatgacaaccaaaatgtctccaggcactgccaaatgtcccctggggccagtgagaaccgctggcctagaatcagatatttctggagagaaggtgtgaaaatgtccaagagtgaatggaatatttgacaatgagcatgtgttacatttataattaaaaacatcaaaaagcaaagtgaatggggaggcgtaggtattagttttattcatgagttcttgcaatttttttgtgaatctttcagacagtgaatgaactgaatgcttgagaaagcgtgtagcagcaataatactctaataatatcttagttaacaggatgacagtttcagttggtgcagcctgggtgtctcagcccccgcatgcacgggttaggggtgacctcagctgcttcacatctgggccagccccaccctccctgcacaactgccctgcccactccacccctggacagtcttctagcaggattttgccatacactgggaattactacaaataagttttccccgagtagtgctataaaatgctcacttttctttgttttcatgcctgagatccctccagttttagatggatttgagtacaagactctgcccctggatcacctgaggtcaggagtttgagaccagcttggccaacatggtgaaaccttatctactaaaaatacaaaaaaattagctgggtgtggtggcaggtgcctgtaatcccagttacttggaaggttgaggcaggagaattgcttgaacccaggaagtggaggttgcagtgagccaagattgcaccattgcacccagcctgggtgatagagagagactctgtctcaaaaaagaaagagggaaaaaaagactctgccctcaccttaatttttttgttgttgttgtagagacagggtctcactatgttgcccaggctggtctcaaactcctgggctcagtcgatcttcccacctcagccttccaaagtgctgggattacagacatgaggctcctgctcagtaagaccctccctttaaaaaaatgcagatactggctgggcatggtggctcacgcctgtaatcccagcactttgggaggctggggtaggaggatcgattgagcccaggagtttgagaccagcctgaccaacatggtgagaccccatctctactgaaaatacaaaaattagcgaggtgtggtggcagatgcctgtaatcccagctactcaagaggcgctgaggcatgagaattgcttgaactgggaggtggaggttgcagtgagccgagattgtgtcactgcactccagcctgggtgatagagcgagactccatctcaaaaaacaaacacaaacaaacaaacccaaaaaacacacaaacaaaaaaaccaagcagatagctggtaggaggcgctgagggtggactcctcagttgccttagctgcattgcagggataagttctttgaggaagggagagagaatggaatggtcactttagaggggacgattgataggcaacagggcaggctaccatggacagtaaaggccacagagacctggcaaggagggctccaggaggcacagaaaggggttgccaactattacctgcgctctaagattttgctaaagactggcctggagcccaggaagagaagaagtcacttgtcttttctctccactaccctcgtgtgcccctctgcccttaggatgcggaatttggtcagagccgttcatgtcagagctcagcagaatggcagctgaaccctgggagagcactgcctgttctgagaaaggcctgcaattgtgtcttcacgatgcttttccaagacagccaaggcaggtataattttcctcagcaagaaagaggaacctcggaggtgtgcaccgcctggctggccacccaggtattggcaaaagtgactgttgggctgctggcccggcccccgcccgccgtccctggagcactcacgatgcggtccggcggcggcgtgctccggatgaagcacttgatctggcccttctcgccgtggagggcgtgctgggtctgggtgctggagatgatggggggtcctgttgagaaacagcgtcccattaggcacccgggaagggcacgtccctgctggcgccctcttgggtgggttcagaagtgtattcattaatccaagcattcagcaaacatttgccgaaggcctgtatgtgcaaggtaaagtgcaaggtagaggactcagagataaattaggcattcagtcataaacctctcaagggatcatgagcgaatgcttctaagtcagaacccccagaagatacaaataactgtaataaaaggtggtgagtgttagtaccacaggagcggtgcagataaagtgctaaccgacttcagaggagagagaataattctatctggcggacggggaaagctttagggaggaggtggtaagcctgcagagggggtggggaggtgtctagatgaaggaagactcccccgcctcagccagcggcacccctgcgagccattcctcagatatccagtagagggcgcccttgcctaacaaatgggagctgctcggccagacgggccaacgggaagaaatggttgctgtccctctccttagggcgggaatcaccccggacagggggaatgcatgcgctggccgtgttcacagccctcctcccacctgtgtctcaggaggtcctgcagttcatcatcttgtctgcctccacgtccatacccagactgcccaagtgaggccatggctcccaaactgaccccaatattatcatatcacagagtgtggcacatgtttatgggtgtcaggttctgagagcgcctgtctcattcaccacattgcacagccaagagagttcacctggtggaggggagcctgttccccagcgcctcctgtccagttccgcctgttacctaacccaagtctttcccctgtgacgcctgcctggccgtgaaagacaaaagaaggagcagctagcttagcctgggctctgctggcttcctggctgggctgggtggttgaaggatgggagtagggacggaaactgtcatgctccctttccaatccctggggtcacagttgggacttagatggcagataccagaggaaagacagccgggagcaacgcatctggagaacacacagaattatgcaggaacaaaacaaaaattgctgcaaacataattgctgtttattagccaccttaattaaagcagatttgcatttctatgagtagctctcagccaagggagaaaaggtactgtagacactccagtgacttctgttgagtttgagaaggcaaaagggctcggggcagcgtgaggtgggcgtgggggaccctccatggctttaagaatgggctgagcgctgccctccttcctaaaaatccttcagctccaacaggtctaggacccaaagagatgaggagattgatgttttaggaaccggatggtgctttgttttattgctggactaaaacgtgatgataatataaaaccttttctggtcaggtgcggtggctcacacctagaaacctagcactttgggaggctgaggagggtggatcacaaggtcaggagttcaagaccagcctggccaatatggtgaaaccccgtctgtactaaaaatacaaaaatttttagtatttattatttagcctccctacttgggaggctgaggcaggagaattgcttgaacctgggaggtggaggttgcagtgagccgagattgcgccactgcactccagcctgggcgacagagcgagactccagctcaaaaaaaaaaaacaaaaaaaaaacaaaaaacccaacatgcacagacacacaaaacacacacacacacacacacacacacacacacacacacacaaaaccttttccttgtgcttcccaggagctaggaattccctgaggggttttcatgattctaaaagccatcatcaaatgcatctgcttcttaaaagaaaatgaaaaccaggataaagggaaatggggtgagggttagtaagatttctctccccttcctgcagatacctgatttgagccaaatcggttgaggtgtgtgccaatttctttcccaaaggactgctgcgctggccagcagttgtccaaggctgggatttgtcgcgataaaaacctgatctcatttgaatgctttcatatcaccagctccctccagcccatgcccaggtcccatccactgggcgtcccccctccctctgcctgctctgcagaagcaggggcagacagttcgccccctggcaggtctggtgcgctcccctccggggccactgaactcatccacctgcctccaggtgtgtgaggccaccctagtcaagaaataaacaagcagcttctttgcttccctccaatccctccagcttttctctgcctggaagcctcggggagcttgtgctggcaggggtggaggcagaggaggggagagaaagagacctggagagtgcagattcaaccttggtcagcgccagggcccgggtttcagtgccctccccgtccaagagaaatgtccctcccggcctgtgttccccagggggcattctctcctcaagaaatctctttaaatctcccttggaaatgtctgaacgtctaaagtgacagcagatgtcagctcctcctttatccacctgcttttccccagaaacgccaatgctcatttgatgctccaggcttgggggccctggagtgcatgagtgagtgtgagggtcccgggctggctggtcatagggccagcagagcagagccggctgcaggcacagacagcctgacttccgagtgccctggctggcgcgggctgtgtggagggccgctgatttcactggggcctggagctctgagccgagtgtcagacacctgcgctgaaaggaaaaggctgcagcctgtgttgccatggatatacggaggcgcgatcagatgctgttatttttagccctgcagtgccaatttattggtggcatcctggggacactcaggaaaggcaggagggctccgactcagggctctgccaggacaggtggctgtgaacgtgctggggtctgggtagactcagcctcccttgggggctgccacgactctggggtggggggagaggaatggaaatgcggggcagtgtggggggagctggtgaatggagacagtagagaggtatggctgaggagacaccaagctggttttggttttctagcgaaggggagaatagatgaggccatcagcaggtggctttctgggtagagaggaagctgaagcccacgagctaatttggagacctcaggagggccctgctctggggccaggacccagatgtcctgcaaatgttggtggttcagttcctgcagggtcccagagctttggggttttgatctgagtcaggctatggtgggaacaggggcctcccaaagggcagtgggcatgacagaggtgaggggggagcattcggaaacggcagaggaatcgaactggcagctttgctttttgcctgtggccaaagcaccagatagggcagggacgtccgcatttgcgtcctggtgccacaaccttcttgggtctggcctgagccaggtctcagcttctccatgactgtctacaccccatcattcaggcctggtgtgatgcccttgtccctacatatttcatgtaacagtcattcatctactaactcccaccgtgaaaatactcccctgctgcaattatttttattatatataataagacatgccccctgccctcaagggggcccctgaacacgtggcctcgtggagacggtgacagggctccctggctgggtgactcacacgcattgggaagaggctgatcaggagctgcagagatgctctcttaaattctcatggggccaggagaggtggctcacgcctataatcccagcactttgggaggccgaggcaggtggctcacttgaggttaggagttggagaccaacaatggtgaaaccctgtctctactaaaaatacaaaaattagctgggcgtagtggcacgtgcctgtagtcccagctactcaggaaggtgaggttgcagtgagctgagatcgtgccactgcattccagtctggacaacagagcgagactccatctcaaaaagcaaaaaaccaacaaaaaattctcacgggccaaggccatggtgagtggatgaaagggtggacacgttggccacctagtgacctctgatgctttttttcctggccaggataaaattcatcacccaccactctcagggctgagaccccttcaaagctaacaaacaaaaagagaggtgactagaaaactacccaggcccttcctccctcagcctgggtctgacggggaatccaggaggtggacctaattgttgtctacccatagttggaggtgacagcaaggcccagagccagcgacagctcctttggggctatgcctggtgccaagatgcctgaggtccttcttccctccctcaggcctggctcaccccagcgagggtcttaccattgacggtcagggtcacctctctctccccggctcccacacggggcaccacagcccggcacacgtacttgcccgcgtcctcctggcgcacggatttgagggtcagggtcttctcattgctcaggacctaggagaattggcaggctcagatgccaagagcaggcggaggggtgcactcttgtctctgggaacaaggcagctgagaggctggcctggggtaactgaggcagtctccggcatctcagtaggaagcaaggtggggaggaaagaggccaaaagtttcctggcccagacaatgcctgtgggctgtacagaggagactgtaccagcagagaggccaccccgtgtgactgaggatgttacatcccaggcgcagccctgtgggctgggggcatgtgggggcacatgtgccggaggagggggatgcctgcctggggacttccaggtttcctcctacaggaacctccctgtacctgcggtggcttctcctctcccaggctagccatgggtgacatgatcctacagctgaacttctctgggggctcctggacctgttttcagagtcattttcaggatccctttgggatatagcttggagtgatgaaaacaggctctggcatgagcttggtctgcgttcgaatcccggctccagcagtgaacacctgtgtctctttggtcagttacttatcttctcagacgctccctttctatgtatggaggctgctaggataatgcagcgtctgctacataacaggccacacaaaggtcggtttccttctggtccccctgcttccctacctggagctctccctgttccttcctatgtgaggacatctgacaatctcttatgcactgaagaatatatacgtcttaaaagaggaacacaagggctggacacggtggctcacgcctgtaatcccagcactttgggaggccgaggtgggcggatcacctgaggttgggagtttgagactagtgtgaccaacatggagaaaccctgtctctactaaaaatacaaaattagctgggcgtggtggcccatacccatagtcccagctactcaggaggctgaggcaggagaattacttgaacccgggaggcggagtttgtggtaagccaagatcacgccgctgcactccagcctgggcaacaagcgcaaaactccatctcaaaaaaaaaaaaaaaaaaaaaatggaacacaggaaagtgaagcccaagtccaaggctaacggtggctttatttgggggaagtttaaaaggctctttctttctctttcttttctttctctctctttcttttctttctcctttctttctttctttctctctctctcttcctttcttcctttctttctttcctttcttcttcttttttttccccaaggtcttgctacgttgcccaggctggacttaaactcttgagctcatgtgatccttccacctcagcctcctgagtagctgggactacaggtgtgtgccactgtgcccacttgaaaagcctttctagtgccttccctcccagcacattggtgaccacctacttttcttgtaaggtttaggacagggcaagagtgcaatggctgaatgtgctcagggtgggacaggcacatgggggtgcctgggttccccctcctctttctgggatctttctccctgtggcttacactggaggctgactcccccagtctaatagtgagaggggcctgggcagcagttccttcttgctccactgtccccgccccctgccagaggtgccccgaggtctgagctgcagcctcaccactccggagccccgcttcatccagacgatggtcagggatgggttgccggtccaggcgcagctgaagatggcatcagagcccagatccacgagcaaggattggggttctgtggtcatccggggcccaactgcgatgtgaggaagaagaagacaggttcaggtgggtggggagctctgggatcctccttgctgctgcctccttttccccctagaccttgactggggggaggcaggcagtggggtacttgtgccacctcagtcgcttccattttaagtcttatgtccgggcggggtctgggatctgggagtgggactcaggaagcaaggaggagaccactctccctgaggcttcgcctctcttgggcccatggaggtggtcggcagcgtggggcctgggaagaaggtgctggggaccaggttctgcctggatttacccccacggctctcatccccttccctctgtctggatcacgcccggtgctagaaagctgcggaagcccctccatcccagtggcgggcaggggccctcctcctgccctggaaatctgggctcttgggatcttcatgcctctgccttcaagctagctgccatctcctccagcctcagccttcatgacctggaatcgagtgactggtgcacctctggggtgggatgggggctctgagatgcagggtgatggaggcagggctctcgtgacccacgcctcctcccccagggtttcccacccggtgctctcaggccaccctcctattacagccgttccagcctctgtgtcacgcccattgcagtggagcagccctgggttccacttccgacccctctcctaagcattaaagagctgaatgcaggctcctctccaccttccctagcatgtctggagccttctgtagaccaagcttggtctacacagtgggggccgtgtggggattccaggctcagggtccgaccgtggccaggcaggcctcagagtgctccttccagggagcagacagagcctgaagcctggtgccaggagactgcgattagtcccctgatgtaaaaagggagtaacagcactttcttcggaggcttcaagggcaagggggagggccagattttttcaagtttgtaaaagcaagtttaaaactgtaaggggcggtgcatgagctaaggatgcttgttttgaacacatccagccagctagtccatggcagtgcgctgccttgctgcgggtccctgctggacctccagtgaataagaggggatgggcaggtgcggtggctcatgcctgtaatcccagcactttgggaggcagaggtgggtagatcacgaggtcaggagattgagaccatcctggccaacatggtgaaactgtctctactaaaaatacaaaaattatctgggtatggtggcaagtgcctgtagtcccagctactcgggaggctgaggcaggagaatctcttgaaccagggagttggaggttgcagtgagcagagatcttgccactgcattccagcctggtggcagagtgagactgtctcaaaaaaaaaaaaaaaaaaaaaagaaataaaaagaaaaagaaggtacgtccgtgagtcccctcagtggaaggcagcagaatgtgtgaatgggcaatggatttggtcattgcctgggttcagttctcatttggccacctactgtgtgacctcagacctccatctcctcattcagatgatgagaataaatatctacccatgatggcctgcgtgcttgtgtcccccgtcaaccctgcaattcgtaaattgaaatcctcacccctgtgggatggtagtaggaggaggagctttgcaggggcaggggttagatcatgagagtggagccctcgtgatgagattagtgcccttggaataaaggccccaagagcttgcttctctctttctctctgccatgggatgccacagcaagaaggcagctgcctgcaagccaggaagagagtccccaccaaaacccaccacgatggcaccctgatttcagccatttaagccaccgagtctatggtaacgtgtcatagcagccccagccaagaccctgactcatggggtcatgatagggattgaaataaacatgaaacaatgcacaaaccagctttcgtcgagtgcaaaccatcctacgctcatgacgcatgaagcttgtgttgtgtgcaatgaatctagccctggtttctccagctctaagcagaaaccagtggatgcctgctcgcctggggaagcctgcaccactgcactcacagtagacgtcaaccgtgcggctgaggttggtgctgcccagggcgttggtcacctcacaggagacgggctctgagaagtacgtgtagtccactgtggtcctgtacacctctccagatgcctccttgatgatctggccccgcttggcccacctgcaacaaaggccaggggctgatgtgggccttgagtggcaaggccaaccctccgggagctggacacatccatcccatggaaaaatgaggcctgggttgtgtggcaagtggggagtcctctggggtccgtcaaggggaatcttcacagaggggctacttcaagggctcagaaagagttggttttgctcccacccaggtggttgtgaaggcagtgggctttggtttgtggtcaccaggcagtcagtggcactcaacaagtgggttattctggagggggtgagttgattactcggctggtcagcccatctgctggctagacgatggaaaatccaactgtcagtgggcagacagctcgctgtcctgctctgagctggatcatgggcccctttggaaaagaaggaggccaagtccatgacctcagaggccagggtcaaacggagcatgcccatacatgcatgctcatacgtgtgcacgagcacacacacacacactgacaaggcgagaagctgtaggagaggtatgctgtaggggctccatctcccgtccaaacagtggaatactaatacccatcaggaggagtggcgtgagcgagtagccctggctgcccctctctttcctcttgacaagctctcagctctcctgtcctgttctgcctcctgcttccatggggttctgcatggtgtctcctcgccccagaaagtcctcctagtttccctggatggcacttgctcttcttcctgcctggcctctgcccttgcagcctggctttgctcctctgaagcaatggctccatcagcactggcttggtgaggggatgtgagtcggaagtctcttttgtcggccaatcggtaccacacaataggggaggacaggaggcctctggcttgctttggatctggctctggggcagtgacccctgtgttggaccagtgacccagcagcctgctgtgtgcagaaagcaacggagcctcacaggggtgtatgtgtatacacatgtatgtgggtgtatgtgtatacacatgtatgtgtgtgcatgtgtgttcatgtgaatgtgtgcatgtatgtgtgcacgtgtgcatatgaatatgcatgtgtgagtgtgcctgtgtgtgcatgtgtgagcatgtgcgtgtgtgcatgtgtgagtgtgcccatgtgcacgtgtgcatgtgtgagcgtgggcatgtgtgtccatgtgcatgtgtgcatgtgtgagtgtgcatgtgtgagtgtgggtatgtgtgagtgtgtgcatgtgtgagtgggcatgtatgtgtccatgtgtatgtgcgcatctgtgagtgtgtgaatgtgtgcatgtgtgtgggtgtgagtgtgtgcatgtgtgcatgtgtgtgtgtgcatctgcgtatgtgtgcatgtgtgtcaatgtgcatgtgtgcatgtgcgtgtgcatgtgtgcatgtgcatgtgtgcatgtgtgtgtccatcggcgtgtgcgagcatgtgcatgtgggagcatgtgcacgtgtgtgtgcatgagtgtgtgtgtgtccatgtgcatggtgcgtgtgtggtgcgtgcatgtgcgagtttgtgcatgtgtgaatgtgggcatgtgtgagtgtgggcatgtatgactgtgtgcatgtgtgagggtgtgcatctgtgcatgtgtgtgtctgcatgtgaaagtgtgggcatatgtgtgtatgcgtgtatagatgtgtgagcatgtgcacgtgtgtgtgcatgtgtgcatgtgtgcatgtgcgtgtgtgcatgtgcgtgtgtgtccacgtgcatgtgtgcatgtgtgtgggcgtgtgtgcatgtgtgagcgtgtgcatgcatgggtgtgtgcatgtgtcaatgtgcatgtgtgcacgtgagtgcatgtgtccatgtgcatgtgtacatgtgtgagcatgtgcatgtgtgcatgcatgtgcatgtgtgtgcgtgtgtgcatatgtgtccatgtgcatgtgtgcatgtgtgtgtgtgcatgtgcatgtgtgtgcatgtgtaaatgtgggcacgtgtgaatgtgtacatgtgtgaatgtggccgtgtgtgtgcatgtgtgtgcatgtgtgggtgtgtgtatgcatgtgtacatgtgtgagcatgtgtgcattgcttgtgtgtccgtgtgcatgtgtgcgtgtgtgcatgtgtgcatgtgtgtgcatgtggttgtgtgcattagtgagtgtgtgcatgtgtgtgcgtatgtgagtgtgactatgtgtgagcgtgtgcatgtgtgaacgtgtgcatgtgtgcatgtgtgtgcatgtgtgagcgtgtgcatgtgtgtgtccaagtgcatgcgcatgtgtgggcatgtgcatgtgtgtgtgcgcatgtgtgtgcatgtgtgagtgtgtccatttgtgagtgggtgcatgtgtgagagtgtgcatgtgtgcatgtgtgtgatcatgtgcatgtgtgtgtgcgtgtgtgtacatgtgtgagcatgtgcatgtgtgcatgtgtgtccatgtgcatgtgtgcatgtatgggcgtgtgcatgtgtgagtgtgtgcatatgtgcgtgtgtgtgcacgtgtgagtgtgtgcatgtgtgagcacgtgcatatgcatgtgaagttgggggcttccttacggatctccagggagagagagttctccgtttcccctggtttaatcctactctgatcccaacattcttttttttgaaaccacggaacttctcttcaggctgttacagttgaagtgtctatggggagtttgtctttccagagctgcagaggcttgttgcctccagaagcgtcaccccacagccactgctccctggaactgcagtgtctctgctcccctgctttgcctcccctttatcttattcctggagcctttcctggcaccacaaacgccgtctcctgcccttccctccattagcttcttgcctccgtctgacccatccagccccgagagacgactgtttcttggcatcagacagaacacctaggctggcaccaagcagttgttattgcaaattaatattgggtaattattaagaacacaattaataataacaactgtagtttaacaacagagcaaaccatatctcccttagagcttaaggagcttcccaacaaaccattatgagttattcatgtgtcgtttcaatctcttaactttgatttaatgaccagacttaaaagagtcaggccggcccctgcctgcggcaaatgaattcagttccaggcacagctagggaagtgtgtccagccccgcagttcctttcaccctgctgaggcgagggggccaggtggtggatgcagcgtgaggccaagcgggcagctggctgggctgggaaggcagggagccctggctgctcacagctgtgggtgccgggctggggctggagggtttgggcccaggtgatagggccaagcatgcgtcttcctcagggcttcctggagaagctctcgcctctcctctccttccagggcccctcaccaggagcatcacggagggtggaagccccacctgcttggccccaagtaatcagcagaactgctgctggctccgggagccaaggttccctgccctccctgtcctctcctctcatggtgagggagccagagacggaagaggaccggagccgctgtcggggctgggtccgcaggagcccaagccaggtcttttggggaggtgcctcaggacccgacagagcccgcagctcacatctcgcccagccggtctttcttcccctcctgcactgaaaaaccctctgagaggtccctgccaaaagcacagacactcaaaccactgcatccacgcagctggccaaggatccaggccaagagctaaagagtgagtctcgccccaccctcttcgtgcctctcctgattttggtgcagtttcttccctgtccttcctctttgtctcctcccctctccccacccacctcccccaactcactgttgcttccccacctcccccagcccctctgaaagtggagtcagcttaagcctctcccaatcaatgtctaatttggtctgaacaaatgtaagaggattaattatttatatcacagaatcaggggggctggcgtgtcacagccgccaggttgtcctcaaatagaccaaggtttcatctcgtgtgggggggccacatcccgctatctgctggggaacactgagagactctcagaggaaagggccccaaagcactttgggctcctggtccctaggagcatctgcagtgacatccccatgccacccaggcctcctttccaggcactgggatggaggagggcgttatctctagcttcagagatgacagcctcttagtgacagcagggaggaagctatcaagatgaatgaaagtaaagaaacaaagtttcctgtaatcttgtcagttaggaaaaatcaatgtacttatgtgatgagatttgcttacggcttttcttcttggatcccaacattgcttctaaacacctggctgcttggtgagaccttgctggagtgaaggggctgagcgagtgtgggtgggtgcaggcgcccaccacctcccctctccgtggcccctccgcctcctcccttcccaggccactctggctctctggcattaacctgggggccggaggggctccctgaaagcctctggagtcctggagggagatgacccctcagtgaggtgttttcagggcccttcactaatcagaaggccatgagggaaggtgaccaggaagaactagtgagtctctgcagggcaccctgccctccctgcccctcccagctcctgcttggtataggaggggccggctgtgatactgtgagctccaggggagtacgaaagggaggacccacaggccacctgtagcatggggaagcccgcatgttctctgcttgttcattaacttttcagcttgcaaaaaacaaacttcggaattacagaaaagttgtaagaatagtcccattaactgccaccctcccatcgcccggattcaccagctgttaacattttctcacgcgtgctttgcggagacctctcctctcctcccaccttcttctctttcctattattgctgttctgcttttttgaggttggtgaccctgggaatcaggcccagcacttcgtttcctgggtgtttgctgtccgggtcagtaggcaggtgtgggtgggggaggcaggcctgggggtggaggggtcaggtcccagggcgtgcagccctgctgtctgcccagcctacccatcactaggaccccaggtgaccagagcctggcagtgaggagaaacgaaagtcgaaagttgtgtgtcctggtctctggggcgcccaacaggcattctaagggtggctgtgagggtgaataggggtgcttgccgggtggtctgtgggtgtgaagggctgccctgggaagctagcatgacagatattttctgggcatgttgtacctggtgtttagggaccaggagcagagacctgggagcagacagaggagagaagctgaacttgtatggagaaacccaggcctggcaggtgcagcgtggaagcctagggccagggagtctcattgggcgcctctcttgtatcttcagtggcttctgaatagatgccagaccacagccaaaccagacttgccccctggacctggctggacccacatgattctggggagcctggagtccccggctcagaagggaccctggaggtcatctgttctttcttctgactctagtcaagcaaatggttaaactggacaggacaaatgggtttcatcctatttaaaaatatccttggggataggaactctgggctctgcctgggtttctgactccagtgctgcttaattacgcactctgcagggagcacctcctcatgtccaacctgaatccctggctgtccctgtggcccatttccttccattctgcccacgggggccacactggctcttgtcttccctgttctccattcccacaggccggcttatttcctaggctggcaccattaacatccttggcctttgcagatgctgcagcttaatggccgagatcaatggcagaggtgacacctgggctccaccactaagcctggtctggtggaaagagaccaggctgagtcagggccatggcaagttccacgtggcacccaaaaggaggtgagtctgcccttgagtgcctccaaggtcacttagtctcctagagtcttgtgcagtgacagtgcccaggcagaaaggcgcccagaggaagcgtgtgtttattggatcagtcagacacatctaaggagcatgtggtttatgccatgtgctgtgctgcatgctgagagccatcagtgactaaattgcagttcctgccttcaagaagctctgtcacaaggcagaaacaagtaaaacaaaaacagtgatgctttggccgggtgcggtggctcatgcctgtaatcccagcactttgggaggctgaggcaggtggatcacgaggtcaggagatcgagaccatcctggctaacacggtgaaacgctgtctctactaaaaatacaaaaaaaaaaaaaaattagctggcgtggtggcgggcgcctgtagtcccagctacttgggaggctgaggcgggagaatggcgtgaacccaggaggcagagcttgccagtgagctgagatcacgccactgcactccagcctgggtgacagagcgagactctgtctcaaaacaaacaaagaaacaaacaaacaaacaaaccaacaaaccaaacagtggtgcttttatccgtgttgtgagcaagagacacacaggggccatgagtaagtgtgatcccggatgctcactggactgggccggggcccagacatcctgatctacccaggtgaaccagtttgatgggcacaagactagaatggaggttctgatcttgctgcttctcctggttgttctggtttttttttgttttcgttttttttttttttttttcctgagccttttccccatgtttggagtgtggaataatcaggctattcaagcagaagccgtgagtcctgcttcctccagtggaagagggcgcgtgcacgcacagaggagaggaagggtccacacggctagcaggcaggcgggtttaagaggaagggaagaaggctactggacacgcggtgtggactaggcacacactgcagccatgctgaggaccctaagtgacatcccacgtgagaggcacgggggtgggggccagtggccaggccgggccccctcagcagtgactctcacctgtactgggtgacagctgggttggcctttgcagagcagtggaaagtgacgacgttgtcctccagcactggctgtggctccaccgagaggttgaccagtggagggtctgcagggagaggagagtcacttgtagaccggagaaagaatgggggcagggagatcctgggcgacatggaggatacagccagagactccaccacccagggaccctcagagcagcccccgccctggtggtcttcaggaagctgggggctccatgggaggtgcctgcttcagacagtcctggaggtgggaacagggcctccccgtggacttggggcctggtgtggacacgaaccccgagccaggaagcctcaggcttgggcccaggggtttcccatcctccaacttttgggcggaacaaaataatctaggaaggagaggtgggaagaggggtgcagggcagagaggggcgcgtggacactcagtctcgcttcagtgcagactgtctttgaaatgtctgtttattatctcttttccgtaaaggttctggggcatttgttaacttgaaagcggcatttacaccctttcatcagcctaatcatctccactcagtcctggctggtggcgcacggcctcagcttcccaggccggggctcgcttcctcatttgacgtgataagaagccaggctctgaagtgctaaatggtgggaaggggaggagacagaaagtcagggagagaaagaggcagggagacaagaaccagagacacacagagacacacagaagggaccggaggccgacagcgagacatgtacatagaggagagacatggagaccatagaggaagagagattatgtgtgtgtgtgtgtgtgtgtgtgtatgtgtatgtgtgtgtatgcatgtgtatatgtatgtgtgtgtatgtgtgtatgcatgtgtgtgtatgcatatgtgtatgtgtgtatgcgtgtgtatgtctctgtgtgtatgcatgtgtatgtgtatatgtgtgtgtgtatgtatgtctctgtgtgtatgcgtgtatgtgtgtatgcgtgtgtgtgtatgtgtgtatgcacgtgtgtatgtgtgtctatgcgtgtgtgtatgtgtatgtgtgtgtatacatgtgtatatgtgtgtatgcttatatgtatgtatgtatgcgtgtgtgtatgtgtgtgtgtatgtgtgtgtagagcgagagagagagagacaaagatgaggaagtgacagggacagggagagacatgggcagagagacagaaagacacacacatagaaattgagaagtgcagaaaaagggcgagaaaaagagaaatctagagaagcagagggcagagtgatggagagatggagagactgacctgtttgcagagactgtgaatcagacaagaatttcagaccaaaagcagaaaaggccacggagacccggcacatagggcccgacaatgacagggtgttagagagaaagaccaagtcaaacaacgaggaaaagagatatgaaggaggagcagacgctgcaagatggaaagatggaaacagctcgagggggctgcagcagagagacagagaggtgggaagggcttccatcagcctggccctgcccagctcaggggcagctggctctggatcctctccagaggctggtgtcacccctgctgctgggctcctggtggcccccaggcctcggcacccccggggcatccacacgccgagggatgggggataacgagccagttcccatcctttttccctgtcatggcccagagctctggctgagttgagtgggcagcccaggacctcatccccatggacaggctgggccctgggctgcatcttctgggtcagtccccaccaacaagcagagcaaattgctggaaagtcacgaggacttctaggggtccagcccatttccagaaaaagaagtaaagaaaccagtttctcagaggcaatgaggaaaaatgctggtctctttcggtccccatgggggcaccacaaagggagcaaggccccagctggcccagttggtctgggctctggttgggactacggtggggtcctgagaccctcagagagtcatacagtcatgcactcagcctctaagctgcagaccgagccggccttactctggagttcggatcacataactgctcagctgccctcttcctgctggtgcccaagaggaccctgcctccctgcctagtgccaggcacgggagctggcctgagagatggccccagggctgtgctggtgtctgcaggcactggggagagaactctgttttctgagtagcaggtggctgactgtgctggggagcctgttctcccacattttccctagttccagacgggggaccacaaatccaggaaacctctgctcctggtgcggtcagcctgcctgcctttcgtggggaattacaagggaagtgccctcacttgtgatctcaatcccagttgtaaggcataattcaagtggtcacaaagatggggttacaaggaatagccacgagaacgctcctcccacccccagaaccccgtgacctctcctcgaagctgcaccctagcttccagggcaaggctgaatcaggagttccagccctctttccatgcagggctggctggctgatctgggcgtccgtgggaccctacctagagaacatggacactcagggaggagcctgcatctcgccgtgggttggagaagtggaggtggggcagaggagcttgggaatcgccaccggatccaaacgcattgctggcccgtgccctcgcattataaaggccaacgctgggacgtgagtacccaccccaagtctggtttgaggaggtgagtgccagtcccataggctcaagggacccgccacagaacttggggggctgttccaggaggcccttccctcacctgggggtcttttctaaagtgatgaggtctgagaggcagggaggtggggcacacacctgttgtaggaccttcctgctgcccgatgcctcatcacgcccctgccatgatcagctcactcgtaaggctgctctcctgcactttcccttcctcttagcatcgtctttggtgatcacctgccccgaagcgattcacaagggttccacactcactggccatatctgcacctccaccccaagaccagaggtgcccaagcttctttctccacttctgctggtgtacagaatatacattttcaggagtctgccaagctccagaggtataaatagtttatgtcatatccaactattaaacatgattttaatctcacttgtgatgtcggcagcataacttgcaggagggcagctttgatgtagctggtggaactgagatcacattgaacagatgttacagctgagagtctgttagtgtttccatccgcccgtgtgtgcgtgtgtccatgtgtgtgtgttttcaggggaagtattacatggaggagagggtgggaaaagagagaatcttcatgactcagtgattttgtagcacattcatttgaaacttggcagctggacacagagtccagatgtggtgaggctttgggggtgttaagctttctctcccattactcaatctgagggctttgtcttccgttgggtaacatatgaagaccaagagaaacaaacaacaaatgtgcttttgctgagtttggatgcttcttggttgactgagaaaatgagcaggttcacaaaggcagctctgatgcagcccatggtgtccttagtaaacagttggatgctgactgaatgaacaaatgaataaatggaggaggagcgggagcaggaggagggggaaggggggagggagcgggtggagaacgtgtgctttgcttggcaagcacatacaagcaccttcaggctaggggcggtgagcgcggggacaaatggatgaagatcccttgcctgttagggctgtggggacacctgatgaggggcaccactcacctatggctctgcgtcctgacagcagctggtaggtgtggggcactcacaacgtgtcagacactgcgctagggggcttgacaggaaggatttcatttaatcctcactgcaaccttaggaggtaagcatgattacttccatgtacagaggaggaaatcggggcacaaggaggttaactaaccgggtcagtgccactcagtaagtggcagagagttcaaagcaggaagaatgctgtggccttcaccactacccagtactgccttggacgaggctggtctgggaaactgggctgctgggccccaagtgtcactctgacctcattctgacgcctcctaaggtggctgagatgtccttggaaaggaagccagaaagggcccagaggcctggcaagacccagtgtcctctggatgcagactgtcacctgcaccctgttgaacgatcttctgtgggcatgagtgcagaaggccgggtgggctgtggttaggagggcgagtttcccgttgcctggagaggttctcctggggtaatgcctggagcaggaaactgcttcttcccacctctccctgccaggacctacgctgctgtcgcagggggccagctagattgtcacttttgtccaggagtctgtaacattttgtacaggcctcctgatcaggttggggacaggctggggaagaagcgagggtggtggtggtggcagtgaatcgaatggcagcctggaagtaggaagcttggatgctctgtgtctcccgccctctccccttcctgatttggattgcatctggacagagagctctgatccgtggccagtcctcgggcaagaaggggccttggatgtcatttggccaaatcagacaaggaaccagagtcccctagggtgatgtgacaggcgtaggcccagcccacccatgggttgtggagccgtcgtggatgctggactgcatggctttgcggcatctcaccttttccagtggggcttactgctccatgtggctgctcaccacacaggaggaggcggtgctcagacccaggacccaggccagggccagggccagtgagggggaagagccgagggtcggagattaaggaggcctggcctcactttcagggccagccctgcttgcactgtgtgccccgggacctccttcagtcaccctagctctaggcttggccagagctccgcggccctggctgcttgtgaatgaggatgccagaaggctccttggtacaggggtatgtcgggggttgtaggggggacagagatgtttgttaatagctggtggcaagacagtgaagataaagtcccccccgccccaagaactcagcctttgtgtgtgggtatcttgagcctacctgaggttttcaaccatttcttctgccctctggaatctaaatggtgtctgtcaggattctagacactggctgggaacttctgctctcagctgccaagatgagctctcagaaccttaagacctggaccccatctctggactccaggtccctggagagacactcggagcccagaatccacaaggcttagagaaatcagggctgttaggaagtgtttttaaatgcacttgctttaaaatgagtaaaaggctaaggaggacacgaatgccagcctgcagctccagccttgaaattcagagcccaggacagaagcagccacctgcttgcagtagcgttatgtttggcggcagggaggggatctcagaggagagaagtccacttttgagtcctgactctttaaactgaactaatccagtcttgagaggaaggcccctggaacaccttgctgagctcttcttggttctggggctgacaggcaccttagggagacttttaggagactttcaggggtctctgttaggtggttgtgggatgcgatgctggtggagccctgaagcatcataactgtcaacatgaatcctaacacgggccaccgagggctggctgggcaggagtgtggagaggatgttaccagggtggactctggaaatctatgctacctaagtggtcttgggcaagttaatcaccctttcggtgcctcagtttcccacggtagggaccacagttgcaccttctccaaacagttgttgtaaagattaaataaggccaggcgaagtggctcacatctgtaatcccagcactttaggaggccaaggcgggcggaacacttgaggtcaggagtttgagaccagcttggccaatatggtgaaaccccatatctactaaagatacagaaattagctgggtgtagtgatggatgcctgtcatcccagctactcaggcaggctaagacaggagaatcgcttgaacctgggcagcagaggttgcagtgagccgagattgcgtcattacactccagcctgggcaacagagtgagactctgtctcgaaagaataaaaaaaagattaaatgagataatacatgtagatttccttcttcttgtccccttgatcaacccttccatgagagtggctggtgcaccctctccagagcacagcgctgcttgccaattctgaagcctggggacccttcaaataccagcatctccactcagacttcccctccaacagaggggccaccggctaggccagcagaggcagcagctgaccgtatttattggtgtgaaagtcccaccttgtacaggtgttgaaatgtggcctgaagatgtcctttgcgaaagaccctcatctgtgaggttgcatctcatgacagtaaggaagacaagatggtccttcctgtccgtatctacaagctggccaatccacagagctgcctgacccatttcctgctatcagatgggccaggctatggtcagggttgctgggtgtttcaccctgggcctggcagggctgggttgggggagggggtgggtactcacgctggatgtcaatggtgaccgacgtctcctttcctccggggatggctttgttggtggcacgacacacgatgctctggccattctccacgtcaccaggggagatgaagagggtgctgacgatgctctcccgcttgccgtcccgaagcagggtcttgggagaaagggaaaggggagagaaagctccatgtcgcttggctggggtggccagcctgggttgggggtaaacgagcaccagcttagacagaagggggagctgtggatggaggggttcagcttaggagacctgggctgcccatgtctacgcagagctcgggggttaccccctggctccctggcctggctaagtgctgggctgtggaaggaaaaaggaactagacagttttccaccatgtgaaaattagcctggattcacatgctaaaagcacaaaagaaagcaggatgggtttcatggaaaccaggcttcagggaggtcccatgttgaaatgaactcacatctttttgcctctggtgcttgagtgacagtctcaggctctgtaggaagcaacgagatggtttgcaaccagcagggactgtggcccctgagcggggacagtctgcagaggaggcacagtttggggaatgggagtcagagtgggtggggatatgggcagaatcagtgcacatcaacctttcgattatttgcctatataaatcctttcaactttccaaagcgtttcactccctgatctcattagagtctcaatcaaaccataggtgggacagataccattatctcccattggataggggaggaaataggtgggctagacagaggctatggagcttgaccaaactcacatttcaagttggtcctgaaataagtactagtctcctacagcaggttgaatggtgtcctctccaaattcttgtctaccaggaacctcagaatatgaccttatttgggaatagggtctttgcagtttagttaagcaattagtaattagttaaggctcttgagatgaggtcatactggattcagagtgagccttaaacccaatgactggtgtccttggaagaagagaagagagtctgctgggtgtggaggctcatgtctgtaatcccagcactttgggaggctgaggtgggaggattgcttgagcctaggacttggtgaccagcctgggcaacataggaagatcctgtcactaccaaaaaaaaaaaaaaaaagaaaaaaattaaaaaaaaattagccaggcatggtggcttgtgcctgtagtcccagctacttgggaggctaaggtgagaggatcacttgatcccggaaggttgaggctgcagtgagctgaggttgtgccactgtactccagccagggccacagagtgagaccctgcctcagaagaagaagaaaaagaaaaagaaaaagaagaaggagaaggataaagagaaagtgaaagagaagaggaggaggaggagaagaggaggatgaggagaagacagagagaaacagagaaggccaggtgaaggtggaggcagagattggagggatgctgccacaagccaaggaatgccaggagctgccaggagctggaagaggcaaggaaggattttcccctggagcctttggaggggcacagccctgctgacaccttgattccagacttgttggcttctacagctgtgagataattgatttctgttgtgtcatgcaccgaattgtggtgctttgtaatggcagccctaggaagcaaacccatcttaactgctggtctcccaccttcccaggtcattgcttttctctactgggccacaatgtcattccgaagctagttccccattgtggctgctacctccttccctctcctgttcctctttgcagctacttccccatcactttggggcgcactaagtcaggtgcaccccggggagggtgtgctgagtgtgtgtgggggtgcacttccaggttgggattggggtctggtcagtatgcaaaggcttctgctactaggaggtactaggaaggaacctcactatgggtgcagtcctgtttcccccgactggagccagggagtagatgaacagaccactcctccctcaaaacctcccataaagtgacaatggcaatgtctctaattcttatgagggccccggaagacagcagcattatctttgattagccaaagagaaacctgtgttccaagtgagccgggaacttgctgggtggagctaggatttgcacttaagaatgggtgaaccctgagccacagcctctgctgcagccccgggggtgctggacggtgggtaccgtgctcttggcaggacagatgggaacagttagggccacagggagaaacctgtaagctcctagaaccccacattctgggtccttaattcagtgaggtttttctcaacttggggcaaacctcgtggcgtcaggagaacagggccagagcctctatatagaacagcacatcttgctggaggcaaagccggactgtgacattctagagagccacgcggtgcagctgcaggcctgggactcagggtgccagccacggccctgggcagaggggctggaggagagtgacgtggccagatgcagcaagccgggggcaggaccactgcagaggagtgaagttgaaccccaagccaaagcccgggcagggagggagcagcagctggcaccgctttaccaccctgccttgggctcttcagcagacctcatcgagtctataaatagccaagtgataataagaacaatttcctggatgaaactaagacttcgggtagggcgcgcaggggcggggaggtggtgaggagcaggttggtattcttcttctcttctttacatttccgttgtgctaacaagggacatttacataagcttgactctgccaggagcccttccaacggatgggctctgggcggtgggtgccagtggcaggggagggaggggacccagctctaattaggccctctgactgctccccctcctccctgcacccagcgtgctcctccgcctcggaatgatgattaatgacatatttactgggtccaggcgtgtgcttttctgggaaataaaaattctggttcaagttgtttgttccacctaattagagaaaaagggagatgtgttcattaaacaaaaggagggtgaggggaaggcacgtgccccagcaccaacaccctctctgtccccgtggaaggtcccagcacctcctgggcccctagctcgcgggggaccccaggccccgtgcagcgggtatcccagggaggaaggctgggtctgccagctctgctgcaggacgactgaggggaggaaggtgggacagagctggggggcccagggggaaggctggagggagccctgcacctgcaggacagggcgggatgtggaggggcacgggggatctgcacccccgggtttctcttcccccattcctttctgatctcgcctctcttgtttcttttgcttcactccttttcagaaatgaatctcccctaattgtcacttttctcatatgcaaatggagcctctggactttgcagccttgaaggtactgtccaggagaacattctatcatctgcaggttctagtcgcagctccactccgcccctcccttccctgcttcccttcactgagcttggctctggggacacaccatgggcattgaacctcccacctcctgcttcagaaagcttcatgccttgcaggtgagctccagaaggaagtgagttattcatggtgggccactcactgtgggagccaccgcctccaaggcctccctccagtgtggtgagcactaacgtgctgccagcccccggctcgcccaggttgcccatgtgactgccatggtggctcccaagagtccccgaggacccagctcctgtgtgtgcagatatgggccaggggcaggcatatagatggcgtgtgtgcagcatgtgtccgggaacgagcgtgccagggcatacacccccgtgggtatgtgcgcgtacctgtttttgtctttgggtgttcatgggcctctgtccactgactgccgtgactctgcggggccccaggttctctctggacgctgcctgctcaggtgccgcctcagggctgtgcacccacccccactgcccctccctaagggcagggatttggcactcacttctctagttccccagcaccggcctgggaggccggtcttcccaggtatggttgtacacagtgtaccccaccccatggttttcctgcttgggtggcagtggctggccactctgctctttccaaagcccccagggcctcctctgggcagtggagagccaggctgagctctcggaaatgggtgggctggagggcagacaaggggtgggggcccaagcactggtgctaaatatggggtgcccgatgacaggcaaaccgtctggaaaggccgagagtagcctgattgcctggcagcaaggccgcctcgcttctccccgctactcaccttccccacctgctgggtccctttttttttttttttaaaaaatcatggctctgcttccccttttgatagctgcttggggctccccatgggctggttgccacctggcttgaataagggtgtgtgggccaggtggaggatgcgcagtgctttttgccccagtccctgcatccagccttgaggccagaggccagaggggtgcccttcacagagaaggccaggatgagcctcggccacacccagtggagactctaggcccctaagctgggcagataggtgcagggtgatgggtgagtgaccagggagggggtgcccagtggagggtgagggccctatgcatgtgggcacttatccctttcctgagtggggtctccagagctcctcttagcaaaggtggtaaaaggcgaggccagtggtcctggtggtaggggtagagggcaaggggctccaagcagacacagacacgactgtgcgtgctaagaccttgcaaccctcctgcctggcaggaagctgcacttaggaagggttctttctgggctcagcctgtcctctcgcccctcctcttccgtaacccatccttcctcccctgctgtgtggacttgggggctttccagaagaaagaatgtggtctccactctggcgccaggccctcagaagtatgaggaacagggaaggaacccactgtccccagacagcccagggttgagtctccaggaagaagcttggaggggccttttcctgctctgtgcctctgcagccgacacccgctgggagcctgcagtgggcactgcccaaggccccatccggcagtgtggctcgccctgcaccctggaggctgtgacagtggcctgttaaggagaagcatggccagcctgtgctgggggagggactgggtgcttcctctcctgcccttcctcctggggaaggggcctggtgccctccagggctgaggctcatccctcccctactggtcccatggtggagtcacagagagaatggtcggtgagcaacccagaaactttgagaacaggcctggtgttttatgaaatagctgtatgacccctggggcagggaactggggttccccctgtgggacaggagccaataatagtagctcacatttatccagtccttactcctgcccttgacagggtgcttctgatgcataatttcttgtaagtcactctgcaaccctaacagacatccgtgatcattatcactgcattttgcagctggggaaactgaggcagagggtgacatcaccatgttatgttacggatcccaggtttgagctaggccttcagaaccatgtggccagcctaactatgacaccgatgtctgcatatgggaaacgcgaggtccatagtggggtggaccttgcagccgtgtggatccagtgagggggtgacaatcccaacagcagtgcttgttgcaagctcgctatgtgccaggcgtgtttctcattcaactcctcacaagcaccccttaaagtgggtgctgctgtcgttcccattgtatggcaaggacagggaggcacggcaaggtgaggtcacgcagctggaaggtggcagagcccggatccaaattcaggctgccagctcctgagcccacggggataatcatccaccatgtgacagccactgagggcgtcagacccgacagcagccagggctgccctgaggggtcttttctggggtccttggaggctgcctgattttgtgtgtgctcccagcttctcttcctctctgcggctgatgctctggcccctcctcatatgtagcctctctggggaagtcaggagtgctgttggcctatggcagggctccttgcagccctgggggaggagggggtgggctgggtccctgggaggggaagcagaggggttggctcggacagcccccagagcctgctccataggagccctggattgtgtaacctactgggtatactccacatcacaggcttgtagcttctccctgcccggcacacagccccgtgcctggggaagctccactgacgtgtgcgggctctgctggtcacccctttggtctccatgagaaccactggccgtggggtggacagttaggatggtggatgaccatggtttggaggagaggcccagagaaatgaagtgccttgccttgggacacagggcctcttcccatgctcatgtccagggacacattgagggtctcaggcctctgctgctccctggacaagccacagaggggcaggagaccatctgaggtgactgtcccctgaggaatctgtttctcttccggagcgtctgatccaacaccttcattttgcagacgaggaaacagatgcccagggagtgagttgcctgaggttatgcagtggaagctggaacccaggcctgcgactgcctggcgctgccgttcccgtcacaggcccaggagcatggatcgggtcccccgccctgctgtgcagtagtatggtaccaggctctccgaggggccttcacaatgtagacaaggatgacatgttgagctcaaggtgatcctgggacaggtccagcagagtgaccctgacctctctctccacctgatggcatgtgtcctctgcaggacattgactctgctagggtccaggctggcccaagttcagggagggacaggacaggtgctcagactggaaggaaagcccctatccttccttttcattctcctctggacaactctctctctgtgttatatccttgtattacataacaggacagggtggcttcagcccaggacataagggagaggcttgtcttccaagaggcagccatccctccctccccctggacttgtgtctgagggaaggagtttgccctgggttctggcaccaggtgctgggttctttgatcggcagccctggagtgacctcttggcaggtggtcagtttgggacaggaaagacacaccctcagagtggggacgggcctgcctcacatcctcggatgaccaaggccctgcttatctttccaggattgcttagaggactggtgggtagggggaaccaggccgtgtatttccccagtctctgaggacaaggaaaaccctcagacctgaggcgagcgggcgttctggaggctgggcccccagctgcggagcttgggggaccggcttgccctaggaggagcatgggcaagggcagaggccagggtgtcaggaattgtggttccaggcctggcactgcccactccaccactgagaaggacagtcacttccccaccaggcctcaattttctagctgcagacaaaagaggttggcccaggtatactgtaaggcctcattcatcttagaggctctgtggtacattaaccccatctgggactctatgcacagttttgttgagtggagtttggtgggggctgtttaaaaatgtacccagaattttgtttttattcaggtagagggaggccaacagatcaggagacaactgccgttgaaaagacagtttgcggccgggcgcagtggctcagtcctgtaatcccagcactttgggaggctgaggcaggtggatcacctgaggtcgggagtttgagaccagcctgaccaacatggagtaaccccgtctcttttaaaaatacaaaaaaagaaaaaaaaattagctgggcatgatggcacacgcctgcaatcccagctattctggaggctgaggcaggagaatcacttgagcccaggaggtggaggttgcggtgagctgagatcacgccattgcactccagtctgggcaacaagagtgaaactctgtctcaaaataaataaataaataaataaaataaataaaaaataaaaaaagaaagaaaaaaagaaaagacagtttgctactcatagttcccagaggaaggggaggccccagggtcagttggggctggggtgggaggtgtggggagagtgtgggcacagcctctgttgtggcttgctttcataggaaggaatggtgaggtagggttggtggctcagcaggtttaggattggatagcttgaataatttccctgggccctgagctgtaggggtggtctgatgtgtggccctggggagatttagggtaggggtataatgtcctggactatggagcctgatgaaaaaaggctgtgggggcctgggctctggattggttggtctgctttgatataaagcctgcttgctatctccaggaattagcttaccctggtccttccctgggtctgcaaggccccagatgtcaaagcatcataaaatacacaacattttaaagacacaattaatacgggggccagttcagggtgcttccagcccttggtatcgtgtgtgaattagagaccagaacccctgttggtagacacagcagggcaagggctgttgggtaagggatcatgggctggatttcagccctccctggcccctgagccaggcaccttggagatggtggagcctaaacggcttcacctggcagccctggaaagtggccagatttagcaaataaaatacaggatactcagttaaatgtgaatttcagatatataatgactgtcttctttagtataagtatggcttgtgagtatgtccaatgcagtatttggaagatacttacattaaaaagttattatttttctgaaactcaaatttaactgggcatctgtcttagcccagctgggctgctataacaagatatataaactgggcggcttataaaccacagacatttatttctcactgttctggaggccgggaagtccaagatcaacgcagatttgttgtctgttgagggacagacacctggttcatagatgccctcttctcactgtgtcctcacaatgtggaagggacaaggggtctccctcaggcctcttttttgtaagggcactgatcccatttatgaagctccacccccatgacctgatcatctcctaaaggccccacctcctcatacttgggggttaggatcttgacatagaaatgttgggagccacaaacattcagaccgtgattgcatcctgcattttatctgcacccctagaacctggccactactgtccctgagtctcctcgtctgaccatggcctattgttagggtcttccccagcagttaccctaggacatagaggagagagagagagagagagagagagagagcacaagtcagataaaaggatggacacacatacaaatgagtaggagaaccacagcatgaatgagaaaaagtgacacagagtgagagagcaaaaaaagatacaaggagacaaagagtgagagaaaccaaaaggggcaggagagagggacagctgcagagagacagggcagctggttccctccccatccagcccccattatcccccctctacctaagcccagcccctccccagcagccccccaccatcctcctctctacctaacccccagcccctgccaaccagccccccactatcctcccctctacctaacccccccagcccctctccccagcccccaccatcctcttctctacctaaccccccagcccctctcctcttaggcccccatctagccccccgcctaaccccctctctacttaacctccacccctcctagtcccctcctaatccagcccccgctcctttagccccctccttacctagcctcctccccatcaactccctgtccacctagccccctccccacccactccccttgaagcccgtccacacccaccccctcccctccaggcctcaccttggagtaggtggccccattgatgacctctccctttcgcaaccagatgatggaggctgcaggcttggcattgtctgcgtggcaggtgaggttgagagggtcccccgcacgcaggctgatcacagggccccccaggatgacggggtcatcaggcggcactgcggggagagaagcagtgaggtcaggccgaggctcccacctcgggcaggacggcaggcaggctgggaggattttgtggagatggcaacaaacaataattatcacacattaataaaacgcatcgtccgcttgtatcgtaatgatgagagcagcacccacagtgatccctgacatgtgcactgcgtgcttacagtggaggatattcctgccagtcatcgcatccctgctcaggacctgccaggaggggacagggccagcagcctcagcctgcactcccagacccagaagcagagctctgtggcccaggcgatgtctgtggctgctttttaacttctttttccttttttcgagatgaagtctctgtcacccaggctggagtgcagtagcatgatctcggctcactgcaacctctgcctcccaggttcaagtgattctcctgccttagcctcccaagtagctgggactacaagcacgtggtaccatgcccggctaatttttttttttttttgtattttaagtagagttggggtttcaacatgttggccaggctggtcttgaactcctgacctcaggtgatctgcttgccttgcctcccaaagtgctaggattacaggcctgagccaccatgcccggccaacacctggttaatttttgtatttttagtagagatggggtttcaccatgttggccaggctggtctcgaactcctgacctcaggtaatccacccgcctcaggctcccaaagtgctgggattacaggcgtgagccacggcacctggcttttcttttttctttaaatgaagcactgtcacacctgctgtctgagttagtcctcacaacagtctggtgaggtcaacattaccaccccaatgacacagatccggaagccgagttccagcaagattagtgactggctcaaggtcacatggtggcagagccagggctggaggccaggcccagggaacctgggagcaccaggccggccccttccctggcagggagcagggtacagggcagcccttcacagtggagccagcgcttcggagggctgtgtaagcgctggcatctcctgagctcctcactcctccagagcggctccagccccttcatccccagaggcagcctgattctctcctgtcccagccttccactgcattttgtagtagggtcagagacgggtggctcccatcaagggatcctgagtgccaggaagagggccatccgcgtcggagcacggtctccgcagtgcccagcacagagccctgtgctggggaaactccactgacatttgctggccccactggggtcaccctttgattccgatgaggaccatgggctgaaggatggtggatgatcatggtttggaggagaggcccagaaatctgaagtaccttgcctaggacacagggcctttcccatgcttgtgcttggggacacgttgagagtctcaggcctctgctgctccctggacaagccacagaagggacaggaggtgaggcgactgtcctctgaggaatccctgtttcccttaccccaggaggagctgggcccaccagctctggaggctgagagaggcccagggcctctggacacatcaagacgtgagctgtctgtgtacacagcaaacacagaaggggtagttggataacgggggcgtgggaacctagcacaaagggtcctctctgcctggtggccagagaagcccgcccttctatgcaggctctgtgctcggggctctgggctggagaagttcagagctgaacagtcacagctccgggcccgtcctgactccactggctcagccttccagcctcagcctgcatgggaacttccctccccttctcaggggatcgccccgtcagcccttctcctagtccactccggcttctgtgaaagctccaggagggacaggaagccccagtgggggccggtaagaagccaagaagcaaaccttcagaacagctgccttgccctccctgcccggccttggaggcctgctcccacactaacagcacagcagtgccatttcctgaggaacaagcaacctcccagggcttccgagaagccatcactgaccccaggggcagcgagccccggactccaccgagatcctggctcaggaacagagtctgcctcaggcaaccctgcctggccctgggctcttgagccgggaggaagcaggcatgaatgggatggatggagaagacgaccccccagccgcccaccccacaccctttcattagtgcccatgggcctccttggggtgggcctggccacagggcaaaacggaggcggctcagggctttccaccaagtgggggtgggtgcaaccacttgtggaggaggggaattgcatctccacgcggtgagtgggggacttgcagcaggaagagcagggctcagaggtggccagccttcacccttctttcttcaaggcagcctccccgaccaggatggaggagctcgggctccatgagctagctgagggcctggaaaaagagccacgtggagccctggggacagcctggatacctggggcctcagccttcccagtgactgtggaaagtgcctgagagcagagggtggagcaggaagccccttctctcagggtggcttcaggtgcaaacgtgagagctcggaggatctgggaactgaccgctctccagcacggacatttactgggccttggacaggggtttgaagccttgactgcatgctcctctgcagaggttttaaaacctcactgcgggccacaccctgagcagccaagtcccagtctctggaggggaccccaggcatcaggactttggggagctccccagggggtcccatggcaggaccagctttctgggctctggactctgggctgaggggcaggagcctctgcttgctctgagcacagtgcagccaccaaggccttcccgagaatccaagacccagaggacgggcccttcctccttgtggctggagtgttgtgttactggaatatcggattagaggcagcgaggacgagggaggagggagtggggcgtgttgtgggagtgctcaggcacacgcacagccacgcacatacatccaccctcagaatggggcctgattacatcttcccaaataagtggttatcatgctgggtattcatgtagccaggcattattgattggtcttcgcttcactgcacaccagatgggggtgggggctgggggggggtgggggttggtgaggatggaggatgtttgggggccagcaggctgaagagaaatcagcagtcgctcttggcagctgtgtctggcgtggaagggggctcctcattacctccccattcagactcggccaggctgggccaggcagtggcgaggggaggaagtttcagagtggtccccgcttggagatgtattattcatcaccccctcgcaggattggttattatcctcaaccactatagagtttgggcttctaatttttaatcacaaggaaggtggaggcgttagccttttcgtgattaatccggagataaaaatagttgactgttttggtgttgtgcttgttgtcagtcaggaaaaaaatggcattaactgttggggcactgaagcctggggaggactgagcggatcccaggcagagtgggtccccagagctggaagccagcctaagaggccacagcgcggccttagccgggggtggctgagcgacactcctgcacccagctggctcctggggcattgattatgaaagaaacacatcatcgcgggatgctgagctctttacagtttactctcccattggccaggactggagcaggcagcttcagtctccctccctgctctgcccctacctgcccagctctgcagactttgccttgtttgggtgggcggtgggggtacccgtccctttccctgtgtgtgggagggagcccccaaaagctttccccaagttctgctgccaaagacaatggggtctcgggtggacaggtggcatggggagagggaaattgaggccagagagcacaagaggctgacccaaagttaccagtgacgagagcaaagaagggtgagggtgggcttgggacgcacatcctggctgtaactggagaggtaaagctttcatctatttcacgcactaaggttctctctaacctctatactcccctttttttagagacagtttgccaggttggccagcctcgtctgagcaggctggaaaaactctcttggtgccaggacaaggacagcactgagggaatttcctccagtgtccacttggtcacccaactgagacctggctgggcttccaggaattcctcgatgctccatcagcctgggatggttggtctctgagcatggctgatcggtggcagctggaggggtgggggaccagcagcaccaccctcctgcccccatactgcatggtggagaacctcatagacacccagccctttggagagcaagactggttctcatttgactcaatgagcagcgagttccccacaatgctggcagagtgggtctatcaccaacaccaaaccctccaggggcttcccgctgaaggagagtaggtgttgcctgcaagcaccagcacttacggccctcgctgcccctggggcctcggtctgttccaaccactccttacacagcagaccctggccccactgcgtctctgctgctcagcaaacccagctccttccggggccgggcttgccctgctcctctctgtctgtaacgctctttcctgttcctcactctgctggctcttcccgtcaatgaaggtgcagcttcaagagcccttcagtgactctccactacccacccctgcactttctggatcactgggttcatttattatctgtcaccgttctagaaaggacaacaaagaccttatctatcttggtcattgtgatattgctgtatcacacagtaggcgctaaagaaatatttgttgaatatattatttgttaaataaaagaatctcagaaggggagtggggatggggccggggggacggttatcatgggctttggcttctgaggtcagcgttttaaatcttgtgtgtgtgtatgtgtgtgtgtatatatgtgtgtacatgtgtgtatatgtgtgtatgtgtatatatgtgtgtacacgtgtgtatgtgtatatgtatatgcatgtatatgtgtgtatgtgtgtatgcgtgtgtatgtgtgtatgtatgtgtatatgtatatatgtatgtgtatgtatgtgcatgtagatgtacatgtgtgtatacatgtgtatgggtgtgtgtatacatgtgtatgtaagtgtgtgtgtgtatatgtgtgtgtatatgtgtgtttgtgtgtgtgcatgcatgtgtgtgtgcattgggtacagttgggaacgggctgcgtgagtagtgggagggaggagggcaaagcaggagcccttctgaggccagctgggacagcgctgtaggaactctgcgctgctgtggcatcagggttggtgctccctgtctctcctcgagagagggaagcctggctgaggggggcttggtgctgggagctgattctcagcctgtttctccgtggctgctgtcctctgatttgtctggaacataggatgggagagggcggcaggccgagcatggtgacagatcagagacacttggctgagtggggagaaggacgtttgtgggttctttgattttgttctgccgcagacccaggggctctgggagagtcagtgctaggagttccagcactgactacagtggagggaggatgccgaagcctcggggtgcatctcccacaccttcagcatcttctccatccccaggttccccgctgcagccctgcagtcagcctgccatgtgtcctgccctcctgcctccctccctcccaacctttctctcaccagcctcctccatgtcacaagctgaggctatgatagctgagtgaagccatacacggcctgccatcttagagctgatggggaggcccttgccactccaggccagtgcccaagacggacatgtgtgcagccttggcacctcctgggagcttgttagaaaagcagactcttgtgctccacctcagacctcctaagtcaaaatctgcctttgaaaagaccccagacaattcacatacattttcaagctggaggagcgctgctctaagggttccgaggtagaaatcatgacaaactgacaagtgctatgaagggaaggctcactggacaaagagcacgtgtggggacccttgatcccttcacaggctgcctgctcccttcgctcccccggggccggccagagaaaggggcagactgctccctgcttactagctttggagttacacgatcttgtttcagaacagcttcctttgtgtatgccgtttctttagcttggaatgctggcgttctcctggaccactggtcttctcctgggtcactcttacacaccctttgagacttagttcagagggcaccctctctgagcggcctttctagaatctgccagttgggccaagtgtatagggcttctgtctatgatcccacagcatcctgggcatcccctgactcactagctaccacatcctatggaaatctctctgtgtgtgtctcttccctgaaccatgatctccatccggatccccatctcccagcagagtgcctgcctgctgcacagggcacagggtggcatatgcatttgctgagctgaacttgacttgagtcgatcactttatgagccatatgattgtagacaagttatataatccgacaaccttaatcctcttatctgggaagtgagataataaaaatacctatcttgcagggttatcatgaggattaccttacaatatgaaagatacacagagaacattgtaaaaggctatacaaatgtaggttattatgtctaatttttaggaataatatttaggtttgtggctgtgtgaaaagtgctgagccaaggtcctctcattttattctcaatatcttttgaggcagggactattagggtcttcattttataggttaagaagctgagactcagagagggcaaattacttggcaaagaccacacagccataagtggtgaagttggaatttagactcgagattttgaccctacaacatgttctgttggagttagagcagctcccagactatccctgcagctgcagcagcccttccactaacccctgcctttgtcctggccctagagctctgcgaagcgggctctctgcctgtcccagggggcattcagacctggcaggtactctcctcccttccctccccgcagtctgaatttcagagggccccaggaagcatgagcctggctcgcagttggtgctttggcgatgtctgctaagggaacggacgaatgttgtttgtagtccgcccagctctttgctgccttttgtggttttgcccggttctctggttctgggccgcgtgtaatcccagcttccggtttcctcacgtatacagatgcgccacctaatggccacaatggagaactgcaggatgtagagacaagagggagctgacctggttttaagagtcagcttcccagtggtagccgaacaatgtttggagaaattcgtattgagcacctactatacgccaggccctttctaaacactagggacaagaagcttctgccctagtggagtttaccttctagtgggagagacagacaataaatgaatacacaaatacatacataatacaaggttaggtgttgataagtactagaaggaaagtaacactgggcagggaatagatacatcctaaattggcctccgggattccctcctggcttttctccttcctctctggttgttactttttgttttcttcccaccccttaaatgctggtcttccctagttagctcttgctggccatatctcatttgacacactatctaatggaaaaccttcacttttctgtgaactcaactcacatctttaagctgacgaattccaaagaagcatctcaggccagacctctctcttgagctccagagtcatgacccaactgtccacgggccttcgaagctcagcaggtgtgacaccacacccaccgcctctcccagacacccatccatccccatattctgtattttggagaatggccccactgtttggggaccaagtcagaaatctgggggtctttctggattccactctcagtcaccctgtcttgccaactagcctggttaaccctctgaagtatcgctcagatttgtctctttccattcccacaggcttcctggatcagccatcatccttttgtgcttggattacaatagtgcttctcccctccatctcctagtcctctgtgcttttccagagtgactgttacagaagtctgaatattcacctatccagtcaaccagtaattcacccaccatgtgctgaatgtctagcattcctctgtttcaaatcctctgaaagtccctcattgccatctaaatagtctgaacttcttggccactgctgactcttcggccttgcttttcatcacttcttacctcaattcctccttgtggataagagccacctgcatttgttggagtaaatcgcttttccccaattgcccctttccattttttatttatttatcttttttgagacagagtttcactcttgttgcccaggctggagtgcaatggcatgatctcggctcactgcaacctctgcctcctgggttcaagtgattctcctgcctcagcctcctgagtagctgggattacaagtgcccaccatcatgcctggctaatttttgtatttttagtagagatggagtttcaccatgttggctaggctggtctcgaactcctgacctcaggtgatccacctgccttggtctcccaaaatgctgggattacaggcatgaaccaccgtgccgggcctgcccctttccttttgctttgctaacttgaaggtcgggcagcttgggtttgaatcctgggtgctatgtttactggcttgtggccatgggaaaactgcttagcttctctgtgcctcagtgtccttatttgtaaaatatgaattaaaataacaaaaccagattcactgtatagttgccagggtcaaggaagatgtaacatgagaaaatgctttgtaaagggtctgatggatgatgtggcatgttattggttctctaagcagactgggctcattcctttgaaaggcgatagacgggcaggggagctgggacttagaagtcccagattgcccccttggtaaagcagaggtctatgtccttttccctgctttgccctgctgggagctgggtgaagaccctgctgctcccatgggtgattccacgctgccctgcctggcttggcatcccctccctctgggcccccccacattctgtgccaactgaggcacacactgcttatgggctgcaaaggcacatgtgagccccatgtggagcagagagatgagccatctcagctgagctcagcccagattgctgactcacagttttggagtggtttattatgcagtatctgcattcagaacacaatactccaagatatcgcatcttagaagttgagaaaacagcagaagcaaaaagtttactctccaatcccctgccttcctgggcgagagctagctgtaaaaaattctttgacccatctcccctgaaactaggtcatgagatcctcattccagagggatcctgccctatactcagaggaaagaaacggtgtacaggaactcaaagaggaatgcaggcaaggccttgctaagttcttctggtttgttaccatgaggtcatacccccttttttgtccaatcacatttctgcacaactgcccattctttgttgaacataagcctacaaatacacaattttcccatggcatttgggccttcatttctgaaagctcacataaaactttggttaaatacatctgttgcacttttctcttcttaatctatcgtttgttacacgggtgtcagctgcaaaccttgtaatggatgaggaaaatatattactttttctcccctgcagcagcaaaagctaactgatgtaacccagtagtcccctgctgtttgattcagaactgggcccacggcatcaactgtctctccacttccctccgatccattctccctccactatggccaggtgactgttctggaagctcggtctgctgctcacaatgttcaatggttcccactgctccagcacaaaaatcaattcctcatcatgggggccttccccggttctctccagtgaggtctcatctctgcagctttctcctgtgtgaccattaactcttctgtgaggatagcctgcccttttacaaatacacgctttggcttgtgaagttccctttgctgggaatctccttgcctgagtcttaactggctggaatcccagcctcttttcaatcagctcaaaggcctatcatgccttgttaactcttggttattctttaagactcaggctattgtcacctcctccacaaagtcttctctcaatctcaacccctgactctcccacctgcagcctctgcactgccataagaccatgtgcccgcctcagcaggtacatgtggtgcctggcgccattaccacctgttgttcccctgaggctgtgagctccttgagggctggtccttgccaaattctctctctagtacttagtacagtgcctggcatagtgagcacttaataaatacttgttgcctggtgccttgcctgatcccactgaattagaagccccctccccacctgagcacctcttacactggtcctcaccacatctctattgcattgacttgtggacctgtttcaggttccctacagttgcagggtaggagtcctggcgcctctttgcctgtctcccattgcctagtatgttaccttggatgcagtcataaaaaaacagcaccaataatatgaataatagctaacattgatatagggcttaccacacagcaagaactcttctgtgtactttacaaatatcctttaatcctcacagctctatataaggtagatacaatgacgatgcatattttggaggtgaggaaacagccacaaagtagtcaagttacttgcccaacatcacatagctagtaagcagcagagctgggatatgggtagggtttccagacttaacaaatcaaagaacagtaggccctgttaaatgtaaatttcagataaattaaaaaatggtagtgtaagtatgtttatctgaaattcacatttaacagggaatcctgtattttatctggcaatcctgtagatgtgttaattacatatatgtgatttaattaatgtaggtgtgctttccccctcttcagaccctccccgcctccacttaggtctatattaagaagatgtggggcaagatgcaaatgggatttttttttttttttttctgagacggagtctcgctcttgtcacccaggctggagtgcaatggcacaatgtaggctcactgcagcctccgcctcccaggttcaagcgattctcctgcctcagccttttaaatagctgggattacaggcacctgccaccacgcctggctgatattttttggtacttttggtggagacggggtttcgtcatgttggccaggctggtctcaaacgcctgacctcaggtgatccgcccaccttagcctccaaagtgctgggattacagctgtgagccactgcgcccggccacaagtgggattgttaaaggatgtggcatccgatatatttggcagcacaatcgcacagacgtgtctccaaggaggttggggacagagagaaaagaggaacaaggagcaagacgcaggtttaggatgatggcatgtagctcagaggaaggtgtgctggaggctgtttcagttctgctcctaacctgggggtggggggaaccctgaactagctgacttcagaggtcccctgcaaaggtttgggacactgggaagcccacttctcagctggagctcatattgtttaggggataagaagggaggccctgaagtcagagtgcctggctgggcttctggctccgtcattcactggccacgtgaccatgtgcaaattctctgtgctggatgatgttaatgtcatagatattatagtagctgttgtacagggctggtgtgctgtttaaatgagttcatgtaagagttatgcagtgtcttgtcccagagcttggcactgtagtaagaacccactaaattttagctcttagtattattgttgtttatttaataagtaactccacatgggggcagagtagcatattgcatgtgaaatgggcttgtttccacctcttgttctgctattaccttgttccatgcccagccctggactcctgagatggaatggtcagtaccttgcctcaaagcacctttaaaccactagagcgatgacaaggaggtcacagacccaaagatcccacagctgtacaggtctgatgggcagccctgctgcctttaggcaggagaccccaagggagggagggctagtccagtgggccagggaaagggagccaggtgctgtcagggtcaaagtcagcagtggcttggttcgctccttaaattaggaagggtgaatgtcctgtttatatttggttaaaccctgaaagagggtctgagcatctcagggcagagctacttgtgaggagacagacgtttcattaataatgagtagggatgtaagtctcaggctgtatgcagagtggaggaagggaggtgggtagagaagggagctgcagtgatttgcactcaagcagaccagtgtgcctgtgccggctccagatgacagagggtgctacgtggccgccgtctgcacagcaagggtgagagggcttgggagaggccagcagagaagggacagtggggtgggggagtgcatcaaactggagagaggaaggggtgagtagggctggggcaggaaggccagtgtgtggtgctgggtggcttacactcaccctcccagtcctgcggagcgagagactttctcctttctccagcccagctcctatgctgatggctgcaggatgggtgagagcgcttcttaggtgtgtttgcaggaataaccggcacatgcccccttgcagccgctcacaaagctctccagctggtttcgaccttaacctgatttggggtctcttttgctcaacacagctgggttggtgggaaaagcccatcatggtggctgccgtggacttgtataatccatgcttcatggtatggtgggcccttgcagtagccttatttcataggtgggtaaactgaggcataggctggccaaaacatttggggcaagtcacgcaactggcaaggactctggctcagatcctgctgccccaaccactcagtcctaactgcggtaccataggctgtgctagcaggaggatctgcattggttcacttcggtagctttaatagcatcaaggcagccatcctgacccagcaaagggccaggcagggacttggagtgtccccgctggtcccataaatagaagcagaactgatatagttggttttgctatgggctccccatccggtaaatccacctcctcaacgagcctcatagtttcagtaaggacgaaaatgaggccaggtagaaatcctgcctaccgataccctggagcctcagaagtcttagcagaaatggaggggcgcaggaagatggtcattacattaaggggtttaaaaaataagcacaagacattccagtagctttcttttgagatgacagattaggaatactgtgttttgcaggataaaagcatgcatttgttccatatcttggttggttacaggccagcagggcaggcaggaggagggaatagagaggtgaccatgagacagaagggcaaaaattaaaaagacaggcaaagaggcaaagacacagggcggggcgtggggtgcaagtcacctgctcaggaagaagatggatgtggggagacacacacagtcctttgggatggagcaccataaaaccaaatggcagtgttccaaggaaggaaacaagcaaaacactttctctaggcctcttgctacaaacactcatttcagggaatcccagaaaatcactaaaatatacctttcaactttatgcaaatttaccagatccactgtttgccagaatcctaagaggaaaaagtcaaaatccttttccgacctgagccttcttctttttttgttttttctcaaaaagtacaagcttctacatttgaaaaagggcaatatttttagaactcattagatgaaagtgttttaattctcatctacagtctggccttatagttattttttgaaatctcctctgttcctcatttttcacatttgccccattctggggagggaggcctggcctttttaccctgtggggacagtcactggaagtgagcttcctgtctttagccacagacaactccagagtggaactcagcagggagttggccgccccgcactccagcatgagtccttctgtcctgtcctgaaaggggtaaagagaaacttggtagcaccgcagcttccactacggggtgccgctcacagaaggcggaggtggagggagggaatggcctcttcccccagggtgtcttctttcgctccatcactgttgaggtgggatggggctggttttggcactagagtgcttacgatcagaataagccccttattcagaataagaagagcttggttactgggtaaggaggggactgtgggcctcctatgttcatctgagacctattcaccggggcagggagggactcctcatctggctctgattatccctacaattaagtttgctggtgttggtggggatggctttggggccacccaggcccctgcatctccagcccttggtgggtgatgtcaggcaggtgaagaaagggcacagcctttgctctcagacagagctgggaatgatcccacagggtgaccctgaacaagtttatcaaccttcctgagcctcagtttcctcacctgtaaagtggagctaatatgtgcctcgagtaatgcaggattaaaggagaagatgtagtaggtccgcagtcgtggaggcagcctgctggtcagcatgaagacaaaggctgctgctgaagacccactgccttctcttgtgtgaagatgagctgctcccctggttaaggcagagtggcaaggaagctcagaccaaatgcatttgtgcagtggaagagaagcaacatggaaggagccgcggcttccagtgacctggcctgtggcccagggagctgcagatggaggctccgtgagctggagcccacaccctcccaccacccatgagccacacagggaaagcctgctaggtgactgctctcctctggcctctccctgctcctacctgttccccacaggggatccccccaaaatgacgatctaatcaagttgtccctctgcttatggtgtccaaagccccacagcacccaggcctggccacctttgcagccttaccccgtgcccgtctccagccaggaagacgggatccttgccgcaggccacagccacatagccacgggcctcggaccctggatctgtggctctctcctccgagactgcgcttcctttcctttcctgacttgtggacacctacacgatgttcagtgtttgctcaaatgtgccctctgacctccactagactgcgcttaggcatctggagcgcagcagtcagtctcatcctggggtgcatcccagggctcagcctgggacctcagcatggggctgagcaggacggaagctgtagatggatgcgctgcgtttgcggtggagagccggctgcatgggaatcactgctggctggacccgggtgcctggctcgatgggagcttcctaagggaagcagccctgtcatgttcctctttgtctctctctcctgccccagctcagcctgcacggagcaggtgctcaacagatgagcaccccatcaatgatggaagggtaagaagagacgcctgcatcaggtgggagttaggtggggaaaacaaagcttccagaggggatactttgggaggcgcagatctaggacacattgataagcatggagtgtcaactatgttccaaaagcttcctgatggccctattgttactccatcttggattcctgggtcaattttgggagatgctgagatctgtagtccataagggcattgctggatgcagatgtgtgaatcaccataagtttggacccaggacagctggtgtcccctggctttcctgagaccttggacgtgccccttcccctctgcattccccactctccaccttccaccacccctttctcaggggcccatcagctaggcctagcagcccttggatccttaatcacctctgttcttttgctggctctctctgaggcttccctttcagctttgatgagcaactcacttgccatggaaagtgtgttgttcatggcggatcctctatcaaaaaacaggatggtgtcgagttgcagtgggtgcgctgggatcagtccgggttaaaatacgtgggtctcagctcagatctccatccctggcactgtgcaggaatctgggcgtgttagtgctgcatacgttggggaaaatgagacgtgttgcttggaagcagcccatgagctgcttcgaggagtgaacggggtgaggtgtccagtgttgctttgaagtgaaatgttttggatgtgccttaaagtcacagttagctcccatgatgggcattcgtgtttgtggccagaggcatacataatccaaatctggtgtataattgagaatattatttgcatttggctttggaatgcattgtgtgtgtgtgtgtgtgtgtgtgtgtgtggcgggggcgggggaggcaaggcagctttactttctgtgtatgtttattttagactcccattagcattaatttgcattcactggacacagccgctagggagaggtgagcagagctttctccccatgaagtattcttcagcctggccctgtccgtgagccaggttattggaaatagaccatgtaggcctgtgttccacgggtgctcagaaaagaccatgtaggcctgtgttccacgggtgctcagaaatcctgggggctgagatacaacctcagtgaacaagccactgggccagggatgcagagctgtgtttgtggtgagacctgggagcgactcctggactcccggttccaggctgcatggccttggatacgttaattagttatttgagcctgtgtcttcgtcataaaataagagggataataattctgtgaaggttaggagaagttccatgggatggcatttgtgacgtccccagaacagggctcagtgaatgctcattccttttcttgtctctcctccctcctcgtctcccaaagaatgggtctgccttcttcatctcttgcgagtctgggactccaagggccgagcagagccggcagtagcatttggagtcaaataggaagacgccactgcttccttctggagtgcaaggtcaggcagggatgctcatttgctcttaagggtgcagggggtccacaaatgcctgaggatccacagcccacctgcacgaggagggggcgtttggagggtggaggagagcctgttgtctctttggagaatggggcagggctctgtctggattttgggtccatcccgtagtggaaaggggtcctatgtgaacagaagggagggcttcagataatcctgaaaccggaatcccaaagacaagccctgagtctccaggccaccactttctacctgcgtggactctggcgagttgcacctccccgggcgtcagcgtctgcatctgaaagtgggcatggcggtgaaaccacctgagggtcaggaaggctgagtgaaggccagaagcctgtgagcctgaaactctgctcaggtgtccgaatgtaatgtgagcccaaggagggcgggcgcgtgctggctctgagcgggtgctttattgtgtgatgggtggggacacttgctctcagggggaaagaaagcgccctctcttcctgcagggctggctgagaactaattcaaggccatgtgactctggctaaagcctgcatcctggttctctgctcccatctgggccagactgttggactccagtgttgtctgtcccccgagtcgaggtctggggcaggtaaggaggccatatcaggaacacctgcccatgtctgtccccagagagaagacccaggagttcaagcatggtgcagagaagttgagcaacatgcccaaagcagccaagattaccgtttctttgtgctccccacacacagatttggatgtttttctttttttcttttttctttttttttatatttatacggagtcttgctctgtcacccaagctggagttcagtggcatgatctcggctcactgcaacctccacctcccaggttcaagcgattctcctgcctcagctgcctgagtagctgggactacaggcgcgcaccaccatgcctggctaatttttgtatttttagtagagatggggtttcaccatgttggccaggctggtctcgaactccagacctcaagtgatcctcccgcatcagcttcccaaagtgctaggattacaggtgtgagccaccacgcctgggagatttggagtattgatagagggatttcagaatctggacttttattgtctcacttcccttcagtgagccaaagggccccatccttgcttacctcagtttcctccgggcttataaaatggacaaaaggataagttgcagagggccaccgaggaactgggaggatgatctatagacagtctcctcttcactgaaaggggaagatgggctcaggctgcagcgtgagggagtgaggttagacatctggaagaactgttgttggagacacagctggggaagggaggtcaggcctctttttcccaagcctgttcccctacccccgatgagggatgaggtggatgtgacaaggtgacatgaccctaaggcagggggatggacctggtggctctgcaaagcccctctcagcccctgtccactcaagtacttcctcattagttttgctgaagttacttccctgctcccagttagcccctgtccgtccagttctgagaggtgtttctatctgtaggggccgaggggctaggggagcatggggctggagtgggaaggaggaggaggagggatgaggctgccaattgccaccgccacacagcaagcgtcacctcagctgttggaggggaacagccaccaggccatttttatgacttcctatcaaactttgataaattgactctgaaagggccttttcttccaagcagttcatgcctcagtgactgttaatggtgaaatatcaagatgctgagggggctctgagctggaccgtgcagggaggactggcttcttacctgccccgagacccagctctttcctcctcttggatgctctggagagggagggggcaggactagatagagacctccaggcagatggcaaggttggtctccagaaaagacagaccaggggatgagggtggaggaattaagttagacatgccgcagaacttcctggccgtgggctgagtgacccaaaaggccgtagaacagcctcggtgctgcggctaactgacagggggcaggaattggcactgcttgttgcacagcaatttccctgcagggattgacgtggagcgtcacaaagacagtgaggtaggcagtgaggtaggcagagtagcaacctgcctctatctcatggcctctcagggcaggcagcagccctcctggactcaggaggaaagggctcagtggggaccacaggcattgagcccaatgcctctcaggcatcatgcaatgagaattggagctgggctgggcgcggtggctcatgcctgtaatcctagcactttgggaggccgagacgggtggatcacgaggccaggagattgagaccatcctggctaacacggtgaaaccccatctctactaaagatacaaaaaattagccgggcacagtggctcacgcctgtaatcctagcactttgggaggctgaggcggatggatcacgaggtcaggagatcgagaccaccctggctaacacggtgaaaccccacctctactaaaaatacaaaaaactagccgggtgtggtggtgggtgcctgtagtcccagctacttgggaggctgaggcaggagaatggcgtgaacccaggaggcggagcttgcagtgagctgagatcgcgccaccgcactccagcctgggcgacagagcaagactctgtctcaaaaaaaaaaaaaaaaaaaaagagagaattggagctgaacctgaacttcaagtccagagaggtttccctacagcccccctcacccacagcagcctgcatcttctactctgcccccagctggccccgcctgggcaaacacatggtgacagggcagtcgctggcccagagctgcttcattcctacttctcccttccttcaaggctggttctgggtcccggaaccatcctttcctggttcaggctgggtgcaggccgtccagcaccacctctctgactcaaggctggaattagtggggaggtgagtgaggctcttgtctcgggcacaaactttaagggtgtactcaaaaccccagtaatggaaataaataatatcttaatgcaaattaaacaaatcagaatgaatgtaaaaatatccacgatgaggaaaatatcacaattttaagtaaagacaggattagggagctgcagttaattaagaattgtttaagatggtcacttggtcaagagaaatggtcaaaatgccaattctctcagtcgaaaatgagataagcaaagaagtagatgattactattactggtgagttattttccattacagccaggaaagtaaaatgaaatacattctgtttttgctgtaaataaaatatttaagtgtaacataatgttggggattttaatacacctgcttttaaatgtttcaatatttttccaactacttcaatgttctggaaaaaatttaccacttaaagaatactttaaaaatataaatgaggtgcacgttttccctcttgctgcagggtctattgtgacttggcttggtgctgttgctgatcctatctttgtctaatattttgatattttgcttatcatggattttttcacattcatttggatttttaaaaatattgctttaaaatattatttgtctagattattgattctttgggtaccctttacattttgtgcctgagaatgatgcctcactctgaacttagttttattctgttcccagagagggaagctgcctctctatcctgtccttggtggggataaaatggaaaaggatccctcctcgggccctgggacccacctggggcatgttcaggcctgaaactgttttggggcggtgagcgctaggacaggcgcaggctgccaaggaaagatggatgggctcccgaggcccacagacagagacgggcagccactaccgagctcatccatcgggacccctgtgggatgacactcaccttaatcaggccacaagggccccgggcctgagggatgcgggtggcgtgggacggggagaagcgggtgagcagacgctcctgtaggctctaagttggtgtctggagaggagtgagaggttcaaccagggtggctaggctgtgcactggccaattccagtgggcactgagcacttagctggcccctcttaggccctgacctccaggcaagtcccaaggtctgttgctcggaccctgggctgtgctgtgtgtggggaaggactagcaggaagggaggagacagatggaggaggacacttagggcagggcctgcaaactggctcttccttgcctttcaggaactcccagtggctttcccttgtttgcagagtgcagtgtgacccatcagcttgacttccgggccctctgtaccctggcccaagcctctcttgccctctgagccccagagatcctctacatgaacctccctctctgcgccctacctccagcaccctctgacctccctgcctgaccccaggtggttctgctttctccccaaagcctccctcgactgtctgtgttcctcgtctccgctcatccttgctggccgggtttctggttgtggctgttgtgtgtgtggacgtgttgctaggaatgagggcctgagttattgtttatacctggccttcctcctccgggtctagcgccaccccagcagcagatgcctcaggaaggaagcgaccctgttgtgtcctccctgctgtgacaccaggtataagcagaaacttatggtcacagtcaggaccatggaggaggaggggcactcagagattcacctgccctctctgagcccatgtgggcactccctgcccttctcaccgctctccttgtaaaaggcagtgctgtgcagcagcctgaggatcaggacactgggactctagtcctgacactcagcaaatggcaactgcatgctaccaggagctcaggccaaacaccttgggattgtccttgacttgccctttctctcgtatcctaattgctgtgggctccacctttgaaacatgcacagatcatcctttctcagtatctgcactgctactaccccagcgctccagcccctagctgtttgcatctgcatagcccaggcaacagacatgtgaccccagcccctcctatgtctgattgcagagatccagaaccattcagctaagccaggctcagtttcttgacctgcagaaactgtgagagctaagaaatgattcctgtaattttaagccactgagcttggaggtgatttgttatgcagaaattgacaaccagacagattttgcagaactagccagtcaactttcaaaggtactttgtgctcggaacattgagaggcactgtgctgtttgcaaaatgctttctatacacgttcatctttctctttaccagaaccctgaacactggtaaggcaggcattcttagtcctcactttatagatgaagaaactgagggtcagagaggctaagtgatttggacaagggtacacagctgaaaaatgaaagggccagtcttagggcctaggaattcccatgataagttcagtgccttccctgccaccccatggctgccatttcttctcactcccttcacaaatgagaacccaaggtgttggccaagtttggagggaggggtgggtgtgatggaggcaaagggaaggaagaccacatccacagggtcttgggaggtggggtggagggacattcctggagaaggaggctaagtctggggtaggtgtcaagagactgagggctactcttggcttcttgtatctgccaaaacccaaacagaagcgctcagaaatgttggagggcctgcgtgcgaactcaaggcctgaggctgtaggcagggagtcagggctggggaagctgggctcagccaggggactgagacataggtcacaaatctaggagacttctctctggggcctctggaagctggggccagttctccagtgcctcaatgtcccggaattgcttcttggaggccaatgagagtgggcagaactgagcaatggaggaggaggcccacccttgctgtagggaaatggccaaggaaatgcaccccagcctgggaatcctgtcagggagtggggtccagtgcttagccagagcagctgcatacaggaccacacgtgacacagaggcatgtgaggctctgcatgtgcctgggcttaaagcctgcttggctgtgtgtgtgtgtgtgtgtgtgacagagagagagcgagagagtgtgagagtgtgcatgtgtaagagagtgtgtgagagtgtgagtgtgtgtgagtgtgagtgtgtgagagtgagtgtgtgtgagacagtgtgagtgtgtgcgtgacagtgtgagtgtctgtgtgacagggtgtgtgtgtgagagagagagagagcgagagagagtaagacagagagagagagactcccttttccccaaaatgtcaccaaggggggtcattttctgtgtgcctgccatctctgttcccagtcaccagcatattgcaagtcaaagggaggcctttccggtaatttgagcatttccaacaaataactctggtctcccagtgcaccagcctacagtggccgcagggccacaacgcactcttcccagagctgctagagctcacctctgctcttcagctcagattctagttggcatctgttatcacagggaactctctctggatggagatgctcaagctcagagaagtgagcaaactctcttctggttgcacagcgggctctcagccttcccacttctggtaagctgcttgaactgagaagtcactgatttttctcaccagatgaagaagccacgccagtgcacatggatgcatgcctactaatgttcagccccacctccaggtgctctcttggggagggaggggcccctataccggtcctgggtgggagtttagtgtagctcctccttcagtcaccaagcactttctctgtgccaagcctgggcctgagcctggagattccaagaggattaagccatggtctctgatccccagagagtttgtgggcccccgtggaatacacacagccccttcctaaccttcctaggccctgcagataagtgagtcaggcatctggctcagtaaaaagtgtcttctccattttatggacaaggaagcagaggctcagagagggtaaatgacttgccccaaatcacacagccagtaagcctgcttagtagctctactgcatcacactggtctggaccaagctgattgagtgaaagggggcagagttggggtggccatcaaacccctaaaacccgaggaggggaagagaggggtagcacaaaagaggatttactttcttcccccaaaatgatgtcatcagctaagacaaaaagaaaaagaaaacgcccattttctcactccaagtttccccctcattaattttaatctaatttgctcataacattcctcagtaaacagcagcctctctttaataagccaggctcttccccccgaccctgcgattgtgttcctaatcagccagtgtatcaggaaagacctgctgctaattgtcgctaggcatcacactatcctgtctgtcaggtaaggggtggcagcgagagataattataatcagatctaattagtaattataaaagatcccgactagaaattgttttcagttaaatattcccagagaggtgctaatggtctccggggcatgccaagtgtcacagccaggaggggaaggggcccgtgacctggcaccctgtgacgacaagcagaggagactcagtgatgagaggaatggtgtgtccatggggacagagctggcctggcgtcccagtatcctgcttcctgggaggagcaccttcccttctgcacctaaggttgagtccccctcccacaggagcacctgcgtgggccctcagtaaatgccagttcttcacaggctcaggacctcgacgcacggaaacttctggatcattaaagaagctgtgtgggccaggtgcagtgggtccgcctgtaatcccagcactttgggaggtggaggcgggtggatcacctgaggtcatgagtttgagaccagcttgggcaacatggccagcatttaatgcaaaaattagccaggtgtggtggcacatgcctgtaatcccagctactcggaggcagaggcatgagaatcacctgaacctgggagacggaagttgcagtgagccgagattgtgccactgcaccccagcctggacaacagagcaagactccgtttcaaaaaaaaaaaaaaaagctgtgcgttgctcaggcagcatgggatatttctgctggaatcgtcattgcattgaatgggattaaaggctttacctaggagtcccctggctaacgaaaatccattgggtgactctccgccccactttagtgcctcctgcctcgggacttcccctttctttttcatcgttagtaagcatctgcaaactcccggttgccctacttactttctgttaacaggacctaactacccaacacttccctgccttcagattcacgccccataccctgcatggttctgttcctgggaccctcggatcaggcgatgagctctcttaaacacctaggacggctccacactgcccacagccaaattcagatgctccagcgtggctcaaagccctttccactgagccccaacctgttgactgggctgacatccgactacacttgctcaagcattgcacgccaaacatcccaaacgctcacgttagggagtgggggcagggtgggcgtctatctttctgtgcctttgattttgttgctatgattacgttttcattttccagctgctaaaatcctacccattctaccaagggagagttcggtagttactgaagtcttgttactgaagtcttgtgaagtcatcccagattttctgagttgaaatgaacacttcctcagtattgtgcttatatattcgagggcttcttttatcctgcctgggatggtagtgagttgtttatgtcttctccctcctttggcagtaaactccttgagggcacagagggcattttgctatttctgcatcttcccattgggtctgatacaatgcttttgcacatcgtaagcatttaataaagatgtgaaggataaacgagtgaatgtattaatgggaagcttctacccactgactgcactatgatttcaatgtaaatgcttctgggaagccgacctctagttccccaggtccagatccttgaacctgtctttattattagatgctgttgggttgtcggagtacgattaggtggaatttggccagtagttgcaggaatctcagcctccccaaagccacctgatgtgaggctagcgtgactgactgaggagctgtatttttagtcttatttaacttgaattaatttaaatttaaatagccactgtggctagtggcttggtgcatctcagctgagagaccttggagccaccactatgtagggcagcctggagagtccagactcaaagcctgcttggtgtctggtgagcctggctacaagcgactcacattaatttagttgaaaaacaggatgtggctggacacagtggctcatgcctgtaatcccagcacttcgggaggccgaggcgagtggatcacttgagatcaggaattcgagaccagcctgaccaacatggtgaaaccccgtctctacaaaaagtacaaaaattagctgggcgtggtggcgggcacctgtaatcccagctacttgggaggctgaggtaagataattgcttgaacccaggaggcagaggttgcagtgagctgagatcgcaccactgcactatagcctgggcaacagagtgagactttaactcaaaaaaaaaaaaaaagaaaaagaaaagaaaaacagtatatattttcactgcattcttatttttttcagtgctgataccagatcagcatactcataactctgttaaccagaatgggagactaagtggggaaatgccacgctctgaccatgtgaggagttcaagtataatttacttcattcacagcttcttgaatggctgctgctggtctgttgcatttgtccacctgtttgcatctgcatgcggatcccaaatgtcagcctttccccttctgacgccctccacccgctgccgagacatctccgtgtagctttcctggctctgcctctcccagcctcctcctctgggtttcatttccttgctgtgagccttgtgcgaggcaggatatctccagtgcaaggacactactggtggacagctggtccgtcccacacttttctctgcacgtctgaggagtccaggaggactggctgaggctgcaggcaggaagctcagttgggtgaacccaggcaaacccaggagtcagcctggctctggccctagcttgaacgcctcggttgtagttctaaagcctattcatttcctccatgttcacatctttaagaggggaagacggggctgcagagggagaggagccagcttggggcctggggtgcagtcttagagactaaggaggctcctctggggagcgagggtgcccaggtggggaaggcagagcgcaggtcgagcagattctaccgcagcccgtcctgggtcctgttgatgtgctacacattgcagggagcattttcatcccaggcggtgcgtgacaaagctaggatttgaacccaggctgttcaactccaagttctgggctctttaaaatagggcagttattagcagggaaggaacacactgcccactcatctatgacaaatcaattaatttgtccaaattccactcatgctttcaaactcacttaaaccctccttaaagcctacacttgccaactcgcctggccctgggcactgcttgcctctgcctgcctttgcctccttttcccgcttctgttcctagttcaacccccacccacattgtgagctccctgaaggcaggtccatgtctggggtgggccaggtgaggggtggaaaacatcgataccagtgacttacatgcacccaggtgccaaggtaagcacggacgagtggggactggtgggccacatcccgcccaagggagcagccattacataattgtttgcaagcaggcaaacaggcataaactgaccaggtctttgtaagagaagccagaaatcagaatttttttttaatataaaaccccccagaatcttaaacatggataatgaatgtaaaaaactctacagatactccggaagctaaccggatccatccatgtgcctgccctggcctccccttaattgtcagctgctgcatatgaatccaggttcagccattcaaaagttctctgcccacttgaaaagggtctcaccttgggcagatctcatgctgcctagcacaggggatgcatccactcaccgcactggaccagcacaccagctagggaagcacagtttgagagctcctgggacctgtcctggctgtgctgcccacagcccctcctccactcctcctggcaagaggaaacaggacagctcctcctgcccaggcacagtcagaagaagctgtcccttctgggcaggcacacctcagagggaaagcaattcaattaagccctggttcacagcgagtgctaaaaacctccctctggagaaccattttctgctatagatttttaagaccagcagctggagaatcactcttcctttttctcttttggtgctgtgtctctctagtcaataaataagtgggaaataaagtatttgcaagaaaatagaatgcagtcgaaaggtaaattgtggacttaaaagcccctaagagactggcgcagacttggaaatgtttcctagtttgacacctcttgcttctctaagcccagcttctggctctccgatttgcatctccaaaaggtgatctttaaaactgatttccttcagttgcatttcattggtgtagaaactaagcaggctgttgcattacagtaataacatcaacatttcacctgccttcgccttaattatttttctctcttgcgatggaatccatttaataagatttacaggtggcaaggaggtggggtgagctggtgtgcggctcagataatcggccaagctgatttctccctcattgggtgtcaccagtataaaaacatgaactaaaagctttgcagcgcttaagtaataataatgtcagcatttcacctgcctccccttgattatttttcctccctcgttcttgccacctgaacctgtttagataagattgccacacagatagaaaccaagggctctcattctcttagataagctgctgtttttctatggtttggtgtgaaaagggagtgttgctggcagaaaggctctgtctcagatcttcctggtggggggcgtccgagcctgtggatcctgggtggaccaaaggcagcaatggagtagggggcaggtggctgttaaggtggatgtgggcactcgggtaggtaccctggcctgggagcagaggaggaaccatctctaaacatctgctctctcccctagatgcccctaggggatccaggcagggacgaatgggtttcatttgttgagggggaggggttctgattatgcagcactaggcaagtctccagtgtggtataaaaaacatttgggtagccctagctttacaactagttagctgggtggccatggggaaggaacccaacccttctgagccatagtttcctaaaaacaaagaggtggtttgctgtggactgaatgtttgtgatggcctccggctgcagttaatatattgcaactctaacctccattgtgatgatgtgggaggtaattagggttagatactgggaggtaattaagctcatcagggtggaaccctcctgatggaattagtgcccttgaaagaggaagagagagaatctccctctccctctttccctccctctccttctctctctgtctctctctctccttccttccttccctctctctctttctccctttatctccctcttcctctttctccctctccctctttctcccatgctggaacccttaactcaaacttccaggctccagacacagtctggagaaataaatgcttgttgtttaagccacccagtctatagtatttgttatagcagcctgagctaagacattggtctggattatcttaaattttaaactttaaacttttggggacttactgaatgactcctttgagaatgtgaaaccactccccagaaatgtgcacatatattctgaatattgcgtccaagctttgtagggataaaaggccccacaccaaaaaccttggcatcatctgtgacccctctctttctctcatagtaactgtccactatctctgctgctgctattccagcctgagtccctcatctcttctctgtattactgcaagagcctcttaacagaggctcttgtcttcccttgtcctcttatggtctcttctcaacctagcagccagggtgagtcttttaaaatatcactcagatcccatcgatcctctattgagaacccttccatgagtgattttctcttcaaatagaaatttggctctaagatccacagctgacttcgtcacttctatgagtctttgtttacacaaagtcagcttctagaggaaaaatatgaattgacctatatcaagtaaagagattggactaataaaaatcttcccataaagaaagccctagacccagatggcatcattggtgaattctatcaaataatatcaatcctttgtgaaatcttctagaaaatagaggaggaataaacacttccctactcatcctacaaaaccagtgttacctgatactaaagccagacagacataataagaaaagagaactatagactattgtccatcatgaatttagataaaaaccctttaagatattagcaaactgaatccagcaacatataaaaaaagattatatgccatgaccacatgggatttttatcccaggaattcaaggttggcttaacatctgaaaatcaattactgtaatacactatattaatagagtaataaataaaactatattatcatctcaatagatgcagaaaaaaacatttcacaaaacccaacacgatgtgtagtaaaaactctcaacaaagtaggaacagatgaaaacttcctcaacctgatataggtcaccagtgaaacattttctgctaacattatactttaaaatagtgaaagattggatgctttcccctaagattggaaacaaagccagaatgtctgctctcaccatttctattcagcattgtactgtaagttctagccagtgcaataagacaaaaatgcattaggttggaaaagacaaagtaaaactatctttcttcacagacaaaatgctcctgtatgcagaaaatcttaaatttacaaataactattaggtttaaaaaatgtgtttatcagccaggcacagtggctcacacttgtaattccagcactctgggaggctgaggccggtggatcacttgaggccaggagttcgagaccagcctggccaacatggtgaaaccccatttctactaaaaatatgaaaaattagccaggcgtggtggtggatgcctgtaatcccagctactcaggaggctgaggcagaagaattgcttgaacccaggaggcagaagttgcagtgagctgagattgtgccattgcacttcagcctgggcaacaagagtgtaactccatctctttaaaaaaaaatgagtttagcaagatccaacagtcatacacaaaaattaattgtgtgtatatatagatacaccatctatatataatcttagcaatgaacaatccaaaaatgaaattaagaaaatttcattcacagtagcatcaaaaataataaaatgcttagggataaatttatcaaaggaagtacaagatgtacactgagaactagaaaacactgctgagaaaaattgaagacgtaaaaaaataaagaggcattccatgttcatggatgggaatactcaatattgttaaggtggcaattaattctaaattgatctatagctttcacgcaattcctatcaaaattccagcaaccatttttttgcagatgttgacagactagtcctaaaattcatatgaaaatgcaaaggacctaaaatagctggaaccattttgaaattcactgtgggaaaggatagtctttttaaacaaatgatgtcggaacaattggatatctgtatgcaaaaatgaatttagggccttcacaaatcactaaaacttaaaatgcaccaagattaaatataaaaactaaacttgtaaaacttatgggagaaaatacagtagtaaatctttgtgacctttgattaggcagagttcttagagacaatatcaaaaacacaatctataagaaaaaattatcaaactgaacttgattaaaattaaaagtttttgtgcttcataagacaccattaagtaaacgaaaaggcaaactacaaactgagagaaaatatttgcaagtcgtatatctggtaaaggacttgtatcctggctataaagaactcctataacatagtaagacaaatgattctatttaaaaataggcaaaatatttgaatagacattttaccaaagaagatacacaaatggataattatcacatcaaaacatgctcaacatccttattcattaggggaatgcaaattaaaaccataatggataccacttgaaacctgtaacagtgttggcaaggatgtagagaaactggaatgctcatttattgctggtgggaatggatacagccactttggaaaacagcatggcagtttcttaacaagttgagcataaactttccatattatgtagccattccactactaggaatctactcatgaaaagtgaaaacatatagccacacacagacttgtttgtgaatgttcatagcaacaattttttttttttgtttttggtatttttagtagagattggattttgccatgttggccaaactggtcttgaactcctggcctcaagtgatccacgtgtctcagcctcccagagtgctgggattacaggtgtaaaccaccacacctggccagcagcattctttataatagccccaaactggaaacaatccgactgtctgccgactggcgaatggataaacagaatgtggtatatccatataatggaatactattcagcaataaaaagaagtgaactacagatacatgctacaatacagacaaatctcaaacacatttttccaagagaaaggggctagacacacaaggccacatatgatatgattctactcataccatatatccagaaaagccaaatccaagaagcactgcattggttgcctgagactgggtgggagtgaggattgacaagggatcgttttagggtgatgaaaatgttctaatactggattgtgggggtggttgcacaactctataaatttattaaaaataattgagttgtacacttaaaatggatgaatttaatgataatgtagagtttacccaaataaagctgttaaaaaataaggggaaagaaaaaggccacttccccatgaggtctattccaacctctcaacacctcctttccctaggaaacccaacccctcacactctgctctactttttttgaatagcattgatcaccttctaatacactataaagttttcttgttatgtttttcgtctaactccctccgctacaatatggttcgcggaggtaggagtttcaagtctgttttcatcgctaatgtatattctcagggtctagaacagtacctggcatgtggaaggcacatatacagatgctgaaagatgaaatgaatgaagaattctggattaaagggctccttcatctctaaaattatctaatcaaaggtttttgagggtctttctggcatcttcttgtgtttcttagcagacctgttgcccaggccatgttggcattttgggctgaacctggacgtgagacggggaagtcccgggggaccctggctagggctcagcgttgtctggaagagtaagaggaccagctctcccttgcccatgcctcgtgctgcctctagctatttcctttgttgaccttagttgacgcatctttaaaatgagttctctccagcagcctagtgacttcgtttgtgtgcgacaaaggggaagggagcagtgggattgggggtagggcagagatagtccttcctggggggtggctgtgtggccatcagccttctcctccctttcttgcctgcaccactgaagctgctgggtgatctctcagctgctaacattgtttctgacatattttcacatgaaaacctcttcctttatataaacatttataaacacctggatcgacttgtgaaagtgtgacacattttttggaagccagttttttcgggttgtgggactcagctatttatttttgtgagatggaggcttctgggtgcctatgaacctcccccttggaaaaacctccttcacacggacagaacaatttagaggctcagagtgatggagaaagacgcggcaggtggccgcccagaggatgatactgaatgggatggcaaatgaatgctgcgggtctcggggctccccaggtccatctgaggaggaggggctgccaggaagggtttttggaagccttgggtttgctcttcgagccgactccccgattccatgagccctgggatggtggaagggttcaagcagggctcctggagttcccaggggctaggaagaaacctgtttcatagtgatgattttagggggagtcaggcagcagagagagtggagtttggaaaagaggaggggcataattgagcataaagggccagggtttcagagccagaagcgactgcattcagattctcgttctttacctttcttgtgtgtgaccttgggcaaggtaatgagcctctatgtctcagcttcctcgtccgtaaaaggggacacgggacctgcctggcagagctggtcagagggcagatgaaggcatgcgagtgggttcctcagcacagtgcctgtcatagagtggcagctcaccagcgtcacccttgcccttctctcttctctccactcgagcaactcacaagctgccctttctgtgcatagaaggtgtggctgaacttagatctcctcatccctgcctagtggggcacatgcagggtgcagctcccggagtctgggaccatcaggacctctgaatgggggctttgaagctgtgtccagtccctgtctttcctagtacctatcagaacttctcatgagtgaaagccagtctcctaggcatgagcatcttatctctgatgaaccccccagctttttgctctgacatcatgccaccgtttctcatcatttcatgggatataccttctgctcctgctggggaccctcactcacaagccctgttctgcctggactgattctcaccttgctctttcacccaggtgaactctcagtcttggaatgccctcacccctccttcatactcaatcacgtctctgccaccctccaagcttggcttcaggtggagttcctccaggaaggtagctgtgttgaacactcactgcctgaccttttcacgttctgtccaaactctgagacattattttagctggtatgtaggtcatgaggttgacattaggaagaacatatcaggttctccatcctcttttttcctttttttccccagccattctgtgtgtgttcataaatgtgacattcccatgatggacccagattttgccagcagtttgcagaatggtaaagttttgaattaaagtcaacagcttccaactatctgtcactttcctgccttgtggcatcctgccaccacagaggcaccaacatatctcagcactcaaattgggcccagcgtggtagctcacacttgtaatcccagcactttgggaggccaaggcgggggaatcacctgaggtcaggagttcaagaccagcctggccagcatggtgaaaccctgtctctactaaaaatacagaaaattagctgggcgtggtggtgcacatctgtaatcccaggagattcgcaggagaatcacttgaacctgggaggcagaggttgcagtgagccgagattgtgccactgcactccagcctggactggacaacagagcaagactccgtctcaaaaaaaaaaaaaaaaaaaaaaaaaaagaaaaaagaaaaaaagaaaaaaaagaaaacacacactgctcaaattgagaactttggatctgggctaatatttcacctggggctgaaattgtctgggcagagcctgcaacaaactgctctggggacagctggataggaaaggaacatccttaaatggttctggctctcttctctctgaatcttcccctctcttgggccagcccatgacttcactcagctccagaactggcagatttgctgccatcatctcatctctggagatgaatctatttccttcctatagaaacagcatgcaagaaaactcagcttctgcttgaatactcccagagacaggaagcttactacttaactgaactctgttagttttaattgttgagataagaaatgtcctccctgacgttgtttccttccttccttccttccttccttccttccttccttccttccttccttttttttgagataggggtctcactgttgaccagacactgcaccctttgcctcttgggtttaggcaatccacctgcctcagcctctcaaagtgctgggattacaggtgtgagccactgtgcccagctaccctggctctgtttccatcctccggagctccagagtaaatctattgtgcttctttagatatttgggagggaccctattcccctacatcttctctctagtgagctgaacctcctcatttttaaaaattgtgtacacagtatctctcttatgtcttttacaggcactgcgtccctgttagacttcagggactttgcactggccatggtgctgaccaatcacaggctgcccaggccaaggattgggtctggtgctgctggagatactgactgctcaactctctctctgctgttgctcctcttcatctactcccatctcccatggcctgagttaaatcatgacagttgtcctggtgcctccagggctagtgcacatagggaagtaaatggctgaaattgggaggagaggaacacacaagggccagtggctgggctccctggagatctgcagtgctgtgtgtgtgtgtgtgtgtgtgtgtgtgttggagcagaacagagagttgttggttgtgcctccatctctagagtctgcagggatgtcaccaggtatgccatgatgaggagtggtttcaagagctacacaggccaggcgcagtggctcacgcctgtagtcccagctacttgggaggctgaggcaagataattgcttgaacctgggaggcagaggttgcagtgagctgagatcacgccactgcactccaggttgggcgacagagggagactccatctcaaagaaaaaaaaaaaagagctatacaaagagtggaccccccaggctgcctggagaggcagtcggtcatgggtccccaaacacctctctccactggacctacaacacaggtcccctcacagcagcaagataacaaagctgtggccattcccactccaaaggcagcaatgcatctttcctctgcaggacactgaccatagctgttagtcttggctcccggctcatgggcattgcgtcttctgcttctgtggtgtcctatcctgccccgaaacagtgggggctcccttaggctctggcccctgccaatcttccaggacctctctttctctccaggcttggcctccgcgagtctgccttgggttgtgtgactttgtccctaaactccctctgaggatgacacccctccgtcaccccactggctgccggggggaaggcttccatttagtggcattttcctttctcatttcatgctgtaatggagattcattgccagttttaaatccataatttgctgtgaaacccttgttttgggcctgggctgaggtcggaacggagaagcggcgggttatttttagccctcagagggctccctgtgcagctgcagctcccctgggcttcccccagggcgggcctcagacagcgtcctgggtttgacacccaggatgcccaggaagctggagctgggacaggggtaaacacacacgtgggactggctggcctgcccctccctcagttggctctggctctgttcctcctccatttcatgagatgagggggaatcagtagagaaacagggcctcatgccgatgagtctgtgcttccattacccccctctttcctgggcctgacaaggagtgagggtcagtacttcaggcctccaagaatgtgtccatttcctaacagtgactgatcccctgaccggatgttcttgtgtctttctatcagggcgacactgatgatttggctctgaggtgtgtgtgttaagtacctgcgtgcaccagcgcatttgtccttgaggcgaagctgtccatgtgtgtatccttatgattggcacataaatggggaatcctgtcaatggccagtggccagcggggcttccagactgaggatcccagtagggcaccaggacagaggtgggctcttgctgtgcttttgcaggcttgtggggatgctgaaagagatacccaggcctgaggagcagccgtatgaggggtaagtgggtgaggggcctcctccaggcagctgccccccgcatgttataggaaggggcttagatttcacttgcagccctggagctgatgattccatgtcaaatggcagacacccgaggatcgaggtcctgacttttgcaaatctccacagtctgagctcactttttgctgagcagttgagcctgctcagcatctcccagggtcacgcttggttccagcagctgaagggtatattatccttgctctcaggaggaagggaagaggaactcagggaacaatgcctctcatgccccaaccccaaaccatgagcaaatgagagagaatcacagtcaacccgtgaagtgggtttaacacttcatctctcctgctactggctccaccatggagagggcgggccctgagagattaagcatcatcagcccctgtctcacagctggatggtggcaggactggggcaggagtgaatgcgtcccagctccccagtgagggccgtttgtcctgcttgggtctggagagtttccaatgccctggggatggtggtgacacactccagaacttcccagggctgccctgaagagcctgtctcttggtgatgggggtgcagccactggggccaggcaacagcaggaggctgaacccctaccataagcagtagaccatgagtgggctcctaagaacctccccagcttcccttgtcctggtgttgggagcaaaagatgctggggggtatgggggctggccctgggcatggtcatttgggaagctacccccagatttcagtggcgagtgggcacttggataggcagtgtcgagcttctgggcccctccagaaatcgctcatggtggcactggctggggtagggtggggctgtgcattccttgcatcaggtcttctccttcttggagaggctcctgcctgcccttctccacactcaggcagggaagggaaaagatgcgctgagtttgcctccatccctgagggatcctctcttcctccgggccttggaagtcgtttaatgcttgagtgtcctgcccccacctcatttcccaacatgagggacgaccccaggctgggggagagttttgacatccagccaggctgtgatgaggatgggagatggagtgggtaaagagacagaggccatgcctgcccatggtaacatgcagattatgggggcagggagattgtggggggcgaccttggagtgcagcaggagggcagggctggggcgacccgcacacctcaactcaatggctgcaagacctccagggagaccttctatctcatctggcccccaacagcaactactcagcgtggcattatggcattgaacccacagggtggacctcagggagctataatataacttagaggtgagagactatatgtcagcctcagatacccttcatggcccccagctctgctcactttatcacctgcccagcaggtgagctccgagttagatgggaggctaaggtggtgtcagtggccaaagggagaaagaggaggggaatctgcttctggcccaggggacatgggggtagtctgggctaccaggaagggagctgggagcgagctggtggcaggggtggggtgtgtgtagggggagcgagatgtacaatagctccgacacagctcccatgtggaacctcaggagataaggatgttttctgctcctgtcttccgtctctggctcgtttgctaccgctatttgggggtgattgcagggtaatgaatgttgcaggaaacagccacatagcacaaatgagatacggcactaagaccaggccagggcccaggcaaaacacgcttaataagcagataaggaaatcaattctgcctttcttcccaggtgtgcagcctgctgggaggggcctgcaggaatcatatcttcctgccttgcttgatacatgggaaagcttctctaggaagcaaagtctgatcccccgggatgcaggggttgcttgttggtgtctcataacattgtgcaataatagcaatgatgaaaacagttataatactagcagccaatgctgctatgccttgctgcataacaggcgctattctgagacatgttttacatatattatttcattaaatcctctcttcaaccccatgaaagcagttatgattatttccctcattttacacagaaagaaacaggcacagagtggttaaataacttgctcacggtcacaccagtggcaaaatgatacagctaggtttcaagtgcgggcaatctggcttccagaggccaggcgcttagccacattgcctctccaacacaacacaacacaacacaacacaacacaacacaacacaacacaacacaacaaaacacaattgtcatccgtgtttggggcttactatctgccagactctgttctctgtcgtcagattcagtgtaaactccccctaaattttccctaagccttgttatttcaattgccatgaggaacatttactgaacacccagtatgtgattctaggctgtgctaggcatgaaggatgaaagatgctcccaggagacccggtgggggaaacagacatgaaaacagttactctcaacatagcgtgtcgagacctgtaatcaaggtgcataaggaggctgggcgcgatggctcacgcctgtaatctcagcattttaggaggctgagttgggtggatcccttgagcccagaagttcaagacaagcattagcaacatggcaaaacccggtctctacaaaaacaaaacagaacaaaacaaaaaaacaaacaaacaaaaattagctgggtgaggtggtgcatgcctgtggtctcagctactcgggaggctgaggtgggaggatcgcttgagccagggaggtcgaggctgcagtgagccataatagtgccactgcacttcagtctggatgacagagcaagaccctgactcaaaaaaaagatgcctaaggaagtgaaaaggaccacagggggacagtcaggccatgtgggctccagagaaggcttcctggaggaggagttgtctgaggtgaatcttgacagctgaacacaagttagccaagggaagaaaggtaggaagggcactccaggaagaaacacagtgtgaatgagggcccagaggcttggtgagcggaaggagatgccagctgcttgttagtgcgggagcaggttggcggtgggtctgaggctggggacacagctgggggctggcctcggggggccttgtgtggcctggcagggagcttgggttttgttctgtggggacactttctcgcccctgaagaacccctcagactgtcacctactgatttgcctttttatgtcagggtgactatggatgggtttcttgcaaccagtttctggaagaatggtttagaagccagcaccctcgaggtctgttccagctctgccttcctttgctggcagactctgagttattcaccactgttctctggacccatctccccagaagattcatggatgggagattgggggaggctgccaacgcggtgggctgaggaggccctgcagctctgctggtagagctgtggcaaagggagcttgtggttttgaaaaacaaactagttaaggacacgtcacagattggaccttatctgttttcctctctcagtatttggggcttgacatcatttaaaaagatgccctctttatttgaattgacttagtctccctcttaaataattcatgttgatttaggaagctttatttctaacgggagccacaagacagcagagttaatattagaacgggccaggaagaagagggaaatgaggagggagactgggaaaaatgcccctcttaataattaatctgatgccaacatcccctcctcccacttctgatccccccatcctgctctactttttcctttccgtagcatttattaccacctcacatcctgtacagcaatgcaatttatggtttaatccgtgcatcacttatcgaccgccttctctctgccagaatgcaagctccaccagggcaaggatggttttctctttcgtttcctgatgaatcccacgtgtctagactagtgcttggcatataacaggtgctcagtaaacatttgttgatcaaatccttggtaccatttcctccctgccctggatgtcccaacaccttgcttcccaagtttccaggaagttgaagagatcaagtgtaatgccacccttacaactctgaccctgggacagtttcaatatttttcaaccctgggattcctgtaggtggaagaaggagcagtctgcatgtatatgtgtacacaactttaaaatacaggcggggtggctcacgcttgtaatcccagcactttgggaggccaagatgggtggatcacttgaggtcaagtgttcgagaccagcctgggcagcatggctaaaaatacaaaaattagccaggcgtggtggcacgtgcctgtaatcccagctactcaggaggctggagcaggaggacccagaaggcggaggttgcggtgagctgagatcgtgcctctgctctccagcctgggcgacagagccaggctccatctcaaaaaacaaaaaacaaaccaaaaaagtgtatgacacttcactgttagagattgagagagagagagagaaagagagagagagagagagagagagagagagagagacagagtgtttaatgtttacaacaattctatgacattggtatttttaaccctctattttatagatgaagaaccagaaacgtcattcattcattcattcacgctggttatagaggcttgagccaaagaggcccagttccagccttaaggaccttgcccaaggtcacccagttagtgagcagcaagagcatattctacttcctggcccagggctcttcctaccccatgacagctctctctgcacatgtgcatgggggtcctctgaagcccaaccaaactgagtcttcggagagggctaggtctatgtggaagctggctacagaggggtggttgggggggatcctttgcagggaggaccagggtttgaggtccacagccaaggccaggaccccagggctgaacaggacttggagaggtcctatctcccagcctcaaagtgggatgctgtttaagccaccctaatcagttttcttctaagcctcggtcactgcgccaatcttggttccagggagggatggcccaatttcctaaaatagttggtacagcatgttggactccttacagtggaagtcatggccttttgggagcgagacagttctcagcgatcatcttatttatcaccacctctcattttacagatgaggaaactgagacccaggttgagaaacagggccactgtcacacagctggacactggtaaaaccaagaccactgcctctaagtctaatgctgtttccgtgacgctgtgattctccagatgttctgcaggtgaaaagacgcctgtcttgaccctgggctgagtcaagccatagtccttggcagctggctgggccacagagggcacgcagcctgaccactgattgacctgacctaaaatccccagtctttgcctctctcagctttgcaaactcaggccttcccccgtctttccctcctcatttcctggctccctccttctgcctcccgaggtacaaatgctcagctccgaagttgctccttgcctgattgcatctgagagctggaaacacaacgctaattaatgtgtctgtgactctaggcttggctgccaggccgagtccccatgccttccctagggcccagcggctctgcgagctggccctctggcttcatctgagcacgctgccggcagatgcatattttaacaatgcacatctgttggctatataatctctcgtatttgccctcctcacttggtacttcgatggaagacccccgggggcctccctctgttctagccaaagtgtttgctttgcaattttgccggaataccatctgattctgctttcgcgtcttccgcaggttctaatcaggctcttactttatttaattaaaaatctatctcaggcaaatacagactaaattaggaagctctctcattcctggaacacagggaaggcagccccccttggggaactggctgggacattttcccgggctgagatgtcacagcaaagcagatggggtcttggtagggaaggcggctgggccaaggagcagaaatacctctctcccatctgtgggaacagccactctctccattccccttccccagaccaggggtccccttccagctggctgggtcagctgctgcactgggggcctccttgcagagcagtaggtggggtgctataccccaggacactcagccaggcggagccctgcaagaccagctgggttggggacctgggagtgtcccagggagtcagcgaggactgcaggcagagtgctgggaagcactgtcttgcctggggttttagtttgctcaggatgaatggttttggtggagctgcctgaaaggctgatggacaagatgctggctgaggctccctttctggctctcaggaatttcacggaggggaccctgctggggatcatggaaacttcctctgccctccttccgctgatctccagacttgaataaaacatctcccccatacaaacccagctctgtgcccagagggcggtgtcaggccatgccaccggagaggaagggggagcgaatgccttttagacatgacctaagacaaaatcgggtctgttcaggttggatcctgaggccctgctctgagaagcctggcccctcaccagccagacagatgagatgctgctggcatctgggaacaggagactaggcaaagagcttggagctgaaaaatctggagttgattttgaaggttaattaagctgtgtcacctcctgtgagtgcctttgcctctctgagtttccattctctcatctgtaaaacattcgaaataatctggacttttaatacgttggacttttttacgtaacgtagagttgagaggaaaggaagtgtaatgatcatgtcaggactggggaagtcaatacagccttaaggatgagatgtggctccacctatttttggttcctgtgaagtcagaggagtggacaatgctcaggttcctgtggttccagcatcctctggcccctctagaaggtgtatgagtcggtagaggcagattcttctgaggatggaggggctgagccatctctgaagatgaggagcctacaacttagcaaatctgttctggcattttgcaatcctcaaaatcagaaacaatatgaggccctaattcctcctcctctcctcccacaacccccacaccacatggcagactcattctcattttagtcaccgtcttgggagaaatgagaacggcgctgctgcctttaataccccaattactcctcggaaggcccgcttcccggccatggaatcccaacttatttacccccgctggaacaggtttattttctcattcctttcatcgcaggcctggggagactcaaaggttgcaggaggtttctgaggctggccccaagtccctcccccgcatctcaagaagtcaagctccgagcttggtaagtggtcctccggggcctgtctgctgcactgcttggaataatctgccctggtgtctttggccatgtagatctgaagataacctgacatgcttttaaatatttcatctctgagcagctgtgtgctttagctgccaggagaggaggcagcaccccagctgctgaccctgttgtcgaaccttcacaacagctgctaaggggtgggcctgggctttcccacttccctcctgcacgcgtgcctggcacagactcacgtgtaagggggcagcgaggtggggcaggtagccctggagccctggccaggagcccatgggccaagctctttgcatctgtgggccttagtatctcatctggggtaacagtccctgtcccaccgagcagcgtcaggaacagcggaggtcatgtgcctgaaagagcctagagagctacggtgaactgcttggcaaatgtgagctctcatgacttatgtgcaaggcctggttctcagcagccttgatcctcggtaacatttggccagaggagggagactcccgggactgaactctaaatcagaactaggcggtttaagaggtcaccgagcccattcccctgtcttcaggcaagatgatccaggaacgctgggctcctgggaacataagatgaagaaagatcaaggggaaaagtatgatttggaataaggacctgaaatgaattttcctaggagggacctgtcagccaggattcccagggagcaatgaggggtggagaagtcacgggggtcactggtgtccacatggatactagaatcatggggagaatcgggctgattctacagagaaggtggaaagatagggctttgttagcaccggagtgggggtcagttcagaaagaagggacccacagcctgtgccacattcttcctggcacggagcctagcctagataacgtgtgcagagcatgctttctgatggaataaataagcatgtaggagccctcattagctgcctaaggcaccatcaaacacgccggggttggactgagtccgctggcattggctgtctggtttactagggaaagagccttcgcttgtcccgtttgggtgggaaggtgggcatggatattgtggaagcagcagtgtctggagccctgtgggatgatccccagaggggagtctccccatgtctgaccaaaaaaataccctcttggagctgagcccttggtgcttcacgcagtgtcccagccccgtgtgcagatggttcttacccaggactgtgaggcgtgcggggcgggagcggatggcggcctggatggcctggcactcgtacaccgcatcgtcttgcagctctgccctcaggatcttcaggtggtgctcccctgacaggtggttccctaccaccaggtactgtgggtaacctgtggagacaacaggcaggtcagggagctggggtggggtggaggggacacccatgacaaagaggcacagaatggaggacccaagcaggggccattctacaaggctggcagagcgggtgattgctcagggctctgatctcagtgcaaggagcacaaatgcaagagctttcccaaggcattgaaggtgttggttctctctctctctctctgtatgtgtgtgtgtgtgtgtgtgtgtgtgtgtgtgtgtgtgtgtgtgtgtgtgtgtgtataagggcatttggtctgtttgttagtttttgagacagggtcttgctctgtcactcagattggagtgtagtggcaggatcatagctcactgcaggctccacttcccagactcaaacgatcctcccacctcagcctcccaagtagctgggactacagacatgcaccaccacgtcggctaatttttttatcttttgtagagatgggatctcactatgtcaccctgactggtcttgaactcctggacttaggcggttctccctcctcaacctcccaaagttctgggattataggcatgagccaccatgcccggccatgtaagggtcttgttggtttcaagtttaggaaaatcggaggagccactgttagaaaggaaagagggagaagagatggaaatgctaagcgtggacagacaccgctggcttattattctggaaagtggtgtgctcagcactgtggtctaccaagcagacatgcattttgataagatagagaggagagagagagagacagacagacagagagacccaggctgagaattacagagagaagacagtcagagagagaaggaaggaaaaagagaaatgtttggaaaaggatcaagagtgactttgcaaaaattttgtttcaggatggacaggaagtagaaatctaggcccgcccttccagtgtctaggaaccttgggtcactttgagtcacagtggaccctgtctagtcattcctcctgtcccgccagaagccccaggtcctggtgacgcacttatgaagtgctcaggacgcttaagaattgggggccccttgtaccatgggcaatgaataatagataaataaaagtttgagaatataaatcattaatcagcgttcctgctgctgtgtagggttgaatataaatgccaactgaagttgtggctggccaccttaggcagatcctctctttcctgggtctcgggccctacacctccctatttctctttccatccatctcctcactgaggtctgccctcccccgagtccctcagtgtgtggatttacaactggactccaatccccgctgtctttcatctctgtcccggttcccttctctcctcagaggctgccctcggcttccactcccctctggcagccccaggctgctcctccttttgaaggaccctcaccacacagggagtgttctcagacgggtgctgtaggaggatgagacgggacacattcagccttttaaagagaagatgagggcttaagcaagtgagagagacagaacaaagacaggcagggagacctgcaagagctcgcctcaagtatttcaaagaatctctcagtgtgggttgggcatgttcctgagctcccaagggcagcaccagcaccaacaggcagaattcacatggggaggttctttagaatattctcaactgtttgaggtatccaacaaggatctgggatgccagagagtgtagtgaggtccccatcactggctgtattcaagcagaggttggatgatcgcctctcagggatgttgcagaggtgatttctacaccgggtgaaagatcagactagaggagcttgaaggcccctctcaccaccataagtgaaggttcttctggaggtggggcaggcctccctgggggtgggctgtacaacgggccaccagcacttgttcctggtcaggcgaggtagctgtgatgatcctctgccagccttcctggcatgctctggagtgcttcctgtgcagctgggcccttcagactcatgtcttcatggctaccatcctcatcatgcaataaaatggccctgtcctccccagctgtgcaggcctggccagaaaagctcacaaggccatcagctgcacccctgagagcactgcctctcctcctgcccacacttcccgccttctgctgggctttgggaatgagcccaggtaagttaagctgtctccccccagggccaggagaggggctggaaatgggttctagcccaatcctctccctgctgccgctgccttccttgtagctggctggctacccccagcccctccagcccagcctctggatcccactatcctgtgattagtccctggtctcctgcaggcatcttggctggagcttctgtttctgttgtcttgcaagctatcagcagcaggattttgctctcacgagctgctgaaaacatcagtgatgggtttgtttgtatttgcctaattaggcagtgagctgtgatgctatcccaaggactggcagcatctttgaaaatcagactcagaagcatggattctgagaaagttctagctccttccacattatcattactctctcttgctactcccaaaggaggcaaaattacttagagtctgggttctatagtcgaattgcctgggttccaatgccagctggatcacttcctagctctgctgtcttgggtgagttactttaacttctttgtgcctcatagactacttactatgtgccagtccccattttatggggacaataccagtacctcataaggttatggtgaaggttaaataggataatctatgtaaagtgcctggcacattgtaagtagtctataaatgccaatttaaatgaagagaaaggtatgtcataaggtcaggtggccaaagaggtctttatctttagaagggagagaagacagagtatctggaccctttggggttaacaggcaggtctcatgtgctgggattggttatatagttgagtcaatttctttctcagttgtgactttgtttacctgtcaaacaaaggggaaaatccttcttttctccctccggatcgctgtagatttatgagataatgtctgcgaagtacctgagcttcttagaagaaaaatgtgctatcaatatgaagaagtgcatttataaatcattttctttgactggttattccagctttggtgactagaaaaacatttaggtcttcaaggagcgtatcatttctgggagattcgggggggccacatgggtacagtaggagaggacagagatgtagcaggctgaaatcccacaaccctgggcctcagtttccctgtaggagagctttcgcggtgttaagggctctacaagtacttgctgaattgagttgagggctgtcctgcctgtttccacatcaggcaagcgagcagagttaattgagcatgtaagtatctatcatgattgccatgatgctatttttgggacaagtgacaaaatacagggcaagtattttatcaggagtttgaggtcattggctctgtatggagaggcaaaccgagtcaagctggagaggacacaggccccagtttgtcagaggccattgttctgcagccctaagcaggtaccagtcctggatcccagaaagccattcatggcactggatgctagagggtcagttatccatgctgagatgaccaccgtatgcactatccctgctgacctgagcctccttttggccactgacccagcaagaccccagtccctgacggaagttggaaacccactgaccgggaccccagacagcctccttaactagcggcagcgctcatcccagctcggagccattcagtgcatgaactattctagtttgggaaggttgtatcattcctggagtttctctagggtaaaggcgttcggagtctctgaaattggctggttcccataacagttaaactttatggcagcacagtatattttggagatgtttttgtgtattttttccatgctcagctgggctgcagcgttcaaacctcgtgcctgctattgaccattgctataatgtttcaatatacatttttggcaagacataactcacatttaaaaatattaatttcccaaccatcatgttcctgagtgcacttcgatttttattttcctgcagctgtacaccatgcgagaggcaaagttacttctcagctgaataatatttttctctcctcctccacccttagctattcccaaatcacaggggaatgacacccagaggtccctgcttgtgaattttactgtgtacgccaagcctagcaaacaaccactgcctacctgtaggacagaataatgatagctgaagggtgtgtgaccagggggatgagccattctttttttttctccagggaagaggatggattggaaaagcgtctgtatggtcttatgggatcactattcacaatagttaacaaatgatctgttgtcagcactggccagtgagttcacgtgtcagccatcaacaaccatgggaactctcactgcctgtcccagggtagctttgctgaataccagcctgcccaagccgaacatagttggaaatttatttttaatacttcctgtcttttcttcccatctcatgatggctcctaagatcaactaggtgtctttgtgagttttcagtttacttggttccctttaatgggtgagaagcctggaagaaccaggttgtgacttgtatttccttaataattgtgccttaataaatgggggatacatcttgggccaagacacaggaacacttgatttctggaaactggaatttacatgaatcatgtttgactttggagtaggtgcttgagggcaatgtcgagttaggttaggacccaccgctagaaggagggtttgcttatggttcattatgcacatcaggggccctcagagtctagggatgctgggtgcagtgcttgcctagcctgactctgcctgaggagttgcagtgaaagctagagattcgatactcagacacctgtgaagatgggtgctccctaggaaggtggatgggtgagtaaggaagtgatggccccaggcccaccccaggaggtctggaggtactcacttgagaggtccctgcccacacccagagccaagccgtccttgatccacagaacgaagccatcgtattcggggatggcgcaaagtagcgtcactggctgtcccgacaccaccacctggtcctggggctgctggctgaaggaatagacttggcctgggaaggagacaaacacaatggtcagttatctgccggctacaggggcgagaaggctcccctccagctatggaagcagagcagggctggcgcaggagactgagcctcctgaagcacctggctttcctgctgagggtctggtagagcttcctaactggtctcagccccagctctattccctcctatgggggcctggctcccagctccagcccctctgcccatcagtccctaacacatggactggtctagccacaccccagctccctatgggccatctccctccacctttgggacgtgccacttcccatgcattggtgagctcctacttaatgccatgtgctgggcatgcagtcccacaccagggcagaaacaggagagagagagagagacctctagctagaaacattctgtggtggctgtgtgttaagaagggggtcgatggagagtggtgcggctttggttaaacctgagaattcaggaaatcattttgttgtttcagtggctcctggggtgggctgagggccaagttcagaggggtgggtggtggtgcagtatggcaggaggtgtgctgaggaggcgtgccatcctaccgtgtcctccctgtccctttcttttctgcagcagaccttactccagcctcacaatcacttgggaaaaaatcattatggacaccatgcctcctcaaaacgagatggccagaatcatcgaagagagtcagttgacattattttattaaacaaacccatccacaatgcttacaagatgccatgctctgttttgaggctttaaaatattagttcattaatattttcatcgtcataacaacctaaaaatagtaggcactatttttatccccattttccagatgggaaaatgaggcacagggaggtgaaaaatagtaatgggagctgtgcttgtgaattgctcaccaagtacggcgcatgccctgactctagttatcaccgtggcaacactcgaatggggcattgtcaaccccatttgacaggactttgggaaacggaggctcagggttaactgaattgcccagggaactgtctagtgggagttggggtgggtggtgcggtgaatccaagtctttctggctctgaagaccatgctctcccctactgagctatgctgtgtgcagatccccaagcctggccttggagggagttgctgatgaagaggtgtgatgtgatctgtgtctcctgggagtccacagttgagtggacaatggaacattgacattcgctgagcatctggcccacagtacaaccagtacttcatacaacccctcctgtaatccacttaattatacttcagggcagaaaaagccccactttacaacaaagaaaccaggatcagagaggcacagtaacctgcccaaggtcacgcagctaatgagtgttagagcaggggtttgagcaggggcccatctgcattccaagccctccctttttcctacctcctgctctacagacccagacctaaccgaggcaaaactggacctggcgctccagctgctgatgctgtggcctctcctccccaacccgggagagtcaggggcagccacagacgtcctggacactggctgctgcccatcttggggacaaaaagccccaggcttgggccacacctaggactgagctctcagcaacagatgaccccaagagggagacacttggtgtgtatcaacccaggggagcttggatggcagcagagcttggggtggaggctccccagaaggaggggtgcagattcacagtggagagctggggacaggcaggaaggtggccgagttcacaacctgacaagatcttggcagggtctccgaggagtctcattaaaaatcaaattggccttgaattgtgggagtaacactttttattctgatttgagctttacaaattagatttcataggacattttaatcagctatgtatggtaggttttttttttcctctctgtctcttcaagttctctgttgtaattagactgtttctggcaccaaaacagggtagaaaaggagggaagagatgagagaggagaaggggagaggagggagggactggagagagagcaaaggagtgaagtgaggacgtgggagagaagaggagagggagaggaagaggaggaagcaggggaggagggtgaggggcagcatggagagggagggggtgggtggaaaggactccttctctggctccttttactctaatgatgatttcacagctcatccttttatctcaaaatctttcttacaagaaggacagagtcaaggcagctgcagtaactgccaaagattgtgctatcagagagaattatcaggttgtcaggtggacgtggagggggttataatgagagccccttaaatgaagcagtgcccgagccctctgagatgtccattattaggaagcacccacagtgggtaaccgtcccggtctctccccgtcctgtgtcctcttggaggaaggcgcgggaggtactgggtgagggcccccggggaagtggggtgcaagaagcatccgagggccaagggtaagttgtggaccggctggagcccccagggagaggagggggctatcaccatggaaaccaggctctggaggaaggcaacgctgggaagggggatcagttgaagcaggccatggaggtggactctgagtggccacagacccttttggtgggtgtctcagagccaggggtggcagcaggcacaagatgcctggaataagacctggggtctgtaggaaaggagcctgatgggatggggctgagcgggagagggccttttgagggggagcatctcccgatgccatctgagcaggcttggaggtgtaggatcccacaggttgcagtgagccaagatcgccccactgcactacagactaggtgacagagtgagactcggtctcaaaaaaaaaaaaaaaagaccttcctagagcctctcgcattctgtctgcttgatccacttggcttttctatggaaagactgtttctggggaagatgagtacacaggaaaaatccacccaaaggacatgatttacaaattattatttttggggatgggagacagtactctaattgacaatgtcccttttcagtccaattttaatttttgcacattacatttgagtcactataattacttttctcttttaaaccaatgagttttttttttttttttcaaatgaatcttaaactgttactgagtatctagagtggataaaagttgaggtgctttggatgaaggtggagatggagggatggaacccacttttttttttcatccatctgacagaccttagggcctctcctttgggctcaagagcccctcagagcacagcttttgagccatggatgtaagttattgccagaagaatgctcctcacccacccactctttcttttcttttgagactgagtctcactctgtcgcccaggctggagttcagtggggcaatcttggctcactgcaacctttgcctcccggttcaagtgattctcctgcctcagcctcctgagcagctgggattacaggtatgcaccagcatgtccggctgattttcatatttttaatagagacagggtttcaccatgttggccaggctggtcttgaactcttgacctcaagtgatcctcccacctcagcctcctgaagtgctgggattacaggcatgagccaccatgcctggcctctacttgctttattttccccattttcttttctactccaaagaagtgaaatgcaagtgagcccaaggtcattttctgcagcctcctggatagtgccttaagtagacagtgagctcctgagaacctgtttcttccacacacacactgaccggaccctgctgtgaggcaggcactgtgctgtctggtgaggagcaggggaacaggcctggccacccctccaggagctcgcagctgtgccccctccccatcacacctgggcgtctcagatggagcacagagtaggtgcctcacaggctcaggtcctgctctcagtggagatgtgacacacccagcaccttccaccggcccagggtttccatcttctccgcttcgcattttccctgatgatgttcccctggtgtgaagccttggcggccggtgcaatctccccttcccatactttatttttatttttcttttttttttgagacggagtctgactttgttgcccaggctggagtgcagtggtgcgatctccgctcattgcaacctttgcctcccgggttcaagcgattcttctgcctcagcctcttgagtagctgggattacaggcactcaccaccatgtctggtaatttttgtatttttagtagagacagggtttcaccatattggccaggctggtctcgaactcctgacctcatgatccacctgcctcgacctcccaaagtgttgggattacgagcgtgagccaccatgcccggccccatgctttgttttgagtctgtcaccatcactgagcctagcccagcaggctgtacatctctcagacttcccctttcctctctattcccactgctagcacccaagttcaagctctcgttgcctcaacctgggctcttgccacagactctgaatgttctctttgcctgatccattaatgtgctgaacctggattttccgtcttaattcaccacttgcttcagggttcccctcttttaaggggtgggacctctcatggctctccactctctgcgggacaacgcccaacttcccatgctggattctaatctccaaaatccagctccttttcttcctgggagctccacagcacccccgtgctggctagtcactaaggtcacctgcctcgagttctcctcgatgtttcattgtcctgggatgcactgcatccccccacccaaggctcccccacccaaggccccccctaagcaaccccacctatcattgaaggcccagttctctccccaggcagctcctgtgacccagatggaatcttcttttttctcgtcttctctctatattctcatcttgcctctttttcatcaatttctccaaacctttattgagcacctactatatgtcagatgctgatgaaacagaaataaggaagaaacagtgtacacttcttgagggcaggggccacagctatcttttctgtcttgtgttcccagctgtgggtgagcaccggttacacgtctgtcacatgtgcctttgtacttagagtttgcctgctctggttggtctgctgagatcggtggtcactacaggaaaattgcttttgcattatgaactactaacccggcagatactgttcagagcacaccacacaggagaaaggtgagaaatcacagggtgggctggagtctctaggaatcaggcttgacaggagaaaaaaataactgctgttcatggaagatttacttgatgccacatctttggctgtatacgttgtttctggcatgcagattagctgtaattaaccacattttatagatgaaccaaggctcacagaaatgcagggacttgcacaagttcacttgattagctcaggtgtcactcaaaccccaatggtctgggtacagccctattttctcaccactatccgatgtaggttgttgaatcaagggtctcaagcccagattttgattcttaagcaagtactcactccaccaacaaggcagcctactcagattatttatctatttttatatttatttatttatttattttgagacggagtcttgctcttgtcgcccaggatggagtgcaatggtgtgttctcggctcactgcaacctccccctcctgggttcaagggattctcctgcctctgcctcctgagtagctgagattacaggcacctgccaccatgcctggctaatttttgtatttttagtagagacggggtttcaccatgttggccagactggtgtcgaactcctgacctcaagtgatctgcccacctcggcttcccaaagtgctaggattataagcgtgagccactacacctggcccagatgatctaaagggaggtagaagatctttagaatgaaaagtgatttcttggtttttccctcagtttctgtgtgtaggctcctcttcacctattggtcagtaacactgaaacggttgagggtaaagtttagtactggccaccataggaagattaaaagaaaggaggtgtactagttaccattacttataattattacttaaaatggctatttaatataattatattataatatagcttataattatgtatcataaatatttttattgctataaaattagtaattgctaacttttctattttttaactttttgtagggacagggtcttgctatgttgcccaggctggtctcaaactcctggcctgaagcaatcctcgtgcctcagccttccaaagtgctgagattacaggtgtgagctaccatgcccagctagtaataggtaacttttacagaatgtcaagcatataataaaagctttacctggattattttattgactcactaaagagtcctatgagataggtaccgtatcacacctacgtgaagatgaggttgtctggggcccacagcactggcagtgagaagggatatgagcccagcagtctggttccagagcagcctctttgcgtccttatttggacttcgcccactgtgcctctagtcctcgcccccaggaactcatagaacccaccttagacctccctctcccactgcccttggccagtactgaaaagtctcaaggaaactcaggaagaataatgtacactagctcacttcatcagttctgtgtataatgtcctcatgaacacagttctctgggtggatcagagttgaccagctatccaagagtgactgaagcctatgttcaccttctttagctccctgagaaggtgagcgcagacctgcaggtcctccagtcacccttgaccctcacaaccacatcactcactccaaagaacccctctctcccttcaccatttggactggacaagccccttgggatgaaggcagatagtgcagtggtaatgaatggggctcaggaatcagactgacctgggtttgaatcctggcacttccatgaacttgctgagcctccattttcctatctgtgaaatggggacaataataccaccaccttgtggagatagagaggatgcatctgggccacttgactccggggctggctcacaacaaatgctcaggggaaaccgaccttcttctctcaaagccaccctctgtcctgaacaccaggccgcaggctgagctccatagggctgggcgacgggaagcgtgacctggaatggcaggtggctctctattggtgtgaaagggggaggcaagggtggacttttaattactatccaatgacttattgaagagacagttttcactaaagacaaggatgtactctctttgcaggaggacctcagtgtagcatccatgggttctcaggtgggtctcaaggctggtgtttgtggtaggtgagctcaggtgttggaagccttggccagctgctgtgagccatgccctgtgggggagaagaggtgggagaatgttcccccagggctgcaagggggctactggggtggaaggggtagggggcgtctcccgggccaatgagggctggcttggctccgcatctgactggcgctgaactagcttccgttagtagaaaaaggctgcgtgtgcatgaacctgcctgggcatggcagaggagcaggcctgggaaacacagcggtctctctcccacattcgcttggttaggtggctgcagaagcaccttcctgctcgccgcctggaaggtaggtcatgttcctgaaagcgggaggctctgcggggcagggtcccagggttctgagacaaagccctttgtctctgagtgagagtccctgtctgggatgcttgcccccagcctgtgcgtctcccctgcacacccaggctgttgtgacctgcaggggccgagagagcactgcgccatctgtcccgggggccctttagaccactgggtaaggcagctgcttttccctttgaggagagtggcagaatcagaggagagcctgggtctgccaccccctcgtgccaagttctctgccctacctgagaaggtagaagcttcaggagtgggagcaggaggtcgaggtgctgagcaggcagggccttttgcagccttgtctccaaattgcaggaagcagtggctgtttctggctgggaacaataaaggggaggggggcttggatgaaccctgtcctgatgggccacgtggcgtccctgagtcaggacagctggcactgttgccagtgctggtgagtggctggtgggaggaagtgtggaggtggcagcagcagtgacaggtgtggcctggcctagggaggtgggcaggaggtggagcatttggtggccttttgggggctctggttatggggcagagctgggagcaggcagatggcatcctcagatcagtggtggggctggatgtcttccccagttgtttccccaccctcctccatcgggactcctcctgactgctcttcccaaaagccccctctagatttccctcctgcgcttactcctgcctcctgtcagcccacccggcttccaacctggatgcagcgccctcatcttaatctcttttctgggactcgcagcacacattatcacggaatgaaccatcaccatctggctcccaaagtccccaccaacttccagtgaaacattgaaatgcagaagaccccatgtttctctatgacttgcacacctgtggccccattctgaggttgcccctcaatccctaattatttcctgagggggaagagtcattttgccatggaaggcgcagattacaagggccacgtcactcggtgtgatggtcttagggcagcactgcagggtgctgggtcgggtgtgtgtgtgtgtgtgtgcacgtgggtgtgtttgtcagattaactgaattggcctcaaccccaccttttctccagccagacatttgctgcttctattccttatcaagcacttaagattttggttgagggctgggcccggtggctcacgcctgtaatcccagcactttgggaagctgaggcgggtggatcacctgaggtcaggggttcgagaccagcctgaccaacatggtgaaaccccgtctctactaaaaatacaaaaattagcgggacatggtggtgcgtgcctgtaatcccagctactcaggaggctgagccaggagaatccatagaacctgggaggcggaggttgcagtgagccaagatcgcaccattgcactccagcctaggggacagagtgagactccatcacaaaaaaaaagattttggttgaatgaatttttctaggagaatccatagaacctgggaggcggaggttgcagtgagccaagatcgcaccattgcactccagcctaggggacagagtgagactccatctcaaaaaaaaagatcttggttgaatgaatttttcttagttttacagaatgttggaaagcataggccctggcagggccatcttggggaactttggaaggaacagtgatctggttcgtctttggggtccaaaggccttggtactatggtgtgtgtgtctgtgtgtgtgtgtgtgtgtatcggataggaaggtggcccagtatcctggtgcccatagaggctgggatctgactcagaggagccgttgcttactcctccctgccacccacaactgccaaccctaaatcttctagggatgcattctggaactccactgtcccaagtctattgctaccccataggcacatgtctctgcactgtggttccacagtggtggtgagaggcacagatctacagggcagcatggactagtacaaagagtgtgggatttgggatggttgtgtaacaggggagataaagctttgatgcagactctgccctggagcctgatgtgggatcgggggtgctgagtatcccctcatggccctgggcaatgctttttttttttttttttttttttttgagtctcgttctgtcgcccaggctaaagtgcagtggtgcgatctcggcttcagcgcaacctccgcctcttggattcaagtgattttcctgctttagcctccaaagtagccgagactacaggcatgtgccactatgcctggctaatttttgtatttttagtagagacagggtttcaccaagttgaccaggccagtctcgaactcctgacctcaagtgatcttcccactctcagcatcccaaaaggttgggattacaggcatgagccattgcacccaacccctgtgcagttctctttccatccatgcttggaggcggctcagaggcaggcaggaggtggctcaagggtgggctcaatccctgcctcccctttctccactggttatttggcctggcctttgttccagcagcagattgaggggacatgaccactccccttaggattaaacccagtcagacctggacaggaagtgagggtcactaatataaggatggaaatgcttgtccttgcttctaaggagcctggtgctgacacatgcacacacccgcctgcatgcctgtgagtgtgggcagcccagctgaaaccctgcctgcacccctcaactctcaggacattctgtgaaactcgctgagagtcttggatggtcacatttgaccacaggttactggattacaagggataaagtggtctcatagagaagtcatataaagcttttcaggggtttaagagaatcttgcttcaagcaagggagttgtggggaggaagcagagaaggcatcctggaggaggaatcataatatggggaaagtaatggaggagaaatgtcattctggggtaggaaaaaaaatataagcaaaaacatgagtgatgggtcaccctctgtcacctgcctggagtacctaaccgatgggtcacctgtcggagcctgggtcctggacagtaggaagaacacagggtcagtcagccctaggaaggaactctggccctgtacctagcagtgtgatctgaggccagtgactcaccctttctgagcttcagtttccctatctgaaaaatggggatgacacgcctccctggcaaagctgctgtgagcatgagaggttttatatgtaaatgatcttggtagacaggtgtttcacaaagggtcattcttactttcgtcactatccacaagtctttcctgagcttgggactgttaaaacaggagccagaggagcacctgtcttgcggagtcccagagctgagaacggaggctttgcaaatctgaagttgcacccattagaatgctgcatgggtggtgcaggagacagtgggtgagccctcccattggctctgcctctttcttgagcttgggactgttaaaacaggggccagagcagcacctgtcttgcagagtcccaaggctgagaatggaggctttgcaaatttgaagttgcacccattagaaacctgcatgggtggtgcgggagacagtgggtgagccctcccattggctttgcctcttctgctcatccgggttggcttcacagcctcctggagtgttgtgtcagccatgcaaaaagggctcaaatgtcaccatctgccttttattagtgaccaattggagaaggcttaagaatacttatactggggttatttattgccggctttctcccagcctggagcttgtaaattgcctcttatgagattaagggaagctgcccctccagagaagcaagcaaataggaagaagggaaggagagaagaagtcagctcagtggctcctggtgacatcagaacaatatcgggtagggtgggaaagacaagggcagcgtgactcagttcatacctcgaaacccaagtcttgaattctgctgtgttcctgctgctcagcacagggccagcatctaacacaggaggatcagctttgagaaatttccagaatgcccagttggtgacctgctcggggaacaggattgggggtgatagagtatgttctgacccactgactgacggataaaaatggatttttatggaggttctagggggtttcagtcactgtttcagctctcaggatgccatggtgcctcaggcatgagcaggagccacctcagcaatctccaagtccccaggttgggtgtggggtgtgcaggaggggctgatatgtcttccgctgagtaggctctggagctgcggggaggcaaatatgtgcagaagaaactagaataaaaagctctacaccataagcgtcagagtgaggcacaaagtcccaaagaaggagtcacagaagggttggcttctgaaatggccaggatgaagacaaggtgggaatgttccctggaatggggaacagcttacgtcaagtgtggagaacagatgtgttcatggaataaaagcagcagtgccacatggtctaggcttgatctctgaccctgccattatggctgtgggtccctgggcaaattgcttagtccctctgagcctcagtttccccattggtttagcaatcaatacttgttgagttgtttgtgagaatgaaataggtcattctctgtgatgtgcacagagccctgcctgccttccataatggcagctggcagtatcattacaagcctagcaggctgggtgcacggagcatgtgtgtgcagactctcttagtacagcgcaaatctagaaagtcctggtgggtcagaccgtgtgggcccttgaacgtgtgccaagaagtttgtacttcatgagaagtcatcaaaggtttttgacccacatgctcagatctgagttttagaaatatcacggtgatgacagggaggaggatgaatgaaggaggataatctgaagacagggagactgatcagcaaggttttgctgtcatgaggactcaggctaacgctgcatcaatggaaagaagaaatggatttaggagccatttgggggtagaactgatagtacttgaccagggatgaggaagatgaaagtgtgaatggatgatggaggagccatttgctgctcaggaggagaagcgcgcttgaggtgaggcagtgagttcagttttaaatgtgttgatggagaggggtccagaatcccccaggtgatgctgtcccagatgtagttgggtcaatggttctggagctgggaaggaggtgtgaagaactcacactgactgagcactacctatgggtcaggcagtaggagaagtattttcaggtgtcctctcacttggtgttgacctgataattcaactccaaatatggaaagttatagatgttgttgtgactatctaagagggacaaggttactccagtctgggagtgttgggagtagctgccttgggtgaaacatctaaatcttgttgaggtttgcacaggttttgaaccatatcgggatggcaagagatcatctaacctaatcttctccctttagactgggattggaaatataaacagagaagccagaagaaccaggcaggggtagaagacagggccttttctctattgtctgtttctccttgatttctactgggagagagacaaagaaacactttccatcccagcatcgccacctgcagccattggtagcttgattctgatacacacgtaaggagaagcttgccagtctcatgaacattacagaaattgcactagaattttacttggacttacaaaaaagaggctgactgctcttcccagggctggatgagggggtggaaagtctgagggcacattcccctatgcttgttcctcacccgggctgagccagtgtgggcagcctgtgattctcccagcctcgcacttctctcccaggacacaaaatccaccaaggttgtcctggacagtgtgggtctttaacgaagagcaatcgggctggccgaggcagggtgagtccaaagtcactataaatcctttgcctactgatgatcaggctcgcggcccctgccaaagcctgcactgtactcattagtggcagggagagggattcttccatcgatccagccaaggcctggatgccacgaagacactgataagtgctgctggaaatatgggctcttcagtgcccatggcagagcccatccatccctgcccgaggtcacctggaggtctaaatgagacaggacgggcatagcagagtgggtttatggtgggggagtggagatgggagatgctcgacagcgcatgaagcagagaccctggctgtggtctcaggcctgttgctggccagccatgggaccctggctaagccccctttcttctctgagtctcaggctcttgtgtcttctgactggaatgtgccctcactgagccggcaccttgggatgtgttggagcagcatggaaggaagagagtggcactaaggggcagggatggaactatgccattagctcaagagggagctgcaggctcggctatgggcaggctcggctacagcagacagagtgcccatcaacccctctcagagggcgtcagcgtgggcaccaccaggagaggctggaggctaggtcatggattggctgactccaagatgcccagcacctcttgctcccatgtctaaggggtactgtatggacacatgaagctttgtccttgtcctgggcccagaaggtaccagttgatgctgcctctgccacctcttagctgtgtgcccttgggcctgactctttaactaagactcagatgccttatctgtaaaatgcaaggtttaagcgccttcctcccaaccctaatgcttgatgttctaacttatccaaaatcctatttcgggggtggggggtggtcctaaggttgaaaataataaaatcaaggtgcaaagaagtgaaagcaagtctctcaaggacacttggccttttgggggctcagatctatatcctaaacattaaaaaaagtaaacaaaataatcatttatgctgctatagccttgtcagtcagagacggttctaaaacttccatgtgcatgaggatcacctgggggactggctaaaaataacagtttcctgggctccaactcagagattctgggatagtggctctgagctgggtcaaggaatctgcattttaatagcttctgggtcatccttctgcaggcggtttctgggccacatcctaagggcactgttgtgtgcccacagcacgggcttgtgggcctgggttatttctagttcaggctctgtcactgggtggccttgattaagtggctgtctctctctcggggtgcgcattgatgttcccactgcacagtgaaggcattttcacaccttttgaaagttcatgcaaccctttttgtcagtgaagtctcacagggaatcccagtgtataaaacggtggaggcagagctgaggcagcgcgggaaggaccgagtcctgccctcggcagccctgcagcgggccctcaggaccctctgtgcaatgctcaaggattccaaaggccctgtgcagttttgatgctcttcaggtgtcctgtgaaggaccacgtggctatatcccactgacggtgtgaaagcaggcccacccggcgtgcactgagtgactcaggcaggctggtctgaagcacgaggtgccttggtcttgctctctgagcctgcatggagaatcacagctcagacctggtgcttatagaggagtcttctcatggttcctggagttgttcccaactggacacagaccatcttggggcaacgtcctgggtttctcccctcttggagaccaaatacaatcaactcttaattatctttgttagtggagaagagcagggtgtgtataatctagaatgatggacaatccaaaacagtgaataatcctaagtaacattcattttcgactttggaatgcattttgatattcacatttgaatatggatatgtttgatgttctaggaatttttcatacttaaaaaaaacactcaacccaagggtggggctccctctctgcctcctactcagctgaggggagaacatcacctctgggactggcccaaagctacagtcaggtgcaccccaccttccccatctcctgtctttatggctcacaccttatctaggaagggagggggatattaacagattttgcctttaaaggacttttattccctttggaccttatgcaaataagagtaaaataagaagctgtgaaatgttaacagaggacttcattaagcaaacttggtgatagcatttgccaggaatggggacaatttgccaacagatacttgagtgctgactatatatgtgtcctaattaaaaaagtgatacttctcactgccctgggattgtgggccgtcttctggtgggtttgggatattaaccacaactaactccgatacaaagcacttcacatacattatcttacctaatccaccttcatagcaccccgtggagcaggtcccatcatcagcccccatgtagagacttgaatatcacagctccaagccagatgtcccccgtgaatataccctcccaattctgccctattctactccactctgcctctcctgtcaccccccaaacagaggccctgcaaagcctcagctggtctgcatcaatcaaagagaacgaagcaaaactaacttgccattactgccctagtctctctgattgttggaagtagagatgtttcaaggagaggttttgtgctggaagccccttgaaaggatggagagggagtgtgaggactgccggagacgcccagcctaggaggggaagctttctgcttttccagcaggacagaactccttagaagcaggtgtagccctggctcatatccaccatcctgagaaatagaaaatctttcccattttacggacaaggaaactcagagaggttaactaacacatccagggtcacagggtgtggtagaggtagggtttgagccatttgactccaggcctggctttttttcccccaacagtagccggtcagcagagggtgtttgatctgtgtggtttcctcttcagaaagcagagactcactactgtgccccctacctgcccccagctgagctccaaaaacagctataaagctgatgggaagccgataggacagcccctgcccttcctgaagaccacggaaacctctcccatggtgcccttggggctgagatcagctctgtcaccaatacttcagggcaaaagtcgttggcaccacttttaatcctaatcctgtgtggccttattcagaagccctttgcaaaggccgatccctagccatagctctctctgctcggccttgggctgggtgaataatgacttccatttcctgccctgctggagccttgggtctttgccactgccaccgtggtgctgagccacttatttgttgtgagatgacccaaggaggaccagccggtacctgctaggcccttctgctggggcacggggtcagggggcagcacatgggcatgtggccccactcctgtctgctccccaggacaactctattttccagcatggagtgcccctggaggtggcgacagctcctctaataagagagttactcatggcttcactggagagaagagagcagctttcaacccccctctcctaaacgcaacgatatttggtaacatgcggcatcttggggagagcattcatgtctgtaattagttactgtatatcacggttagtactctgctcagaatttacggggcaaataccatttaactgcacaataactgcaggtccttgctgcttattgggtaatttactaaggctggaagaacggggcaggagggattctgaatgggaggtattgtaaccccttgaatcaaactttatgagtttgggtttggcagggaggcagctgcttgcagccagttctcttctctttgttttgcagagttggctggcagactgcttccttcccttgatttattgcaggatgataggtctgggactgggggtgggactgcccggggctacctggggctatggaagggactttccatagagggtctttggctgagagtctgcagcaggaacccagagtcggtgtcctgggggctccatgcaggacagcaaatgggccctgtcatttatttactccctccacggggctgctttttgtatctgggccagtgggtggagagtgcagggagctgtccttggttggcagcatcaagataatcgcctaagccctttcttctcttgcaagtccgttgctgcctgggaagcagccattcctggacacttggccgacattcctggccttaatctgcttgagcaaagtctgtctttgtttggccatgcactgtctaaactcctctaacctatttaggccacagagaggggagaagacacaataatgaaaaactcaacgtgcaacattgccttacgcaatctaataaattacttggtacccggctgccagctcagactaagcccaatattgcctgcagtaattatttggatcaaatgcagtttatctgcttcatatttgtgcttctgtgctcagtgataacttataaatgtcattgtggtgtttatttgttataatgaaacttaatggcattggaagccaagagcagaactggtggggcggcaggtttaaaacaatctcttcatctcgggagaaggaatgagccaagataacatgaaactgccctatagggaagagatttgcagagatagtggtgtcctcgtgctgtgtggtggacgggagtgagccaggagctttgagctggcaccaaggggagccgtctttgcctccagagatatctatctggatcggggagacatggctgagcttcaccctgcactgccccatctgtccttgctgctttcaggggtgggaggtgttcagtctttataccacctgatgcctgcctgggataagagatgaatagggatggaaattagagtccctgggccaggcacggtggcccacgcctgtaatcccagcactttggaaggccattgagggaggattgcttgagcccaggagttcgagaccagcctgacaacatgtgagaccctgtctcaatttttaaaaataaaataaaataaaataaaataaaataaataaaataaagaactcctggatgactgcattatggagaacaggccttcagggagaaggaagggagcagggttggagaataaaggaggatatcatgagggcccagacagaaggtggcaaggctttctcttctggttctggagggcattggtggtaggaagcacagagcatgagcagaacagggaagagctttcaagggttgcagggcagggcccccactggcgctgcagaagtacctgaggcaagggccatttaatgtagaactcagggttttggcttcatacagtcctgggctctgctatttcctagctgtgtggctttgggcaagttatttgtctttcctaagtttcattttctttatgtggaaaatgtgagtgataatagatacctctcaagattctggtgatgattaaatgaagtgatgtgtgtaaagtaatgactgtggtgtttggcacacaggatatatgataaataaggggctgtggcagtgattggcacatagtagatgttcaataaatgttgaatgtatccatgaataataacacttcccacttgtgtgcattacaaaaccctcctccaaacagctgagcttggatttagacctcacaattgttcagggttgatcttctcattttacagtgggaaatggaggcccagtgaggttatggtaacttgcccaaggcttcccagctggtagatggaatggggtcttagttctcctacctcccagggcaaggttgctgccaccagtccaccctggacagctcccaatctgtgctgggagactgacctcatccttcctgatgagctgcccctgctccttggagaccaggcacagagcctgtgctgacctccccagcacaacctgggggcagaagcaagcgggccgctttctgtccatttcatcttaatacaacattcagcattcactcataaaatattcattttctctcctcggtgacatgctcatgcaagtctcctaacatcataaatatggatgaagactattagtcatttttatttatctcactagccccttccctccccagcacaccttttgtcttgatctcagcacaaatgggactgaattggggctattaacccggatctctgataataaagccttgcatcctgtggtgctttatactttttttcaaagcatcacgcaatcgtgatgcatattttctccttacaacaaatgcgtggaggaaagagggctagcatcatgagtatacccatttcgcagatgagaacatagaggtcaagagagatcaaggtcaaagtcatatactgagacaggaacagaactaatttttaaaaaacattattattgttatttgtttgtttgacctccaaggaaaggttctctgggacactgagtgtgtttgcttcacacaaataaataatctgtatagtattttacaagtttataaagagtgttcacccatgttacttggtgggtccccacaaggcaggtatgatttactcttgtttgacaaagctcacacaaccagttagtggcagatctgggctctaaaacattatttcccaaagtggatttcagggaccactagtcctgacacatgctgcaggaaaaatgttttgtggtcaaatgagtttgggaactctgtgagtcatatcccctttgggtggcttaccatggcctttggtgtattagtgtctctgagaagttctgcaggaaagactctcattttgttaggtctcatgtagcttctccccaccgtgtctaatcacgaaggctgcatctgacggaaaacctattaacatgctacagaaatgctgcctgtgtgtacgcgtgatccctcctcccccgtgtgtttggaggcagtgaggattagagcgtggctgggagaggagcgtgcaggggtaaggacggggtaggggacccactgctggggactactagagctgaagctcccctcctcaggctgtgtcctctctttccctctgggcagtgcagaaaattcactcaatattaggcacagtcagcccagcccatatctggggcaggatcagaggggccgcctgagtggcggagtggggggtctgtggtcagtgaatggtgggagatttggggacggcagtccttggccatggggaaaaatcaacagggacccacaataggggcttagtcaagtctgccctggacgatggtggggaagtcaccctatcctcgtcgcccagacacaaagctcccgaggcagggtggaagtaagaaggccaggctttggcgttcagctggcttactctaacatctgtgtgcctttaggtgatgatctaatctgtctgagcctctgtttcttcctcctcagaatgtggataacactacccactttgtgacgtggtgaggattagatggtgcaagtgtgcaaaagtaccctccttggccctcgtctttgtgtgtcagctccatctctcttcccctgcttttttggagcccctcagtcagaacaaatagcttcccacctccagtcctccacgagcctgtcatctgtacctctctttagttctcccatcgccctgccttctgccattttattatatgcccatctccccaatggacctgaagttctctgcaggctgctgctgactctctcagtgcccacttgtatctgcaggcccgaccatcccgcgtcttcaggccaacctcccattgccggtgtctggaccccttctcttgagggctttctctttagttgcggaggccactgtgccctcacacagagcaggccagacctgctgggagacaacaccctcacccagcagcactccacccatgccctacaggagctggtgcagaaataccccaccgcttgggtgccctagctgtgaggtggtgttcaatagcacttctcagagtttcttactgggactgggctctggctgcccatagtggtagcaggtttggggtccccccatgccgatgcctcctttcccatgtcaatttccaaccctcccgctggcacctctgcaccttcatgaggaatgactacactagcgctcttgcttagggcctgcttccaggggaacctgaggtaagataagggcatcctccaggtgtcattcatctctgcgtacacagtgggtgctgatgaatctctgaatccagcagaaatgagccataggaacagcgcaggggtgactgtcaatcaaggcaatgacgtcagtgggctcaccacgtgggtgggtcctgggagcaacgagatagaatacctgctcccttccacatctggaagcatccacagccacactcacacctctgtaccttccccacctaatgtttagtcaaaccttggcaggcacagaggagctgaggtccagggtcctttctctatgagctgagaacaggttagtgttgtgttttgagatccttttatgaataatggttgagaagtgctgctctttagtactaagaatagtggttattcctagtgcatttgactcggagatggggactattccattgctctatttgtcccacactcggtacacagttactgaaactgtcaccgtgtcctatattccataggccattatgtgtatttcaaaccgttatataaatggacttgatttggcacttctgaatgtcattaaactcctcccataccagtaacaacacagtttccatagaaacgaatacatttcagaaaggaaggcacagggaagaaagcagatggagttagggggaaaacgcggccccctggttcctacttccagagcacagggcccggcactgtgacatgagcactctgtggaggtggggcaagctccttcaggtttttattgactccctttgataaaagccctggataattcatctcagcctgaacctgctcattccagcgcacggctctaaaaactttatggcaccgcaagccattaagcgccttcgtttattccaacttctctggggctttcttcagaccctggggagagggctgggggagggtctcagcactcaaagaattctgtgatgaagcctttgaggctggctggggatggaaggaagaagcagagagaagaaaggaggcctccccggtgcagttgacatagtggagaccccaggatcttgccagtggctgctgtccaagtcactgggtcccctcgtcatcagtaaagctagaatgcgaaaactgcagcctcctggggtggaagcggtgtggcgtttggagagcctggctgaggagctgcccaccgcctcggcaggctgcaagtttcttgtctttggagggattcaagcataggttgcaacagcctcttagaataaaacatctcacagggcttatttctccagaagccatgctggacactcctctcctggcctacagtgtgattggattctccttctctgtttccaatagctacttattcatacccggttaccgcaactgcgacattgtattgtagttgctgacgtgtttgtctctccccgcaagacagtggtatccttgggggcagggactgtgtttttacatgcacagcgccaggcacagagcgggtactggacacatggttggtgaataaatgagcattccgccgtgttcacagtctttacacacactggtacttggcagggatatggaaccagatgacctttggtcccttctggcctggagaatctgtaatgataggggtctaagcctgccctgactacacccgggatttgaatctagatttctcctactcctaagccacagggttacgttaagaatattagtcgcacgcctgtaatcccagcactttgggaggctgaggcgggtggatcacccgaggtcaggagtttgagaccagcctgcccaacatggcgaaaccctgtttctactaaacatacaaaaaatcagccaagtgaggtggtgggtgcctgtaatcccagctactcaggaggctgaggcaggagaatcgcttgaacgcgggaggcggagcttgcagtgagctgagatcatgccattgcattccagcctgggcaacaagagcgaaactccgtctctgtctcgagagaaaaaaaaaaaaagaatattagtcgcaatgataaaaggaaaaccagaaccaaaacagccacaaaaacagctgggtgtgaaatgttggagaaaactctccccaactgcatttttcctctacactcaccacaacagtccacacaggagacctctgtggccaaacaggtgggagcagcggacaccagctgggtgtcctccaattcaattctgacactgtctacctggagatagtgtcagatcccacaggctgggggctcagtccccaagacttcccccacaccctggcacctgtcacaagttcaggcttccagaacttctggcagacccgctgcaagttgggggttcccaagaccttctgtttgggtttgattaatttgctagagtggcacgaagacctcagggaaacacttacctatgtttacagtttattctaaaggatattacaaagaatacagatgaagagattggggggaaggggcaggagcttccacgccctccctgagtgcgccaccctccaggaagctttacatgctcagctgcccagaagctcccgaaactcagtccttttgggttttcatggaagcattccttcccctagggtgtgaggcgggactctctcagggaagggtcttaagacccacaatcagaaagtggtgaaaggttagagtcctgcgatggggcaggggaaaggagggccggagagagatcctgtttcccgaggcctgcccctgaggcctaacacacccaacatatggcaaaagactgtagcaagggctatgggagttatgagccgggaaccgtggatgaaatccccccaccccatgcgcctctatatagaaacatgtctagatacatcatcacgcctcaggccatgccctgactttcaaccactgatcccttacagcaaaagaatatatatgatcatttaacaattagtccagtgcactgtattgcatgaatgtctcccagggtgaggccactcaggtttgcaggcttttttttttttttttgagacagagtctcgctctgtttctcaggctgagtgcaatggtgtgacctcggctcactgcaacctctcctgggttcaagcgattctcctgcctcagcctcctgagtagctgggattacaggcatgcgccaccatgcccgactaatttttgtatttttagtagagatggggtttcaccatgttagtcaggctggtcttgaactcctgacctcaggtgatccacccgccttggcctcccaaagtgctgggattacaggcgtgagccactgtgcccagcctgcaggctttctttagatttgaagaaaagattccaaaaccaggagtggtcccagcaaacacagcttcccccttccaggcatctggggataccaagcaaagagacaatgtcctcttttggttcgagactctttccagttgttaatgtagtattggatttccttcattttataacccatttttcgtttctttactctcaggtattattcctcattttctccactagtcgtttattttttacctgcacttttccacctttggaagggacattgggttcggccactgtgtggtccagatggctgctggcagcactagtccagccagtgcctcccctcagtccattaccattcatacccgggaaggttacgtaagttccaaacgagtggactattcttaccaccaggccccctagttggatttactcttagccctaattttgctagacagggtgaaggcacctcccacccccatcagggccctaggaattctgacataaggtttaaaaacacagtgacagttttttgcttagaagttatctctgtttccagcacttgtagttgcagccctggtcccgggatcactgcatcacacaggggagagagaaaagtttttttttttttttttttttttttttttttgagacagagttttgctgttgctccggctgaagtgcaatggcacaatctcggctcactgaacctctgcctcccgggttcaagtgattctcctgcctcagcctcctgagtagctgggattacaggcacctgccaccatgcccagctaatttttttgtatttttagtagagacggggtttcgccatgttggccaggctggtctcaaactcctgacctcaggtgatccacccgcctcagcctcccaaaatgctgggattacaggcgtgagccaccgtgccaggccaagaaaagcttttttttttagctgagttgggaaagaaagaaaaaaatagtcattataccagtgtactccttccttagcaagaattgcatagttatctagcatccttcccacatcctcttccccagatcagccagaaaaacagaggaaaaagtctagtggggacactagtaccactcatggtgtgtgtgagcacactcgtgaaggcgtgcaagccagcccttcatgcttttatgtccccattttagacaaccaatatttcaatagcctgttgtatttctctatcaaattcttactctaaggagatctctctgaccattgctggacattatgggcttacagtgtgtcccttggtctgaagaaatgatggtcagctgtccaaatgcatacaatatcttctgttccatttttttttaaatgacactctgagcacttctatcttctactgagtaaggaaagcccactccagagtcagtgtctattctaggcaagacccatttgtagacccgcagcaccagtctcacttgctagctgtgtttagagccttcccactagggaatcttccacatagccactggcagtctctgtctctcttgctggcagacagaatagctcttactggcattatgtgcctgagagggtgcaaagggaacatgtccagattcagcccatctctacactgctgcggtgcctccatatctacccatttcatgagcccaggtggccacctcaagggagcagctggggctatctgcgtgtcgattcccgtcaccttctgaaccttgaagggagttcttctgatgggaactgacttgttctgctttaatgcacccctcaaatttccatagggctgtgctccacatgggcatcccattaaaaggccaggtttccattgcccttctgcctggccactcggccaggccattggtcactgcccatgattcagtaaaacctaaacacagaggcctctaccattgttcatttttttccatcactattaggaaaacagcatgcaattcagctcatatgcagacctgtatttaccttgtctgatcaaagtagtaaccttcgaaacaggttggtgtccattcacattggaactgctgtctgtcaaccaaacagctcctgagtcaatcaagagctgttcataatgcactgtccacgtgttgatcgaatccagcagcacctcacacagttccagagtcagttctagggggagaagaagctccctgcctgagagtgtcttgtccttgaattccacaggcagcatgatcctctagaaaccatttccattttatgtactcttctgggcactgctgtccccattagaatgtttctctgacatcaccgaagacaggatgagtatttcaggtgggtcctgcgcacccaccttccaagacagctaaggtttcatagcaaggcagtaaatgccctcaagtggaaattctctagtccgaagtcctagcagttgctgctgggaggtgctcagaggtgtttgccataagccccaggaattgctccatagaagtatatggagtcttcccaagaggaggtaaactttctggggaccaagacaagtgcccgctgcctgtgttactctggatgaatcacatccctttcctgagtcttggtttcctcctctccaggtgactgccaatgtttcttttaaaagtctatgattgtcaaattatccagtcccagcatcttggagctactgactaggggcagagaaggtcactgtcctcactttgctgacaacatctatgcaaacactgtgttgggctcctgggatctaatggagaccaaacagagccaactgactggtaggggagacaggtgttattaacacaaaataactgggctcccagctaaaccccacccttaagcctggaactgcagcccttagtgaaaacaggtgactcaatttttctcccaattgttgcttttttggcctgccacatccctatcctgtgcccatgaaaagacttcagctggcagagtaacacaagcggctgagcgtcagggatacaagtggctgagtggtgagcagggcagcaactgggcatcggagactatggatagacgaggctaacttcagacagtgcagcttcagggaatgattgccttcttcctgcaccatcccctttccaactcctcattccgccaagagccccttccatctcccaataaaatcctccgcatacactacccttcaatctgttcatgtgacctgattcttcctgacactggacaagaagctgggtgccgagagggcaggagcttggacactgctgtggggccgcacagagcctgcttctgccagagatgagtgactggccggttccagcgttcattccctctggttcctgcacttgcttgctcacacactccctctctcaagcagtggccagaggtaggctgagtgaaacaagccactccagttcccacccacaaagagggtcaaggttaagggaattatcccatctcattagtaaataattgcaatatgaatgtatatgtacaaactgaactcagagctctgaaaggaaggatctggttctacgggagcatgtgacacaggaactggatcttgactgaggagggatgggtcagtggaggcatcactggagcagagacttgagctgtgatttgaaggatgagcgggaattaccaggtgaagggtttggggatggggtgagcgtggcaagcagggtagacacagggagcagggtagacacaggccctatgacaggggccctgcttgaggagcagcaggaaggcccatgtgactggagcgcagggtgtttaagggggtaggatgaagtcagaggtaggtaggaaccagatcacgtggcaccttgtagaacatgctaacaatgtgagcattttttttttttttgagacggagtctccctctatcactcaggctggagtgcagtggcacgatctcggctcactgcaacctccgcctcccaggttcaagtgactctcctgcctcagcctcccaagtagttgggattacaggtgtgtgccaccacgcctggctaattttttgtgtttttggtagaggtggggtttcactattttggccaggctggtctcaaactcctgacctcaggtgatccacctgccttggcctttcaaagtgctgggattataggcgtgagccaccgtgcccggccttcagtatttttttcttaaagccattgaaatattttcaaaaggaacatgacatggtcaaatttgcatttcgaaacactgctctggctaaagtgtggaaaacgacctgggcatggggattgggcatgatagatgcaaggagccagttaggagagccctgatgcagtccaggggagagaggctggggacagggtctagggtggtggcatgagatggagagaggagggtgggtacaggaggcactcaggagataacatccctaggacttgctgaggactggatatgagtgtgagggaaagggaagttataaaggaactttggctgggtgcagaggctcctgtctgtaatcctagcactttgggaggcccaggtgggaggattgcttgaggccaggggtttgagaccagtctgggcaacatagtgaggcactgtctctacgaaaatttaaaaaattagctgggcatggtggtgcatgcttgttcttctggctacttgggaggctggggtaggattgcttgagcttaggaattggaggctatagtgagccacgatggtaccactgcactctagcagaatgaaaccttgttttggtgaaaaaaagaaaaaaggaacttggcagggtctgcagcttaggggtccacagtctaagagaggcaggactcctggtaggaggtaggaaaggtggctggaggaatgggctgagaaaaagctttggaatgttccctcagatcctggctggagagtggaaacggcaggtctcttgttccaagacactgagcgaaataaataacaatcataaagtgccctgtaaatctgactcttgccataaataataaacagggatattatacaaataacgggctttgcagccccagtggaagaaaacacatcagtaagaaaaatgaatttagaaaaaatgcaccccaaagccccaactaacaaaatgacggtattagccaacatcccgggggctcggcaggcagtggaggaatgggctcaggaaaatgactgtggcccttagcgcgagccagactgtacggctgcaacagagtgagaagtgctgccggtagcagggaggcctgctcatccctgggtcaggtccccaggccaaggaccctggcctgctgcttcccctctgccctgagaaaagcacagctcatcccacaggcctgcccgactctttccctgccacccagcatatagctgatatggcctgagttcacccttaatgacagatgggagaaagaaacacggatccaccttcagaggctgccaaggaaagccagtctattgacttttttgtactggttcctttggtgaccaagacatttaaaattatgggatgggctgtgagaacagggtgtgggctgggtgttgagatccaagatagatttttgaatcatcacattttagagacatacaggtcatcttatgaaacatgattccattttgcacatgagaaggttgagatcttagtgtctagggacttgcccaagctcacacagccggctcctcactcttaagtgctcctcccactacacatcccagctgtggggcacctctctttctatacgaggaaacagtagaagctttagactcatttttttattagtgtacgagggtgcataaagaacaggctctcacgccatcataaagaactttagagctgtcgaagaaatgagattctcaacctcccagggctctgactcccctgtaaggctgggaagtgaggacaggtgctgtgggggaggggcatttgcacacagagcctggactgggaccacagtgctgttcgggagctgtgggccatgcaagaggctgctagttatttatggaaccagctttccccttcctgggtgctccagctcttcccacacagggtagaggtctccagtcagcaaaagctgcctttgctaatcactcacaagtatttcgtcctgaaagatgaaagggacagcacccagaggcatttctgctctcccttggtctcttgaagcagacatcattgcaatgctgaaagtccacggaaaccgacacccaccctgatgggcagcccaagaaggcaccagtgtgagggaggagtaccctcctgtgcaggcccccctctgccccaaggggatggctgaaggggaggtcaaaacttcggtgcctctgcttcttccctcctttaaatatcctcttcctcatttccccttctcaagagtcctgtggcctgccagcttttctggtcccccaggaatggtcttctctggtctgtgtccctcactccaggtctcccctgattttctgcaaatcaactcaagttttccctgtgttctgccctttcttctccctgccttgccacttcctctctttccagccaccctgaaaaatgaaaccaagctgaagtgttagaggctttccctctgctcatggtctcagcctcctcttccagaagtctaagagccctgggtgtctggagccctgggctgtggtcctggctcttccagccacttcatatgggccccgggcaagttgctgcatgctcttgggccatgctgtgttattgggttgcactgtaatctctagagttgttgacaggtctaacatagaggaggcctgagctctctgaggcaggcacagcccctcccctgatacatgtgacagccttctactctgcctgggaataggatcaggtctggggaagccatgtgctttgagaaggtgagtggtctggatctccaggagagagaggtcataaagggggagggccaggaaggggaggtgaaggttgtgtgcgtgtgtgcacacatgtgggtgtatgtgtgcatgtgtatacatgtgtgcaggtgtgtgcatgcatgtgtgcatgtatacatatgcatgcaggtgtgtgcattgtgtgtgtatgtgtgtgtgcatgctcatgtgtgtgttggagatgtggctgaggaaccagtgagagtaaactggatctacttaaagatgtcctgagagcatgggctggcagtaggtggggtgaggaaggagagctggtacagaaagaagggaaactacccctggggaaggcctcctcacccagccctgcttccacgacttgcctggaccctactcccaggaaggggctgtagcactggaactggaagaaagcctgagagtgagcaccaaggtagactctaggaatcacccaaaacagggagaccattttgtggactgttccacatctgtgtgctctatctgaggcgctccttttcaatacctacctgacacctgtggggactttgtacattcctccattgtcactcagggccctagttaattacctaaatgaaagttgagcgactactccctatgtgcaagacactgggcgaaggcccagggagaggagaggaaggaacaggagtctttgccctcctccagctgattctctacatgggactgacagcacatgaggaagcagaccaataaataatcacacatcatgataggtgccactcgatacacacaccagctgctgtgatgagcacagggtgcagggagagggtgtctgtgtaatttaggtagatggaaggcaggatctctttgtggaggtgacacatacactgagatgtatttttactgtgagctccttgagggcagaaaatgtgtcttactctacttttttttttttagatggagtctcactctgtcactcaggctggggtgcagtggcaggatcttggctcactgcagcctctgcctcctgtgttcaagcgattctcctgcctcagcttcctgagtagctggggctacaggtgcgcaccaccaaccctggctgattattattatttttttttgtatttttagtagagacagggtttcaccatgttggccaggctggtcttgaactcctgacctcaagtgatctgcctgccttggcctctcagagtgctgggattacaggcatgagccatcgtgcctggcttgtgtcttatttttatagctccagtgcttagaacaattctggcacttgtaagaaattggtattatttttatggtattcaatgactgtttgatgaataactgaatgatcactcatcagcagttcctatataaagcacatgtgcttaatcacatgaagacaatgatctcaaacaaatgtgatattgttatggctagtctgtctttacttcctcctttcttgcctgccctttgttgatttctgtttgtatctccttttgatggctcaattgtgttgggtccacacagtagaggacacacacgcacacacacacatacactctccatatattaccaaccacctccattcctgcaaagactgcagattctatccacgaagctattaagcactcccaaatagagcaaacctctcattgactatcacgtgcctccttaaatgatctttgaatagcattttctttttattgctttgtgtagtttaacggcaccaattgcaattactctaacttatgataaaccccagatctataaagctcctgttcattcattattttcctcttgctccttctcaagctgttattttttggaatgtagtgaggagggaggagtggagagagaagaaaataaaaggacaccaaattaacaggaaaacaaataaaatagggaagcacttctccctgggtgacaggcaccttattagatactgttaaacagaacaaatatgctttaatacagcacaagtaggtcttttatatttattctaaatgggaaatacaatgatcatcaacttatctttaagggaagaagaagctaattgttctaatatctcactaatcctagcaactgggagaaaaataattgtttttccctattttaccaattgttcaatttataccaaggtgtgttgtgtagcatggacagagatttctatttcttgatgtatgtcatggctgctattccattttaattattaatatgtggaaattataattattttgagtattggtatgagataattataaatataaaacagctccgcatgctttctgatgcctttcttatctgcagacatgttggagtttgggcgtatgagctttagagagagagaaatgtataatgtggtacttagggcagcaaggctggctggagtggaagaagaggagcttcctccctccagagccctccctctccttcacctctgccttccagctctccagagccaaagctgacccacctgtgtctctcctctgccccactgcctcaccctcctcttaccctgtctctgagttgttagttgagatttctaactcatcacacatgttggctcagcttgcatcccatcccctcatctcctcagccacccagaagctgaggtcagatatctggagctatgggtttcaattccagcccagctcctgactttttggcttccccaatccctacaaacctctttcgagcttctctaatgagcatcgccagcaagagaacatgtctattcagcaccacggacagaggcacgctgtcagttcccacaaattagaagttactgcctagcagtcttgtcaaggcagtggtgttggggagggaaggggaggctgagaaagagaaaagtcagtaaaggcaactgactagcaggacacagaaaatgcggcccccaactctggttgtactcagccatggggttcctacaaatgggaagtagctttttgatgctgttggcttcaggcaggcagcaaatgggggaggtgatcacttcctgtgcttaattgtgctggcctaactcttgtcagattgtcaccatgatgggtgctggaaacaggtccacagctggcaaagtctcaggcatggggagcgcatggggatgtggttgtcgtggtcggggttgggaggagagacagctgaggagcttggaaagagggcactgagaccatgctatggggatagagatggtagaaagaagcttcctccttcttgctggaatgggaatgaggagacatgggccctgggccctggaaggggaggggtccagcccatggcaagcatggctggtgggagccaaggcttcatttgtctgactttaatgaataaatggcatccccagccattgtttatctacttttgaatcctgacaaatagtctgtggcatctgatggagagggttattagctgcatggagacagatggctagggatggagaggattggttctttattacagcagacccgtaagtgacagcactcctcctcccagcctctatgccaatgtcaacacgtttctcaagccttcagtgacccaatgaagccagtgcaagaggaagacagaatggcctctgagtaagagggaggggtagggtcagtggagttgggaaagggggcaggtttcctagggtaagttctttgggaataaagacattgccatattcttctttggtattctcctaagtgcctgtatagtgctgtttattcaacaggcattcaagaaacatgagtgatggaggaggcaagtagagaggtctggattagaaatgaaaataggagcagatttaattgggctggctgtggggtggggtgcggaagaaatggtagggaagagagaggaagagaagtaggagacacaaagggagaagggaagattgcataaagaaaatgcccctgaatcagcatcctgtgtttcaggcattcactatgcttccccatgtgattgtacaaatggcttcatggaaaccaaactggtcttcccactgtccccttctgagaggtcccaggttcttattcctggttcctctgtcctgtggctgtaggggagagcttcctccctccagattactcccgagacaatggggaggttctcactgaccttcattcattctccgaaacttgtccttggccatgtagcccagcaccagacagcatcctctcttctggaggcccagctctggaagagaagcataggtgggtgagttgggaatgggaacaggtcaggcattgttggggggccctctgcagggggctgtggagcttgttgctcttataaacagaggtgcttttgtttagccaacatttatatggaaattgttatgttccaggcataagtttaagccagcaattcttcattttgattctcataacaaccctgtgaaggatgtttccccattttctatcatccccatttatagatatatgaagttagtggcactggatgaaagagctagcaggtggtaaagccagagctttgaacctaggcagtctggctctgagtccatgctcataaacataactctgggttattgaggccctttgtatctcaggcttggggactatgctcagatcaacttgggactgtggccagacctgccagggatgatgcagaatctatccagtcgtgtctaggatggaacagtgcaaccagacatggtgggtgactcaggaggatgaagtgattgcgtgagtttagggcagcggggcgacacagaggttaaggtataggcagaagagctctctctaccttttggagagggtgcgtttctggtgctagagattcctgtgccttcctatatcaaggcccaatttagcaccatcatcaagcacttatgaaatgtagacttagagcacaggggtcgagatagctgagagacacggactccacagggctttgacccagttggaaaaacaagatggaataacaattccaggtagcaaatgcaagagataacttttttatttgcacagtattttgtaaatcagtgtccattgtgtgtgtgagcattaaattggagtccatctgcctcacaagaaggcaagctttcctctctggtatttgtgctttatcctgattcatcttaatcactttatggatcctgaagcaatagcacactaatttttttgacccccctctacccccaaacaactcactgaggtgggcatatgggccactgcaactgacattatgcagatgggaaaattgaggttcaaccatgttaaatgacttcccacgattgtcttagacccccaccccaccttgtagcatagaagtcttacaaatgtgtcagctgccacaaacttggtaaatagataaggaatttgatttctggaagagggaatatgactgcagctcttcctggcccttgccagggtttctgggctcctccctgctccttcctttgatttctcagagaaagagggtcccaatgagtgatgcatcacagcaccttctcccacgacaccgactgcctccctgaacccagccagtcagtgtctaggctcaagaggatagacggagcgggtcattcctctttctcctcttccatccaccgtctgcagcccaggtccacccaccaagcatagcaggatgaaagagagtgcagggcccatgagacacagataagtcaagctcaggggctcttgccctagagaaaaacaaaacatggcaggaggtggcagaacgccacggcccagggaggtccctggctttgatctcctgattctttaaaggggtttattgactatcagtaaagagcagagaagcagatctgagggcactgtttccaaaggcactcacttctcttccttcccctccacactggcgtctgaaggcttagccaaaccgccctcacttcaaacggtcttacatctcaggcacccaaattgacgatgttaagttccctcattcaaggccttggccctttcttcaggggctcctgctctgtcgcaggcctcatggatcaaagcccctttgatgtttacttactgtatttgtggattctttctaacaaccaccttcaagaggcaggaatgcagccttccaggagggggccagtggaagtacaagctgcgaggaggtgctgagctccctggaacaatagcctctcgagggagactgtattgaaacctcaacacgctgacgacaggcagagttaaccagcccattgtaattgcacacgcattgttcatcattagaatgatacaattgctgacaattcctattatatttttgccattgacttcgtatgcccatctaaagcacatcagcaatggctcctaatgagaaagggagtttgggctcctggactaagcccaaactcaatccaggagcttgggagggaggcaggggagcactgagtagggagggcagaagatactggatggatttaggccaatgttccagctggtcttctggactgtgactgaacgctcaggcaaatggaagggcgaacaattctcttacagatttagagagtgtgagcaatctgttgactctggattgtcttagttggatagagaactcaacctctcctatgccacatactaggacaccccccagggcaactgcttgaggagaggctgtgtggacaagtggttatgatataataactaagagtctcactgattatgtttgatttttgcaaatgagcaggaaaagaagttttaaaaaacctgattaataaaagaaattgagaatgaggcaatttctcaatgtatttggctcatttaatttgacacgcgtgggttagtcttaattatttaggcggctacgttacaaggcgctaataagcacactgcagaaatttattaagtgcgagggctctctgactgagactttgtagagaagtggggagaagctactgggatctttgcaagaacgagcaggttggaggatgagtgaagtgagaattagttaattgtccatatatgaaaatttgggatgtcctttggagagatttgcaaagctaaattaaaggtcattgggttcacatgagtgtgccagcagggagtgaagtgggggaagggaggggatgctggaaacccaagtggggaggtgaatattgtccaagctactaaccacagagagaaccaggaggaagcaggaggcaattgctttggcttggggagactctaccaagccaaactaactaggttattaggagagagatgatagaacatgacagaaagaacaggaatctctctctttgtgaggtagatcagccaccaccagactgtcaccttccttgtcccatagcatggagatgaatgggagagtcagatcacagatgcacattttggaacagtaagatgatgggatcttctccaagtaggctttgggggtgctgtctttggctttatcagtagcagaaacacccagatactctaaagctggctatggaaaaataattaccatgaaaggagtcagccctggcttaaaaggaaagttcatagcaaggaagtccagggtcacctgcagatggggcagtggagggcactgtcccaggaacaaggaaggtttaggaataccacctgtgcaaggaaaaatggattggagtagggtatgtttcttagggagaagataagtttgcacccttgggaactcctggcctctggactctgagcaactgaagtgtcaggactgtgccttctcctgctctgagcccgtaggaccaagcacagtgcctgacacatggtaagtgctcaggaacagtctgctgacttaatgaaagggctggctacaaaatatgggactgtgaagggttccttctgactcgggtcagaatgaaaataagtgggcttcactgtagcacaatgggtttaggttagcagaggttggttgtagagtgaatgaaacttgtagctcattggaagagaagcctagataacatagtgggatttcctcctgggagaaataaaaggggatggctttttaaatgggatgggttttcttccatttcagagggtgcagatgggatgttttctagccttagaattccttcattcttactagtaatgtagtgatacggtggtattatttcatatttgtgggatacttattttttaatgacgctgtcatattccctttctctttagatgctcacagtaagtagctctgtgacacaggcaagtcagaaattatctatttcattttggtttcacaaactgaggctcagaagtaaagtgacaatttaaggccaacacactagctggtgatagtgcccatgctggaacccatggctgatttttggcttggttcttagggtaaagtacggggtcgcagagctgcagatgctgcaaatcaagacagaccagagactagagcacagatcagcggtgtgggctgggacagtgctataggtcgaattcctcaccaattctgtgttcccctcctgcaccaaattcgtacattgaagtcctaatcccagtccctcagagtgtgaccttgtttggagataggaaatttgtagaggtgatcatgttataatgaggtcattaggacggacctttatcctgtgactggtgtccttatgaagaggaaaatctagtgatagacacatatacagggagacgctgtaaaaacttgaagacagccatctgcaatccaaagagggtgcctgggacagatccttccctcccagccctcagaaggaaccaactctactgactttggacctccagtctccagaactgtgggacaatacatttctgttgtttaagccccacagctggtggtactttgtaacagcagccctagcaaatgaatatagacaggacagggaggagtgggtcttctctgaggcctggcaatttccactggccatggttctctggaacccagcccccagagcacaaagctgcctgcagggagcagcatcacactctgctaaggagaccccagggtggctaagatctgttgggagtggcggccacaagtgacaggaaagagggaaggtggggagagaaggctggttacgtgtctgcatgcctggcacccagcggcaagctgggatgccattagcattcctgcttccagggtgaggaccgtattggccaggacagcacttgctggttgcctggttgccctgttcagacattaatgtgccctcaagtaactgcagatggagccggtgacaacggataggcaccagcctctgctacctcaccatttctgaggccatcaagtgcatctggatggctgcttgtagaaggccttcctgtcctgtccccaagttgcccagtcacaacagttcaggtgtgcttgctgaagactaaccccttcccacctgaagctagtagactcgagcacgtctctggaagcctatcaaacaagaaacagaaattaatggcaggcagtttggtgtggctgtagcagaagaaaaaagatgagacaggagatctagccagggaccagatcctggagtagccaatgagcctcacccaggagtctgggctctctcttaaaggaggtgggagccacgcagaatgctaggcaggggaaagacaggtgagacttgcatttcataaaggatcccttcagcactggtgcagatgatggatgggagatgagctcagagaagggaggctggctgggagaccgctgccatactccaggtgggagatggtgggcttgcatctgctgcttcttcctgctctctgaagatggccagagatcagaaagcaagggaaggaccctcagttttatcctgacattcatccctgccacgttgacatagagagcaggggaggggctgaaaaaatagctcccattccccagacagtgcctgagatcatctggaggagacaccagctgggtttggttggactcacagggaggccacatggggcaggggaggtttcagaactaacagagctggctggagccatgctccagcacttaccagtgagcaactcttaggcttctctgagctttggtttcctcatttataaaacgttgattctaacggtaagaccctcctcacatgattcatatgaaaagcaaatgagccaacacatgggcaaaagtgcccagaatgaagtacctaataagggtgagttcaataaatagaaacaaaataccaaattctacccccctcgtttttttctttttcagatatgaaagtggagatgcagagaggtggagtgagctctccagggtgatataatgagctattaggttgcatacttcccaggttagcacgtagccaacagtgacatggactggaaatgtgaggccagtcaggaagaccagccaggtggctgtcatgggagaggccaaggaaccagagagcttgggaatggagaggaaatgatgaatcagagacattccaagaagagacagtggtgctaagtgacagagtgggtcaagcagaggaagagggcaaggatgaccccagtgtcttttgtgggatataatggacaaagagacatgtctgtatcagagtagggtgatgacaaaggaagcctattaagtcacaggtgataatggtacatttctggacttactgtgttcgaggtgacaaggttctaaagtgaagaggacttggatgatcatgtgagaaggagttctaggctgaagaaatatttttaaccagttgcgttgacctcagagggtaaacattttgttgggggaaacagcagttggatcctgtgggtagactctgctacaagcattaatcctacccctctggaaccaggacacattaataaatgtgactggtgtaaagtccaaggcacagacactcgcaaagaggccactaagtgctgggcactatgtgcaagagaaaaaaatagtaggcaaacttcctagcccaaagatactataatccagttggctatacaagacatatacttaagaaaaggtaactaaaagtcagagacaggtaatagttcggtaaagaaagtcttgaggcagcacgcaagttatttctgcatgaatggcaattcttactgcaggagtccccaggaggaaaagacagcttcaggctgtgggatggtgagggaggtccttgcaaaaggccttgaaagctggagattgtccctagttttgtcttagttttggatgtctaccaatggccctctcattggtttttgtctatcaatagccatcagtagccattctgcccagcgatgccattctgattgcagaatgatggggtcttctgtttggaaagttttcactttgattctgctaaactgctttctgcatcggttctgcctactcctattttcagcataattactcatatcccaggcaataataatgcccatacatcatgcaaagatcataattttctgatcaacctctatcataaagaggactgaagagtggagtagcaaaggtatattaatcctgactagtgcctggccctggacctccaggacgagtgataaatgtttaattagcccaataatacctgttttataatttttggatctcattgcttgctaattctaagtttactaaataactataaactttacgttgttgtaaagacataattgcttcttcattgcttatttcatatgagttaattatactagaactaagtttttccccattcatattatcaattagttgttttaaactattgatttgtatttaattaactatgctattacataccaattaaattcatataagaggaatctgaaacagctgtggtcttaaattacgtttttgaaataatgagttctataacatttcatgtcaagttattgtcagttaggaagagttgacaatcatttgtgataattccaaaaacttgttgtgacccgccagcccatctcaccagctccagcaggcagcaagcctccctcacacacctgctgatcacgtgccgatcagcaccttacagcttggtaagcagtggcagtgcctaacactgggataaccctttgccagccctgccttctccagcctgctccagccatgccattatttggctggcatagctctatcccccatgcggccaaggcaggcattatcagcaactcctcaccaccagctgtggggtctagaattatctgtgctgctatgtctcagatcctgtgtgcctgcaggaaatctacatgcccatgtggtcatctatccttcggcttctccaaatctctgctcactggcttaagtctgtacatctcaggtgggaaaaaagacagcagtcatttgctgagctgcaagggacatttaacttttctcatctcgtttcaccctcacaacacctttatgatcacaggtgttattctccttgttgttatttagcgagagattgacactttagaggagtgaggagtttgtcctgagtcccacagctggcaaatggtgaggcttgccgtacacctccatgttggtgcttgttggtgcgtcgtgccatgctctgtctccattctctgtgagattcgactcccaaccaattcggagtctcagccctttgggctggctttttgataccttgcctagctcttatcatctttctctccttggagggctgggttcctcccctaccctcagacactgcctgggatctttctcccaactgatgaattgcctggaattctgacacagccatcagctttctctggggcacttggccatcaacatgggacccaaggttggcagagctcaccccactcctctgtacactgaaagtgggacactggttactatctttgggggctgggtgcagcccagccttgcccctctcccttggccagcatcaccaagtgtctgccacctgggaccaggctcatgtagttcaccatcacaatgaaagctgccatgtgctgattgcttatgcttcattagtctctgggctgagcactttgcatgccttaccttctttattcctcatcaaaactctataaggtaagtgctgttattattcctatttgacagaagggaaaccgaggatccaaaaggttacaaaacttccccaaggtcacattgctagtaagtgctgaggttagtaaagctaatcatgaatgagattctttggacttccagtataatccgtttgtgagaggggtggggcggggggatgttaaataatgttggttaaagaattttacgggaaacagttttatcccatgtgcaaggatgcctcagcccgtctctgatttaacgtatctaattccaatgagttacttgctaggtgggggaacagagaaataggatcatgaaggccattcctgtcctccagtctgtcttccacacaccctgtgaggaacaggggctgccaaaagccatatgcctgagggctgttagacttttcctaacagaaagttggaagtcgtgactagtgtttgaatggggccagatgctcgacagctatgtgtcctacccctggggaggctcagcctggtccattcagtccatcatggctgggaggccaggcaggaaaaggcatttctgctttccttatttctagaaggaccaagagttcccaaaagactaagactgaaggcaataaggaggcaggcaaagtcccagcctgcctccaagtattcccttccccagcccctacagttctcttgaggccaagatctttgcaaagccagaggcccaataacaggttatacatacaagactgatttgtgaaattagtctttgcccagattagtgaatgtgtggattattagctttgctgtacaggtgaggctcagggaagccaagcaattttcctaaagtcacacaactgggaaatggacgacccaggattagaacccaggcccatttggttccagagcccaggcttgctgtgcccttcttccaggatgtggtcccaatgtcatgcacacagcccagctgaccagcagagaccccagtgggaagaggggaccccccccccgccaagcaggtgctgctgatggagtcacaggcatcactgtcaggtggtcaggagcactgagaagcccttgtgggagtgaggctcctggagagcccctttctcagggactggagaggcagggaggtggggtgaggtggggaagcgtggagaatgcctgcctactcagggtgtgcaggcagcaggggcggggctgctatttagtgatgggcttacaaaccttcttgtcacctatttatggcccacataaaactctgatcactgaggattaactgaagagggtcctagcagggccacacgctgactttaaagaattgatcactggagtcaggcagtcatgtccagcccctgccctcaagcccctcacatgctgccgaatgagtaggggtagggggagatgtctgctctcacttggcacaagggaagggggcagagagaagaacaaaatgtcctgcgagtggggagtgcagggtttttaggggtggagatgtgtgggctaaggtccagtgggctgggaatgccccctccacattctgggtggaaaagcggcacaggagggaggccaggggacagcacgtccttgcccccagccaagtcacagtcacagctgcctggttcacagtccagtgggcatgcgttgcctcgcggggtgggtcctgttcacccaggaatgctgcgcaccttcactggggtggaaggagggagggctctccagctctccttgctgtctctcctccctcacacgtttccgcagagaggactgtcctctagggcattgtaacttgggccaccttgggagctgaggctggtgaggagcagaggatgaggaactggtgagatctccccaacagcagagccaagcccaggcagctacccgcttcccccacccaccccagcccacacagcaaggagggaaagtaggcggtggggttaggagaggacccagcggaaaaggcagggaaccccgctgtcctcccattactgaaatcctccttgagccttacataccccattacgacgctgtatcctataattaaattgaatctgccagttacctctcagcacggcagcaattcaaactcattggaggctttgtttattttcatttatttatttatttagtaattatttatctagctatccagagagctagatggaggccctagcccaatgtttcttttgtcttcaaaaacaagaaagctcaaatgcagtctctcccacttcaggtcaagagaggaaaggaataacagagaccacagggtggcagcagatccgcggggggacctcttgctggggggatatcgctgggacagggttaaggtcaagattgcaggggaagttttgtctgcctgccagtcatggtctggaccctgctcctgattctacccattctattcttgtcagagatactttatggaaagtccacacattccagaaagctccatggaagccccttacaggccccagacaaggggcttcattctgagggactagaacatcggttgcggaatgtggaaaccaggttaactgagtattattggcaactaacacacctgcagagctttgcagttgaagaagtaaatacatgttcttctttaaccctaaacatttatggaggacactgaggatgagagaggttccacaacctcccttgctcaaaatcaccctgctgctaatggcagggctaggatttgaccacaacgcttggggtaaaaccaaactcccccacctccttcagagccccatatccaagctggtggcccagcaacaaaaatcaaagctcttttcttctctttaatgataacctttcagcagtgagtgggcaaaggagagcatgatggctttgagtatggaatcaacctcaaacaggtccaggggagcgattctgagccaccagccatcactcaataagaacatgaaagtttatttaccacgaggccagcccagtgggaggcagattgctactattagcatgccaaggactgcacagaccctgcacgtcaatagctgagccccagagaagtgaccccttttggggttatccaatctagcagccccaccagagcaaaggacgagggtggctgggatagtgtgtgcttacatgtgtgcacgcatttggagaaagggaaggaattccagacttgagatggctccttagacttaaatctcccttgaaaagaaaatgctgcttatgaaccacttccacccttgcctacctactcctgccaacccattcatttgtttattgatgagctgcttaatacttcttggaataggaatgaatagtacgagaaaatacctgggtccacactggcaattcctgggtctattctggaacaatcatgcttacaaggttttcggtgcacatgggaggtggggatcagtgtgtctctgggacctatttacccctatgaaccactggggttcttgactcaggctctgtcagtccacagagggtggttatggcaatgtggaggaggccggtggcccagggcctgaactgcaggagaatttatacttcttgttcatctggagaaagttctctggccagaggacacagtgagggagcctggtttaaaaaaaagaggcttaagctaagaagcccggggagtaggaagttctatgctaccctggcttgaagctttggacagtcggggcaggttctctcttggctcctgaggccaagagaagccagcctaggaaggttggaccattgatcccacagccctggggccttctcacagtagtgtgggtgtcacaaccacctcttagctcttgatcagagatatccaccttcagtctcctcaatgtgtacaatggagaggtcttgggctgcaataaggactggagataatgtatgtacaatactgggagggaagggtaaagagagttgtgttcctaaaccctgtctaaatgtatggaaccaaggccggacacattgtaagcccctataaatggtacttacttataaatataatatattattagaaagtacaggggtatgctaaaagtcaggaaaataataagatactctaagattagcctgaggaatccagttctgtagcttgaatagagactgctatgttgttggagttaatacccacagcagctcaaggaacagctttgttcagctctcagaggaaggggctgcctggtggctgtcctggggccgctgttccttctatcagggattctcacacccctctcaagcatcacatttcattcatagttcaagagcccccaagaatctcctctgtgtgtggccttctccacccctacccttgcagatgggcatcccctcctctggacaccaccccccgccaactgccttattcatacctcttcattcattcatacctttgctatgagactcccttatagatgcgaccacggttttgaatttttgctccaaccctcccagactgtgaggtgggaaccatctctattaatctctagaacctggctcagagccaggcacatagtaggcactcagtgcacatgtgtatgtgacgagtaactccacagacagggatgatctactctaatgttcaacagattaatatttgatttagcactgtgtgtcccttcaaaattctgggggccaagatgagggctgaggtctgagatctctgctggtttgagaatgggacttcctcctaccttcatttgtccttccttttacagaactataagtcagcctcaggtatgggtcagctttatgtagttaaccttccagtcattcaggtttttatctttgagtttattctaatttcattcattcattctcattcattcattcattcattcaaggagagctcactctgtgtcagttctggctgttatggatattgtgatgaacaagacagagaagaatttttgccttcccaagcttccattttagacagcttctatgtagttcctttcccttacacgtaatttagaggtaggaagtttcatgtgggtttgggcaaattattaaacatccctggacctcagcatctccatcttcaaaatgctgtcaccaaaccctctctcaggctggcagtgtgccacccaccacagcttggccttgcatggctggtgcttggtaccaccagttggtttgaatgtgggtgcacgtgcatgtatgagttcattaatttgcttcctttcttctcaggcacttagatttttgatgcacactgagagggtcctttttaatcagctgaggagcaagggattcctgagccacaaatgaggctctccctactggaatgcagaaggaaggacaagagatgagcctttactgagatgctgctatctgctgggcactttacacacacacagttatgccatttagtccacactgtaactggggagggagttgttgcttcctgtgcttctcatatgagaaaactgaggctgagagaggctcaagggctcccataactgaagacccgtgccttcgctgctgccactcaacctctgggtgggggatggggtgctcagtccacgtggaaggaagagagaaatagaatgtcacagagctctctttcaataaagggctcagcaaaatgtttgtcttagccgcgtttcctatcgacccggtgtgtggcacatggattaagtatgcagtttggtggtctttaaaggatgaacattttctctaggatcaataagctgagtgagtttgggtctgaattcatcaaaatgtcacctgaaacaaattcagtatcaggacttctgcgctcaggtcaggtcgatgggtgggggcagagacaaaacccagggaataccaggtctctgggaaaaaggtccagggcatctgttggacaaatttgggtctgataactcagagtggggagggggtcctagctggcaaccagcatcctagaaactaaccgctggcctggtacagtggcttatgcttgtaatcccagcactttgggaggccgaggcaggtggatcacctgaggtcaggagatcgagaccagcctggccaatgtggcgaaaccctgtctctactaaaaatacaaaaaaaaaaaaaaaaaagattagcggggcgtggtggcaggtgcctgtaaccccagctattcgggaggctgaggcagaagaatggcttgaacccgggaagcggaggttgcagtgagctgagattgtgccactgcactccagcctaggcaacagagtaagactctgtctcaattaaaaaaaaaaaagacactaaccgtcctttctctggtctagacgtcatccttaccttcagagagaatagctgagtgagaagctgtgtgaaactgcccagttctagattcttcgaacaaaaagtgtttttgaggttaatcagtgccattctcacacccagtgctaaaggattccccctttagcaccttggagaagtagtcacactggtttcccttggatcgttctaaagacagggagctcattactttggaagctgtggttttcatttttggagagtttaaataattttagagttcttctatgttgagcttaaatattccctacagccttgcaactttgcctcattagtcccaaatttgcactgtgaggcaacacagaatgagactaatccctcttccacccaactactgagaagtttaacagacaatcttttcttttccaaaataaacaacccttaggatgtttcggtcctgggatgcttgcagcccaggaaatgctccctccctctcccctccagcttctctgcaaatgcaagactctggcttcattccctggtccttcctcagtatctcacaaagaaagaggagggcaaaatgggaattcattggaagagatccttggttcacacgctaggaaagaaaagggatgatcttggtcttggcgtgaacttccacatgaacgtgactccgtgcctacctgctaataagagcgggagtgtggattgtgcacataggtggggacggggtgagaacttggggtgtggcgtgtccctgtgggtggacacattgtgaacagtaagtatcatgaatgtgtgacagcatgtggggcacgtgggtgagcgtgtatgcatgtacacaggctgtctgctcaggtcctgggggagggactcagaatccgcctcacacccatggagagttctcgcaatgggtatggcaaacttcctgaccaacaggcttctggacttctgactcagcaccagtcctgctccttctgtctcaatgactgtcccctgtccctggagatgtaaaagttccaggctctcctaccacacctaggctggacttactgattccaaggtgaaaataagccatcacgtattgaccatctgtcagcaagtatctaccctgcaaaatacttttcacacactctctcacttatcctcaccatgcctagagatgggactttgtctccatgtgacttatgaagacactgaggaccagcaaggcgagacaactgtttgaggccacacagcaacagaaccagacctcgatcaaacccaaagcccgtgctctgtccgtgtgctgcctccgagaagccatggccaagaaaggtctttgcaccagagctcaccaatgtctcggagaggtcctcccttcctgccagccattgatgatcctggaggatgaacgggtcgtctaaaacagatgacgctggtgcgggccccagggagttccaccaagagccttaggatttatcatgtgggagggtagttagttcccaaacgcaggtgagtataaaatccaatttcttaaattgcatccagggccaaggggtgcaagctgctctgtcagttatgacttcctcgggtacctgagactgtagctcctcatttcctaaatcctcctgcttgttgtctgagcttttagccctctgatttacttattagatttctactgtgccttttctctgcagagtgctcagtgtccccaggaaccactctctaatttaacgaataacttctctcatgagcaaatggggtccgggttcatgcaagaagccagtggaagaggagaactggggagacagagagtgagaaaaggggcagaaaaaacagggcagggtacaaaggaggcaaatgcaccacctgtggccctagagtggggagcattgaggttggatggcatttgtatctagagttgcacctggatctggacaatgcttccaggttaccactgctggtaagcaatgtgcccaaccaccctctctgctctcatgaccccctgcctctctccacctctgcgtgatgtttttctgttcgcctgtctgtctccttgaattgtgaggtccttaaaagagggagccaagtcattttttttttttgaggcagagtcttgctctgtcacccaggctggagtgcagtggcacaatcttggctcactggaagctccacctcctggattcacgccattctcctgcctcagcctcccgagtagctgggactataggcgcccgccaccatgccaagctaattttttgtatttttagtagagacggggtttcaccgtgttagccaggatggtctcgatctcctgacctcgtgatccacccacctctgcctcccaaagtgctgggattacaggcgtgagccaccacacctggcccccagtcatcttttaacacctggcacttgtcactgtgtctggtccacagtaggaatttaacacatacttgctggagaggccagttacggggcacagctgaaagcataaagatgcactgtataacatttcagcccccagaggacccacagttggggagacaaaggatagccaaagacaccatggctgggctggccagggaggtcttcgtggaggaggctggactatactgggccacctagaatgctggggactggtgaaccggacagcaggaggacattctaggaggaggaatggcttgagccaagggttcaggttgcgatgggcaagggggtccctgagtggaaggcaggacctgtgcagggaagtctagaaaggtcagtggaggcataccgtggagggctttgagcacagagggtggagcctggaatttcttctcctgtgatggagcctctagttcgccctggcccagccccatgtgctgtctggcacatttgtgcactgccctcctgcaggagggggcctggcacagtttctgtgcaccctggacaagcagggccacgtgtgggccaggactgctctgccctgtcttctcctctgattcaggaaggaagaacttgccctggactctgtctgtctaaaataacctcccctccccatccccacatggccctacctgttcccggaatttcctgttttttttttttttttcttccttgactttacagtctccgggttgcacttgaatctcaatggcatcatcccctttcagtctttgcatgtgcttcataaagaaatgactcttttgtgcagatccactgcctatggtgaagtaggtgctcatgtaaatgccaggtcctagctctggaaagggttagacagcccttctcaaaccatgcctgcaatgccagtttaaagaacatggaggcaggacagcagccatgggaatgaagggtggcagataaaatcagtgccccagaagctctggggcctcctctcattgattaaattttcaaatataattttgctatagttagtggggggtttagagctggtcacattatattgaatttttttttgagacagagtctcactctgttgcccaggctggagtgcagtggtgcaatctcagctcactgcaacctctacctcctgggttcaagtgattttcccacctcagcctcctgagtagctggggttacaggcacccgccatcatgcctggctaatttttgtatttttgtagagacagggtttcaccttgttgaccaggctggtcataaactcctgacctcaggtgatctgccctcctcagcctcccaaagtgctgggattataggcgtgagacaccgcgcctggcctatattcaattttaaaactttcatttatttttaaaattgaaactaaaagttgtagatctatttatggtatacaagacattttgataaaagcatacattgtggaatgaatacatcaatgaattaacatatccattacctcacatatgtatcattttttttttgtgcatggtgagaacatttaaaacctattctctgagcaatttccaattataggatacactgttattaactgtaatcaccatgtcctgtaatagacaggagtctcctcttgaaccagggttatgtctcagaaccagagtaggaggagaagcacctcacacacgagaggctctgctgtcctgacgtggcacggaagggaatggaagggacaaggggaaggtgctggaaaggggccagctatgaactgagcacaggtaacagaccacacctgacctcctggatccctagttacacaagggcatgtattcattgttccattccacagatgggaaaacagagactcctggggcttaagcagcctgcccagggtcacacggctatgtgacagaagggctggaacctagatcctcccaccccaaagccaggctcctccctgtgatctggccctggttttgcctgtgtgattcctctggccttactgggtgatactgagccaatcgtggagcctctctgggcttttgtcttctcatctctcaagcgaggggcatactctcaactgagcattctttgcatggcctgtcctctcagtcaggccagaccaggaccagctcctgccattgtgcattgcaaggatgcactgcttgctagtgggcctgagattcaccagtggcaacacagaggtgccttcaccagccttgctaagctctggtttgtgtttctgcctctggtgtttggtatcagaacgcattcccctgatgctgccggaagcaataatccagacacggttcgggggtttagtggaaatcctctgctatagcggaagaaaatgaaacccagtgaagcaaggatttcggcagatgcaaaaatctgcccatttacctccccagtctgaattccacggcagggacagctgagaagcaggcggatggatgaccttagctgcaggtcaggtggggaaggggtgagaactgagttcagaagactggggcttctgcaggtctaaagccccatgaggatgggaggggaaggtcaccgagtatttgcaaacatgttgtaagatcaggattgaccttaattgagtgctgactgttaaaggccagtgcttcgtgcagcaacatattttccttttaagcccttgcaacactgacgtattgaagaagtactaaagaagtattatccttaattatctgatgcactgaagaagtattatccttaattatctgaggtactgaagaagtattatccttaatattggtatgagggcttagatagcctaagtgacttgcccaaagctacacagtcagtaaatggcagagcacagcagaaatgctcactgctaacagatggacactgctatctgttcttgatactcagaccctcccatctctcccatccacaccagttacccaccatcatggaaacatgtggttccggatgtggacagctggctccccgggccccatacctcctgtgtgctcctggagccttctccatctgacacaccatgtcagatgtggtcctggaccttcctgctatcctcagctcactgtggactgtttctgagccaagggtattgtgtggttaccagggaaaatatgcccccgctctaggcctgccagcagctctagggcaataagccatctttctaaaatgagatttcctatttcagggactctgaaatctccagttctgccaaacagcaggtcttctcctcagcttaagatagctgggatcatggctgaggttgagctggtcacagaccatcccccactgaaccaatgataacaccctgccaagggcctcagcacgagcaccaggagcttctctgttcacatatttacatatcaagatagaaaatgaatatacgaaggagtctagcatgaggaggacgggatgcgctgtggagttagacacacttaggttcaaatcccagcgttgtcacttattaattgtgggaccccgggcaagacatttaactcctctgtgagcctgcttccttctttgtaaaatgcaaagaatgatcccatctacctcgaggagctgctatggggataaaggagagcaagccctcagtacggtgcctggcacgcagcgaggactccctaaatggaggctcctgctgtcacgaccctcgcccggggaaatgcctgtcttctccatttagaaagtgacagctgacggcaggcccgaggcagccaggtagggaggctgcctgtgtgcaacccgctgtggaggctgctggtggctgcaggctttcagaaggcattacaggccattgttttaatcaatactatattatttcctccgcggcaactatccccatgtttattatgtgtaaatagggtttttcaatgatgtgaatgtgttagcttaacgtagctgacattcagcgtgcacaatctggtggctgcccctcaggacttccaggaaaatgagatgatgtatccgtcacaaagccatcctcgtgagtaaaatttgagcagtggcagcagccagggcacccgatgaattctgcaggcgtgggctgcgtgcttgagaaggaaaacagacatcaacatagcctgggagcacagtctgcaggcagtgtggacagttggtgccccggaattagggcgttggcgttcccatctctttgctgccatatctagatcctatacagcttattccaacacctctccattgcctggcgagcgcctgtggatgcactcttctgcctactcctggaacttgtcaaggtttgccctctctgactgtagctcctcactctcctggactctaggatgggcccctttcttccccatacaaagcccccagtagtctgaaaactcatttttgtctatgctcctcagttcagcccaggcatgtgggtatgaccgagcctggctgcaaaggcaggcagaggggagcaaaggtggtctttctcaatgtcccatgtgggcttaactttcctcctcctgtaccagggcactcagagtaacaccaccaatgacactaccagcttctctctggtgtctaactggactgaaggtgaagcaggtggggtgtcgtttagatctggggcagagcttccccactgtgacacccttgaagttgcaggccagatgccactaccacacatgggtcactgtcaacaggccacaaccccaatgatgggcacttaactcaataataccagatatcagacaactgtggcttcatctgtagagctctctggagtgcatcataaaggaagtaacctttttcttttttctttgcttttctttttttttttattttgagacagagtctcactctgtcgcccaggctggagtgcagtggcgcaatctcggctcactgcaagctccgcctcccgggtttacgccattctcctgcctcagcctccggagcagctgggactaacaggcgcccgccaccacgcccggctaattttttgtatttttagtagggacggggtttcatcttgttagccaggatggtctcgatctcctgacctcgcgatccgtcagccttggccttccaaagtgctgggattacaggcgtgagccaccgcgcccggcctctttttttttttttttttttttttttttgagatagagtctctgttagccaggctggggtgcaatggtgcaatggcgagatctcggctcactgcaacctctgcctccctgattcaagtgattcttttgccacagcctccccagtagctgggattactggcactcaccaccacgcccggctacattttgtattttcagtagagatgggttttcaacctgcgggccaggctgctctcgaattcctgacctcgtgtgatccgcccgcctcagcctcccaaagtgttggaatcacaggcatgagccaccgcgcccggccaggaattaaccttcaccaggatagtttgtggaattttatcaagaggcttcgctcccatctcctgctttcttaacagagtttggaagcagcggaccggataggaaaactgcttagggttccaccctcatgccaagtggcagaggccccgggggaagcctcctgcggaacgtgggaacaaagggatgcggggcctagcactctacgccggtgtctgttcgtctgtccagaaggcttgtcacactctgggggggcatctagctaaaaggtactccatcaatgtaaacgaccgtcgctctcgttaagttccatctgtgtgtcttaaagctcccgcacggaacgtgattggagttgggcttcagcttccctgtgctgcctgagacagaggagggagatgtttttcttggcaaataaatatgatatcataagccctggcaggattccagcctgagtaatggccgtctgccttcctaattccctcagcagcttggaacaggaacattactctttacttcctctctttaaaaacaaactctctattggagcgcattactcagccacaggatccctccccggacgtggcggcattcagatgatgggaggtgaggaatgagctcagattacagcgcacattagggaaaacacagcaaggcatttggcccagaaaaggcacctgaggaccttgaattagagcggccactcctcatgtgtccttgttcatgaggaacatagagctaaaatcaataaaaatcacattgtttagcgctgccgtttccctggtttaaatcatgaaggagtaagtaggtaattaggtaatccagctcggactggatagttaccttcaagtacgaagcggtcttgctgagaccctctcactgaacgcgagctgggggaagggtctcgtggcctctctactcacaggagcactgctgcctctaagcacataccccgccctctttctgcttgtcattagttcttcctaacaacagttagaggcatcggtgttgttactttccattttataaacccgaggctcagtgagactaattaggtaactcgttcagggccataaattatacatagcagaagtcagagttgaactcgggtcttttggcttcagattcaatgtttacaacgccacatcaagcctcatcactttctctggcctgtgaggacttgggtgctgccacttgtcccttttgaagtagcggatacaaggtggcaccgtgaaggcactgggtcaggagctgggacacagctttgcatcacttgggcactgttctgctggggcctccttggtaaccaaccatccaggtgaggataaaaactgacccagcttgtagagagatcttgaggcaggcatgcagcaagggccctaaaattactgggagaagggcaagtcactgttcgaaggcttgggatggtgaattcagccaataaacgtcctttgaacacttactatggctaagcatgggggcacaactgtaaaccagagagagtccctgcctcagggagctgggagtcagtgggagagatgaataaacaggcaacgacgatgcagtgtgatggatgctccagtggaagagtccagagcaccgggatgatgtgtagggagagccactcaccagacatggcagttcttggaaaatgtccactggggacatgacatccaagctgaaacccgaaggacaaataggggacagggagatgaagacgggggctgcagagcgttccaggctgtggaggcagcgtgtgcaaaggctgggaggtcagaaagaacacactctgctccggtgatggcatgtttggtctggcctggagcagagctgcaggggaagctgtgaggcatgaggcagagaggtaagccaggagtagtttgcagacccctggctgggcagctttccaatctggaacagtgggtcatggagccatcacattcccaaacccacagcgcttccctctcaccaaccctgtagcctgcagtcttcactgtgctctcgactcccccagcctttcattgtatgtggaagaggagccagaaatgcacccaaactgaaagaggagcacgcagcaccaatccctgaatcaaaataaaaatccggctgcactttatctcgctgaaggactgtaatctgggagatattcatttaacatatttctgtctctgaatggcttttacttttcactaaattgaaaccgcagtacaatatatgtgaatgattaggttgtgtaatacattccagcaaatttagattaggaatgattatgacttaagtaaaatagttgaacacaattcttattgccatctatcttttcacttctttttagttttcatgagagtgagtgaatgcaaggaatgaatgactctaaggagagctgggccctggtacagggaggggcagaggtctgtctttggaaggctttaggaagaagggagaggtggactggaagactcagatctagggctcgggggaaagcattgggccatgaggtagattggggacaagtcctatatctgccgtttgctagctgtgtgacctcaggcaagttacttaaactctctagtcttagtttcccatcagcaaaatgggctttattgttccccggctcatggaatcattgtgggacacaatgagatcagggacatgagagtaacactggccaagagctcagatggggagtcaaagtcctgatcaaagtctggctctatcacttattagagctgtgtggccttgccctttgatactcagcttctctgagccccagtttcctaatccacaaaatgggaataagtgtactcagccacaggtatccttgaagagaggcttaaataggatttttttgcatgttaatagtgctttgcaaaatgcaagttacctgggagggctatgctggctgataggggtgggaataggaattggggactcccctttcctgggatagcgacctggaggggtttgggtggagccttgctgcgggccctgaggcagggaggggaaggagaggaggagtccttgccaaaatttccctttggagtcctaagccttgcacgcgccctgggcactccaatcctcctcactccactgctctattttccccatagcattgaacatgctgtaacattctatataatttaccaatttattatgcttttgtttagaatctgtttccctggttcaaaggtaaggcctacaagggcagggagctgtttaatcccctgataaatcccaagcacctagagcacagcttggcagttaggaggcatgctcaggaaatatacgtcaaatgaatggatttatgagtagggctggaattctgtctcctgagaacaagtgagctgaggtgggaagaaggtggcggtggtggggggaccaggggagacgagggcatcagtcactccagcagggagcttgctgcagggagaaagagagaacagcaatttgggccgtgaagcctggcactcattcttcaagggggctgcaagcccccaggattttcctggaacccagggcacccgcacactagctgcctctcccggtcccttccagcaacctgaggaaatgccttccaatcagagcaattactgctgccctggagccgctgcctctccaggtgtctgcctcctgcggctctggctggagacaatatttctcctctgttcatcacgagaacagggacaacaaataacacaatggcagatgaagggccctccaagccctccagagctgaaagagtctgggctgttggcagcgtctgcgtgcaggggaacagaagctacaacctgcgtggggtgtggggatgactgactcttcctggatgggggcactgtggccagctttgtccgggaactgtgctgctcctggtccaggcaggcagggctgtggcagccgccctccgcccgcccaccagcaggcagggactcagggcaccatgggcttgggaaactgagagagagctatgtgtgtcagttgtcttgttaagttttttccccttggtcttaaccatgtaggtactcttgtgttcaaaggaggaaatggaatctcagagaggctgagtcactggtgcatagtaacacagctcatcacacagcagtgctgggataagtgctcccatgtttctgaacccaaagcacatctcgtcgctctggcactgagtgatccgtgacacagatgtacctatagggcgtgagtgcagccccttacctctcagcctcagtttccctactagtgcaccagtcactgaagcttgggaggtgtgtcagtgactcaacccactttatcctgccacctcacctgaccttgctggcatttcatccctgcctcctggggctggggctggatcttgcctagtgccccagctgctggctgaggctctactcagttactcctgaacgctcctctttctactgtgccccatccttaggagcaggggctccctctgaataccagccagggccactgcagcagaacatgccacagtcctttgaaagctgatctcaacaccagtatggatactaactctggctttcattgttgagcatttgttgagctcaaatgtaaacccaggaaccagattctgagggctgcatacctaaccattatacaggcctgcctcttcctcatttgacatggtcttttgaccttaactaccttggttattcgttttgttaataccccctttcaaattgatttctagaactgaacccaaaattccagatgtagcctgatcaagcaaagcctagaagaagaacatcacctccctctgttttaaaaattgctttgcaattaatgcagtctaagattacacccactttcctgggcccccagctcccagagtcgactcctatggggctcttcagccagccctgtctacagggctctgccttaaatccctaagtcttctagaaactagctgctgtggcagaccttttgtgtggctgagatctgcaacaccccagcggtccccacctcaagggctgtgtctgccgtggctgcatgcggccctgctgtggctcactgtggacacagcagacgaaagagaacatggtctcagctaagtggggggctggaaggaggagaaatggtctgtgaaggtcactgccactgtacggtgagtgatctgtccccatttcagcctcagtgggagagtgatggagggtgtaattagggcttgagctgtgcctgtgggggctgctgcaccaggctcaaggaggctggggacacagctggtagtctctgccctcctagataccttggtagcgggagccgcccttcttgggaccactccctcgctggccatcccagccaggtcttccatccctgttctccccaccccttctctcctcaaaatttgtcctgtatgtctcatttcacccattctcttgaggatttgccttattagaaagtgatctggctgggtgcggtggctcacacctataatcccagcactttgggaggccgctgaggcgggcagatcacttgagcccaggagtttgagaccagcctgggttacacggtaaaattacgtctctactaaaaatacaaaaattagctgggcacggtggtgtgtgcctgtagtcccagctccttgggagtctgaggcaggaggatcgcttgagcccgggtggaggaggttgcagtgagccgttattggaccactgtactccagcctgggtgacagagggagatcctgtctctcccacacctgcaccccaaaagtgatctgattcaaatgctgtattaagatgttaacatctaacgactggctggacgcttgtaaccaggtgtattccacaggtaacaatccttcaccaagagaatcccttaacctaaaggcatacatcccttagggtgaaatcctgtgtgttctggtgggaggtttgtgcaaggttggccccggctggttataacagccagggcattactgcacatgtaacctgcacttcccagtgatgaggaaatggcagctcagagggcttctacatcttgcccaagatctcagacatgctcttcctgtccagccttgtgtataccagccatgctctgccttgcacctggacctgaggtcagctctgggggccccatcagggtggtagtgcttctagaaggatctggctgttcagagaaagctctctgtcctgaaggcctgaactgggtgaggaacaggagcactataaatattgctacaatttcttcatcacctgccatgtcctagatactaagttaggctctttacagctcataccgtgttgtcatacgtatgaccatgctctgttttaccagtaaggaaactgaagttcagaaagtttaagtaacttacacttggccactaagcaggaagtcctggcagggggaaaggcaggcctgagtcagcctgcctttgggccctctcaccacccctggagcccaagcaacataggcctctcatagggccaacagctcccacccctatcacatccttcagggtgcagtgccacggctgggggtcgcttgcctttggactctccagagaggagtccctgggacagctgaggccttgctcacagccctaggtgggccaggaaataacattccagggccttttgtcgagcccctgggatggggacttgcatgtgctgggtgcctatgatgcctcaggccttgttctaggtactttccgaacagttattgtcgtaatccttataacaacaccataacttaatccttataacaacacaatactataaaggtatcattgttccctttatatggatgagaaatactatgtcttaatccctataatactatgtcttattatacaatgctaggtctgaatccttataacaacacagtactataaaggtaccattgttccctttatatggaggagaaaagcaaggccaagggaagtctaaagttacatagctaagaaagtggaaggagctgagatctgacagtttccagcgattccaaactcaggctctttctcctacaccctgtagcttctccaagaagattggggtctaaaggggcagagctttctccaggagcttctggtccattgagggagatggaatacatcaggatggaaaggaccatggcaaaaaacccacacagtacactctgcatgcctgctgtgcgggaaacagcgcgcctggggccagagggaagggaggagggagccagggtggggagcccaggaggcacatcaggggaggccttggggaagatgtgagtttggcaccagtcgcaggtaaggcctttttctgtgtgctctgggaagagaaagctattgagctgggtgtggtcacagcagggaagggctgggagcaagacactctcagctcaggcagaaaaggcctgttgttgagagaaccgatgcaggctgccgctgggagcagagggctgggcgtggcgtacctttctttcctgtgagggggctaggagctggctggggtgggagggctgaggggagcaggcacatggtccagccacgttaggaggcttgcacaaagggcttctaggcctgaagcctccagctcccaccccgtcagccgacttgcagattgtctgaatgggtctccaataggaaaaaagccagggctttggagaaacagatgcttaccacggaaccaggatgctgtcgtctgcaggtcacccctgtgtggatacagaccgtgggccaggaggctcttcagagcagttctcccacagctcatcctgtaattgactgactcatcggtcactgcttgcgcgctcagccattgttaactggtgacttgaaaattacctttatttagcaccgttatcgggaggcttcaggggcgccagcatttccacgccaccagctctctctggctgatggcagcaagcagcctcatcacactgtccccagctctaagccacagccactccctacccactgtggggaccagggaggggccctcgtgctaagtggatgcagtaggcaggccagtacctcccaacctgctgtgaccccctctgggtacaggtgggcaatgaacacccggctggacctgtggcctgctgtctgttctcctctgacttgcttgtctgctgatcatttctccatagccacgttgccctgtatgcatgagacaatctggaatgggggtcatccatggggtctgggcctgcacggagtggagttaattgcagaacttgtgcaattccttaattctgagtgaacgtgcatataagccttagggagagagaacattcatagcttttagtagattctcaagaggatttgtgagccctaggaagctgggaagccaggttctgagtcatggttctcagatcacccctccaggaagctgctcaggttagcccattgcaccgttgccatcactgcgagactcagggggtccagtggtgcaatacaactgtccccctccacccagagggcaaggccaggtctgtactctgctcagtggtggatgcagatgacaaatcacaaagagagaacaaagagatgacatttgcagaaactcctgcctttcactttctgctttattggggaaaagaaatcacatccccaggctcccttccctctgtccattggcacagtgtatcctcctcccatcctccacccctccctcctggtcacaggttctgccctgagatctgaagtaagctgtgggactcatctacctggagaagaaggcaggcagaagaggaagggagggaaggatggaggagctggtgaaaactaacagtaaggtgaagggtagggctgggggctgggtcggagccacaggattcatggcgtactgtgatttttttgttgttgctatggtcctttctacctggatgaattccatctccctcactggaccagaagctcctcgaggaaactctgcgccctttagactccaatcttcttggagaagctacagggtgtaggagaaagaacatgagtttggaatcgctggaaactgtcaaatctcagctccttccacttttttcgctgtgtaactttagaattcctttagcctcgtttttccttctttctttccacatagcatggggccttcaactgctggagggtctgggcggtcatttatccttgctgggcctcagaggcctcatgagtggtgcctttaagagtgcaatgaggccgcagcagaaactatctctaaggccagctcttaaattctctaacccatgctcctggccaactctcctctgtccagccgcaggtcctcatagaaaggcagagacactgaatagaacatagaaggggttgttttcctaaagctcatataaaattctgaagcctcagcgatggaacctgcatttgggagctgctcgatcttttctgttagcatttccgccacgtgcttctcagcgttttgccccagttggccttccgcccctgggagggggaacaatgtctcctggtgaaagtcactttgcagctgccctgggccctcggaccctcaggggccttctgggttgtgaggcgtggggcaccccgtcctgagcgtgccctgaagatgggcacagagctcccccagctgccgtggcactgtttccatgcagctgtggggatggtgacaaggcctgagggctgtcagcccggctgagagcactcaagagccacttcaccggccttcttttctctttccaaggctcttaacccacttgtggagggggtggcgggtgaggggctgaagagggtggatgtccactttgggcagacaaaggagctgcagtcagcctcctctccagcctggctctggagaaatgcagtcagcctcccctccagcctggctccagagatccggagctgagggcagtgtaggagctggcagggcccttggcaaagtggagcccagcaggctagttgtcccaggtttatcgcccaggattggggggctctgtgtggctcctgtcttagctgatgactcagatcttggactatttctcccttatcaaggtcttcctcatcctaaacttggccttgatttgagcctctttagtttaccaagtgtttacctgaattatctcatttaatttcacagcaaccggtaagggatgcattgtgagcatcatcttactgaggactcagtggctatgactcaggactgtgtcctttgcctaaggaaggccacacagctagtcagtggcagagataggactagaatgagttctttttctcccagggagacccagtggccagaaggcacctgcagccaggccacaccgcccccttaggagcgatgggggacagcaagaactgacaagccctgatggcatacaaagcctccaggtgaccagcagtgacagacgccagccaggacatcctttccagaaccttctctagctctgctggcataagcagcacctggttttcaaaggctttctttggtgtgtgtctatggtcataaagaattgtaataaacaatgattaagggtcacaatataggctggtgctgtgtttcctcccttaggagcagaggaaagtggttgaggtctccaagcaggtggggagcccttggcccctaggaaggcaggaaagtctcccaggataaatctgtctgttctaggctctggtgaacccaacggaaagccctacgagcctggctggtggctgagctgccttctccataggctgttcaccaatctcgagagtcacctgccatgaagtcccaggagttctgacatccagtgttcatgcccatggagcaaccaacaagaatgttctgttcactgccgcatccttagatctaacacagcacctggcatatggtagatgttgagtacattgtcaaacaaacgtaagtgaaaggaaacctacaagatcatcatctgcagataagtcacaaattattagccctatttttagaggtggtagtgaggcccagagaggtaaagtaacatgcccaatgtcacacagccagttagtgagggaagtgccagactctaggtctcctttcactatactctgtcccttctgaaggggggaaggtaggaatgtgatgacctcggccccagggccaagatatgttcttgccatgtttcttagctgcattgagttgacagtgatctgatgtggctaggtaatgaagagatggtttttctctgggaagtgactctgctccctgacttctggcaggcatgcgggagtggggaggaggtatctctgtgtggagctctacattctgtcttaggagcacaaagctcttcacagctcacctacgcatcttgagcccagctttcttcttccaggaagggggaatgaaagcaactattaataaggtaataagaactgaatcaaccatccagcctggtcttccagaagagtttgatggcctctagccttgggcaagagagacagagcccgggctgcagtttcctggcctaaaggatgagtgtctgcagatccatctaccagtttctagaatctttaaagcagcaggaggaagcaggatggggcattatatgggctctagtctctttacaaagtcattcagaggaaaacagggacctaggagaattttggagtgtggtagccagacagacctctcagaaattcccttgatttacactagccatcaccaaaatccctgtgtctccattctctccctttggagggccgttcccagcacgagttacccagaactacccacccaatcagagcccttggctctctgtggcagggggccctctctggtcaagagcagcctcgctggtcctggagcctgggccagagcccgcctgtcactctgcagctccgcaatgtcgggacaccaaagggcagtgccagtagcccgctgcaagctgacaaggctgagttcacatcagtgctgaggagtcgacaggaccatctgaattaagtggccaagtttagtttttaattaagtccccgtggtcttttaaaaaggtcactgacgacaccatcttctttaaggccaatatgaaaagacattcaaagtcaaagttctgagatgggagccttgtaacttgaaatgtcacaggaagaaatttggaaacagggaaagaggaagctggtgggaaggacaaccctgtcacattcttttgccgtcagcttcacagttcccacttggagctccaaactatttcggtctcaaagggcaagtggtcccaaggttctctcgagtgccttccccgacagaggattgtggagcctcttgtttgctgtgccagtgaaaaacagagcccttgtggtccctgacacggaataaaagttgatagcaatggggcagaatgtggcaacttacccctgatggctgaggaattaacaaaaatgtatgcaattggtcaccatcctctgcacccattcctgtcttcacttttctacctaccttgatcagtactgtatcatttggaagtacagttctgtctaaaacagagcacagcagccacttaagtcacccatagcatcctatgaggattgtacagtgagagcaaagacctgtgcctggcttagacccctaagagaagtagagacttgaggtaatttgagcagagtggaccacacctcctagagaagagatttggaccagccaatagctaatgagcaggcgcaagaatattttcctggagttcttggctcacgccaatgtctgaagagcgggactttctgagtggtgaagcgttcagtgactttgctagggtcagaggggttggaagtgctcagtagtgtgtgtcacattttgttcatgtttgcaataggccatgtaggaagtggaaagaattttggatttagattcaggaaatttgggtcttggggcaaagagtgctatttgcctacctaatatacattctcccatttatttaccattacagtactttcattgttggtgtggcaggttacccaagttaaccaaatatggatttcctagccttccttaagaagctagaggtgattgatgcgaatattcagagatcactggtaggcttctttaaagatggctgattcacctgggaggtgcacctcttttgtcctttcctcttgtttcttcttcctgcctgaaatgtggggctgatgactggagcttcagcagccattttatgaccatgaggtatgacccaagaatggaagccagtgctaaggatgggctgcccatctactcctggtcttcattttatgtgagagaaaagcaaacccctaatttgcttatgccacttactttggatctctgctacacccagttgaatgccaaactgatacacattgattgcccactctgtcattcactcctgagggactttgggcaagtcacttaatttttctgggcttcggtttccttacctctgcagtgggaataataattctggctttgtcttgcaagcgttacttctgacctgtagggctcactcttaggcttcctagaatgttctcaaccccagtctgaagatcacgtggtttttgtgcctgagcagtggctgcctccctcccattgtttggccagataattgttcccaaactaagaaatgtgcctgccttccgacttcaatggctgttataaagtccccttgtgggctcccattttctagagacacaatagcttttcctggcttgcccaggcctcacccctccttgctgggtgcagagacatctgctgtttcaagctgctaaaagagaagcttcaaagaaccccacattggcccctcttagggctctgactcatataaatgtttctagaaatcctcaaaagccttattaatctgttaagacatcccagaagcaggagtctgcacacccaatttccacggcttttcagctgcttccattgtctcagccgcattgtccctgctcggtgtcttggcccctaatggactctctctgaggcaggcacgctttcggctgcacctgctattccattgcctgactcttttcttcttcttctctgttctctttaactcttaaaatgaaaaggtgaccagctcttcctgggctgtttactcctctagctcccctgtgcgggtctctgcttcaccccctttctcttctggcatgtggctggatctgagtcagagacatagaggcccacatagaaagtaggggcccatttgtcttttccatcaaatggaagcctctaggggtctgtcattcctcatgcctagccaagataccgggtatccccacaagcctctgaaggggacttgcttacagctcttgcatatagaagctctaatcaggcttctccagaaactccctcatctctggtccatacagtaatgaccctctgatgtgtaaccttcactgtggttgaagggccctggagaaagagccagaagaccagggctctgttcctgacttgaccccagctggtttccattttcttagactagcatcaggggacttaacttgacagccaaggtcccatggtgggcagcttgccaattactcctgcctcctggttttcagacccctgtgtgctcccttcccttgagtatgggctagacctggtgacttgcttctaaccaatagaacacagcgagagtgatgggctatcacctctctagttaagttataaaagactagtttgcgtgttctgtcctgttggctctctctttttctctctgtctctccttctcagatgcttgctttgatgaagaaagctgctatattggagaggcccatgtggcaagaacttgagtgtagcctgtagccagtatccagtgggcaaatgaggctctcaatccaacagcctacaaggaattgaatccaactgacaagcatgtgagtgagcttggaagccaaccctgccccaggtaagccttgagatggtaaagccctgacttacatcttgattgcagccttgggagagaccttgaagcagagggcccatctaagctgtgcccagattcttgacccacatatatttagaggtaataaatgtctgttgtcttaaactgctaattttaatacagcaagaaataactaatctaggtccttattagctaagaagaaatgtgtttcttgccttgttcctctgtatttaaactctaggtccttaaacctttcatacccacgagctagccacttgggttgtgcatgtgcaccacccaactccaccaaccaccccactccaacactcaaatctatgggtggtgcaaatccctttactcttactccaaacatacatgatcagaaaaaatggaagaaagacatagctgaaatagagctccaatgagatgattcctggtttctactaggaatataagtaaaatttgaatttttgccagaatccaaagtattcaaggaagggctccttatacacctttgatcattcacttccatgtctcatctttcaaagcttggcttaaactttcctcctctgggaaaaaagaccctgacttcttcagttagggttactgttccctctcccagtcacccatcagttttgtccatatcagagcattctattttagttatttgcatattcccttctctctctcacccctccacggatctcctaccccaggaaggtcagcatccagtgaccttttcaggaaattacccaggatttcacaatcttagtcagaagcgaaatttaaaaccctttgtcccccgtcctcccagccccccgatgttccaggaagccaaagcacagagcaatctttccaatctaggaagcaataaagaaatgtatttatgaaccagcctctatctaagggagagaatttatgtctcttcatgctcttgttgacaataataactgattgctgcatcaatgtgatgcaatataattttaaaaccctccagaacaaggatcagaaaacaactggcagagagactgagcggcagccgtgggcatcttgggttttgcagctcagccctgggcctgctaatgccctgaggcgatgggaacacagctctgggagcacctgcaatctcatcttgtttctttccaagcaccagggaagaaaagcaatttgtttgctctcatactctaaagatgaacttcccgtgctcaatcaaacgttattatcccaatgtaagtcaatttacctttgaatttgaaggctattttcttcctaaatggctaattatgggagatagatggctgtaaacagaagtcttctacctcaacactccgccaggttttctccttatggcacctgagagaaccagagaaaggaggcctcacagtgtcctggccccctctgcccacttgccgcccctcctccattcttctcatgcatcctgcggtgccattcgcccaccccgcctacattcctggacgcctatttggagtttcatccccctgaattccatcccctgccgcgtccatttctaggagctccattccctcgtgccatctcccgtttttaaggactggactaaaggtggaggtcttggcctgagaaccgtgcatacgggacagcatgagttttaggagacaaggggtcctgtgtgtgtttgagatgaaacaaggtcacctgaggccgcctctttgatttgcctgacagagtcacagaagctgaccgctgcgaggcaggggctgcggccttttcccgtggcatgatcaacacctcgcaggaactaattgaatggccgagtttgtttactgagaggaggagtagccccctcctttctcgcaaaacaaagtctttccccaggagcggtggcaaagaggtcagccctggcagcgtttctgttttgccttttgatgaaagcctactctggctgctctgaagaagggagctcattgtgtgctcactgtcagaggtggctccagcagggaggccacagccctgggggctttttgggtcttggggttatggagcctgtggtgtgtggggttatctacagggactgagctttctagctcttctcccagaagtctggcctctggtcctctgccctttccacctgggccccagaagccatagtaatagcaacctgcctttgtccggtgcctcgtcgtcgtttatgcaagtctatatactttatctcacttgatcctcacaaccatcctgtgctgtcatcctcccctgacagatgagggagaggcccagagaggtcaagtgctctgcctgaggtcacacagctaggaagtgacataactgggacctgcctccctttggcttgaacgcctctgatctctcccgtctgtcacagtcccatcacagaaaggcaggcatgtggccccgtggttgaagccctgccccagctgtggatccgcatcacctgggccaggcttccaatttatgatacttactgagaccttggcaccacggccttgataaacccctctgccctgggcttgagcttgctgttctgtcgggggcagttcgcggggctgggaggacaggtaagaagggaggagcttttcatgagctgctctggaaaagtttaaggccatggtagggtcagctcaggaaagcacagcagggcaaggggcaggtaggcctgtccaactcagctaatagctacagaggtctcaagaagtaatgattggaggcctgactgaggcatagagaccaataggagacgctctctctcctagctcagaccaaggaaccctagaacatgctcctccaagttcacccaccgtcaccctgcaggggaggggtctgccacactccaaaaaagaatcaatccactgtgtgttctgtggactgttatttagagatgcccctacagattcctggagctgctgggccccatgccagggcaaggatcccaggactccctgtttagcatagtactttgattaaaacaataaattcccattgaataccgatgggcaggcaagtgggggctcatgccagcctcggtgccctcctggcatcatctcacagcaactcgtttggggagaaatacctccctccgctgtgatgagaaccctcattcccaatgaatgagggggcagaagctgcctgggagcctcaggaatgagggcatcatgggcaggacagggtaggactggggcagctgcagatggcaccaaggatatgggggccttgactaagcagggagggccacagaaggggagagggggcacacagaaacctcaatggctggcccctgtctggtcctcacctcctgaccctgtctctgcagacatgctgaactgggaggaacatgcttgggtcttggccccctgagcagctgtgctggagccacgcctcagtgcccagcgctgctgcatctgctctctggcagcacatggctgcatgtttctctgggccctgcctggtgcgcagcagccatatcctgggcaggtgtgctggggctgttgcctcacctggccctgggatgctggtagctccggattgaccagggtttctgatgggaagggatgtatgggagaagccagggagtggagagagaactcgtgttccccgatacaaggctttttacccatgtctccccaaatagccccccctcctcccactagccccgaggctggagatcaacatcatggtcccatctttaagaggaaccaggatctgttttgagatggccaatcagccaaagaatgccataattcacgttatccattcacttttcagttgacttccttccttccttcctgctttcctttcttccttttatccttcctccctcccttctatccattcagtaatatttactgataatccttcacatgaggcccgatgctaggctgtggaaatcaaagatgaataagcaatagcttctgtccttgtgctatctcctccgggtgtccagtattatgaccactgtatttctgaaccgaaaacgaggacgcagagctgacaggggtgagtgtacacgtgggaatgggcaggaagaccaccctgaaggtctgaggcattctgttcctaagctaggatgaaactgagtattccatacatactggctgcattgcatttttgtctagcattctttaataagaacagtaagagctgccatttgttgaacatgtaccatgtgccaggcttgtacaagataatgtgtataccatatctcatttagtcttcaccacagccctacagagaaattcactgtccagacagggaaactgaggaccaggccgttcgcagttagtgttagtacagtccttcttggccactctaaatcctctgctgcctctacagctggagggttctgatccgttggcttacaggtgtgtcctgtgggccacatgggggtgggtgggtgttcacagcacactgcctggagccatggtgcacacagcagggggtctgaggctgcgcagaatggcccacttctaaacaagcgtgtctgagctttgccaggtgtccatgtttggaacacaataaaagaggaggtcttcgaaaggaggtgactcagagaagcaacgctagactcaccccagagctgcaacctgctaacttcacagagcctcacagcagaattatttaaccccaagccccctctcctcatggggacaaaagagaaatcaggctgatgctatctccctcatagcacacttaggaggagcaaatgaaacggcatatgtaaaagtgcattgtaaattgcaaagtggcagatgagattattattactgcttccttcacctcaacaaagacccataatcacagacaatgcatcgagcctggtgagggtgtggcctttcttggccctgccctttctccttggctcctcccacgctcttggcttttctcctggattccctgctctcccatctgcagcaggttggggccccatggataactatatctagggaccgactcctgggatcttaccaagtcacatttgcagttggtgcctccttagtcactgccaggattccaggcaggtataatgtgctgcacttaatgtagaggatcagggtcccagtgagcagcttcatcttcaggcgtcgggagtgggagcaatggagcacccatggtctccaggtctcaggccacttgggtctgggatttgaggctcagggggaggagtcctgcggtgactgctgtgaagtggtgtgggggctcaggatgggacctacttcatgggacatgatggatgagactcaggatgccaggagggaggcacagcccacacttagcagcttggcgcacgcaaataggagctctgctcacagcctgtgctgggcacttcatttcccagagacaaccggcgcgttttaataatgtctacttgggttaatgaaagttgtcggtttcacttaataaatacattgccattcttggccacacatatccgtcatgctgggcctggagctgtgcgtcccgcctgagttgagtagggatgctgggagtgggaatggggtggggaaagcatggggcatatgggtagagagtgaggtctggagggcatgggacatggtccctcttgggagttaagcagagggagtcctctcattgcatctttcctctgggatcaaattagaggcacaaagggcagaagggaaccttggaggttcctcctgttcattctctgcctcagggaagtgacacacagaatggcccctttggcagggagcagtgagccatagtgtggtccagagggacgcaggccatcttgggaaggaatcccagttgaccactcattatctctgtaactaagtcaattattcaatctccctgagcctccatttcttcagtaaaatggagctaataatcatatttgcttcatagagcctgtttcgagcattccagcataagccatgggaagctcttagcaggcacccagcatctaaagcactcaaatcagagtcactagtattattaatgttaaaatattatttttatgaaggcacagtttagtatggtgtttatgagagtggatctggagtgtgggtttggatttcgggtgtatcacttactagctgtgtcactctggagaatttatgtagtctttctgtgtttcagtttccaagtctgtaaaatacggggaaataatacctaactcatggagctgtgaggagtgagcagattatgacatgtacatcctttggaacacagacccaataaatgttaagaattattaagttgtcgatttcacagggccatgggggagggaagtccgggctctctgggaactgccttccacatttccccaccttagggtggtctccagaccacatcccagatgaccttacacaccccaggggttgataccaggccgagaccctcgacattccagggagggaaccggaggactccagtcagtttccaagctgcataacttggttcaaggttggcagtgaggggagagacccaggggagggatcatgcttaacattcttgggacattctccttgaactctgcaggggccttaaaacatccctaagtgccatacctctacatgctggccttcttctgcactctttttttctttctttaaaagcttagactgattaaagatgggaagggatttggggggtcaagggaggactctggatgggaaaggggagaagctcagatgatgggaaggggcgggggtggccaggcagtgctttctagctgaagtaagcagctttggaacctgcctatcacatggccgggtattccagggtttttaaattgcatgccacatgtttatccttattaagcagttgttctcttccaaggggctctctctggcagccaagaaccaaccacagggcttgtcgtggggcttatgagtagctagggcctcccaggaggtcgtcagagtggatggaggggcaaagccaggaaaatacctgggggcttccactccctaaacccagggaaacgatggagtagctgagccgagattggctcacctccttgtacaggaagaaaaactgcggccagaggggcaaggcgaggaagtcgccataacacatttggtgtggttttgggcagacagaacgggtttcttatggctggggctgctttctaatgtgaatatgagtactcttggctgggagaggaagggctggaggagagatcaggaaggagagatccacatctggctccgagctgactctcggtgaccatgaccacctccttccactggagggagcagcctctccgcaggtggggctgtccctcaggagcaggaactgggctcccgctggagagaagcagcgctccacgttcaaagaccattattgccattattaattgatcgctgttattatcatgtaggcattaagtggcttcctctgccctttgagttgtaacacttagggcagctgctagcgaggacaaaacaaagcttccctactgcaagagctttatctgggtccctgctgctgtgtggccttctgcaattagccattttacagatggagaaacttagtcctaatgatttgctgaagggccgagttgcttagccctgcagggtacacagatgaatagggagcgttgctgagcacttgcaatcaagacagagttgccacccactgcaaggacgaacatcactactgggtcagctctgcagctgcaagtctggggaaaagggatccacccaggcactagggcaactgctcagccccatcgcagcaagggcccgaggaacgagcacgtcagctgtctccagggcctttctcatcatctcccgtgcctgccgtgctgtctcttaccaacccaggagggagggttggtggctgctgctccatcctcaccctttagaccaccccacaggtgggacagggtgggcccaggtggagtctgagctgggtgccaattccaggaatgcagctggaggtgggggcgggccatggtgggccaggacaggtgggagagaaaagcaggaggcagctgaagggggcggtctcagaagcccccgctgggagcctcctatccacctggcaggcgtttggaacaacgtgctgaataacagcagcatttgtgaaatctaattagtgcaggcccaacttctgacttcctgtgcgggggctcctcctctagccccaggctatcgagctgaattaagctgcctaagatcacctcattaaattcactaaccttgcttttccaccaggtttagcccctggtgcccttcctctgtctgtgggaggtgcgcgtctggcattcctccagtgcgttcccaggcaggtgttttgagaaactcccctcctcttccctcctctcccctccccaaatggctcccttaatcacgagctgctttcttctgagctcaataatcaccctggactaatccatacacaaaatcctgtggctgcagtaggagcccccttcccagccctccctggctaagggatggtggtcccagaggcactgaggactcctcctggaggcaggcagggggctgtccagaggcagagcattgggcctgctggcaaactgctaactggcacaggtgacttgcatttcctggggcctaactgctgggagtgcacttctggagtggagatgggcaatggggatgcctgatgagacctatgtccaggacaggaggggaggggatggagaagcagctctggagcccagcttgctgttagccctgagaaacaagtgacttcctgtgggtcagagtacagggtgggtagcagaaacaatcaggccagaggggtatttgttgcagaagagaaatgtgatgcaattagtatgctaggagaatggaaaactaacccggagacagggctaaagttactgcccactcaactctgcatggaattgtgctgaattgaggagcactgcagcgagacctgaccaccgcccagcccaggttgggtttgttttccccgctctgagaccggacctcaggaaaggggtgcggggaaggttgggttcagaaggagagactctccagccacacctgtgaagctccaggcagtttccctaatgtctctccttagcctcttgcagagagggctaatgtatgtcttccccccgggctggtggctgggttaattggaccttgtttatgtagcatctattatttatgatttcctttcgtctctcctgagtatgacaactgtggttaagcaaccagagttattcctgcctcgggacatgtatgaggacggtctcctttgcagcctacctgaagtgaatgtgaggccgagaggcttcgtgaaaggttaagtgggtgggggacctgctgggagagaggggcaggggaatgtgcctgagatcagacagccttgcactaagctcagctcctttctggggggacctccgatgcatgctcacttgtataaaatctaactggaactgggatcgtgttctgggggttccgaactttggctgcatattggaattatctgagatgtctgaaaaacctgacaaccagagattccagattaatcggtatgggggtgtggctacaaggtttcagagctccccagtattctaatatacagcaaaagttgagagccactcgcagctccagcacattcttactgtgtcagtttttttctgttgattatgaacaacagcagctaacattaatagaacctgatgatgcgataggcaccgagataagaattttatgtggatgacttcaacgaatcctcagaacaacccaatgttgttggaaggtgcaatgatcatcttccttttacagatgaagaaactgaggctcagggaggttaagtaaatgaggccgaagtcacacattgtttcagttaccaagttaggcctgacctgactccaaaatctgtgctgttaacttttttttttttgagacagaattttgccctttcacccagactggagtgcagcagcaagatctcggctcactgcaaccttcgcctcccaggttcaagcgattctcctgcctcagcctgccgagtggctgggattacaggcatgcaccaccacgcctggctaatttttgtatttttaatagagatgggggtttcggcatgttcgtcaggctggtcttgaactcctggtctcaaacaatctgtctgccttggcctcccaaattgctgggattacaggcatgagcctgcttgtctgaactgtaagaggattttaacagtttcccaagcaatgcttcatattcacaaatgaacacattaggctcaaggacagaagggacatacttaggatgatagactaacctggcccagcctgcaacctcatgggaatgtgggataatgagagagaatgtttgcattggaggtctgtgggcgtagagcactcaacaaatgccaggcactggggctataatcacatggggagaaggagccaaccgtgcatgtctgaagcaggtattctcttccctgcaggtgccaggactacagacagggcaacggagagcaggggcttgctggagaaatccatccttccctgggatctcttggagggctctccatctctcttagagcagtttctttcttagacagttgaagctgcctcagtggtctccccagatcatgcaggtcggggcagaagcttctcactcagagaactgagaatatcatttttcacagaagtctaaggtggaatttagaccaagatattcttggccttagcagtttgactcgggcgggggtttgaagctggaacttttcaacatacatctccaagcttcaggaggaagctagacacatctgaaagcctctgaacaacctgcgatgaagattcttgaaaaaagagaccatttgccttaggggctaagagtacaggtgcaagagacagaccgcccacattaaaatctgactccactcctgagctgtgtgactttggggaagttcctcaactgaagtcacaaagacctaatctgggaggtgggaatagtcatagaaaaaggatcgtggggaaatgaaacgagagaatacatgtaacgttcttggctcacagcgcccggtgaatgttagctgctattactgttgttcctaccaccgcaccctctcccattcctttccttctcaattctattgacatttttggtgtctaactccttttgagagatcatgacttttgtagaactaggctgctttcactctttgagggtggtctttctgattgatccatcagtctgcattctccttgccgtccttggtatgcacacacatgcatggaagctatattcctccttcatactggactttgaggacaacgttttcatgtttcacatttcccacttcatctcctttgttttccacttgcttagtttcctactcttccctttatcctgaggtgtcgtgagggcaatggcctgcagagtccaaaggtggctgtcatgtcatttgtccacgtttgcattcccgtgccctccccacagatggctgctctctgggctgcacgcacgttgggttcactgatcgcagagtctttttctggctgccaagaacatggtagcctcccagaggctgttggcatgtggatgctgcctctgtgatccacagccccgccaggctgatgcttcaggaatggatcacaccttggctggacccatcaggctggaacaccagattcttaatcaactgtaggtgctactgtcgctctaggacctgccgatgccctctgtccttctctggtgactttgtccacgtggatcttcagttccttcaacatgtgtgcttgttgccccttggagcccacctcctcaagcaagcctcccagcccagtcagcccctgtgcactctcatgttacctgtgcatctccttcacaactcacgtcactgatggacttacgcagttgggtgtgtatttggtaacctgtcttcctcctgctgaaatatcaactccaagagggcaaggagtgtgtctatttgttcactacagtattatatgaacacccctggcatataataagtgctccctcagaatttgagtattatatggacacccttggcatataataaatgctccctcagaatttgagtattatatggacacccttggcatataataaatgctccctcagaatttgagtattatatggacacccctggcatagaataaatgctccctcagtatttgaataaataaatgtggtgtcaatttggattaattttcttgatctcatacttgtgttctctatgcatcctatcacctggctctgctactaactgtctcatgaacttggaagctttaggggttagtcttttttaagtacattcgttaaaaaagagatgttgttcatataacataacattttcccctttaaaatagacagttcagtagttttaagtatatttacaacattttgcaaccatggccatgacctcattttggaacaatttcatcgcccccaaaataaaccccacacccatcactccccatttctgtccccgtcggtagccattaacccactttctgcctctgtggatttacctatactggacactcctacaacatgtggccttttgtgtccgtctcctttcacgtaacaaaatgctttcaaggttccatcccagttgccacatgcatcagtactttattcctttgtatgggtgagtaacattccatggcatagctataagcgcattttgtccattcatcatctgctagacatttgggctgtttccacttttcggctattgtgaatactgctgctatgaacatctgtgtaaagtttttgtgtgaacgtatgttttcagtactcttgggtatatacttagaagtgggatcactgggtcatatggtaactctatgtttaatttttgcagaaccgccaaactgctttctgaggagtttttatttgacttttttaaatgaaaggccaatttagtgtccacccccttacatttaaatttttatttgataaagaactcctttagaaacatattaaaaaccatggaatctccagataaatgcatatgtgtgaatatacatcatttcaggggtcccagaaccatcagaaactggctgtggatcccaaagttcgtgattacaggctcgcacgcagcagtgttttaaggttagatgattttctccaacacagaactccagctacagttttggctttttcacacggatattggagatggataatttggctaatgagttctaatccatgttctgatttgcatctgggatcagaacattcagcagccatttagttgccttaattttttccacccactctgcaatcatttgattgatgtgcaattacctccccctgcttggacacgtgctttcccctgctcatgtgtgtcatccaatgcctgataaccttcattttttcccatttattttgtgtgtgttggccactgtttgatataattatttttgtaatcatcttctattaggtgaaagaatattgcagtagagaaagaaggaaaaagaaaataaatgccttcctgacaagttctaatattttatgttcacaaatctcccaatatcagagcaataatattattttctcgatgtgcatttattaaaatgtaaagtagctccatcacattgggaacgaaaacccttgcattaccttggccagaaaatatcacttatttatttcagattgcatttctggaatgttaatactgttgcttttttttttttttttttttttatttttttccccatagcctttatctagcaggggagtgaacctgaaggtctgatttctaaacaggccttgctgaatgcacaggaccttaatttggttttaagaattgcttttggctcttgatttatgatgaggttcttttctgtgtaattcttttggctgaaaactgaatagagttctccctttgtgggtggcattttgacatcacattttaagacagggtacagatgtaagtggggagtagggaagatttataaaagagaagggggattaacatgtgcgctttaagggttggaaaagttcgatctattgtcgatttctctatggtatcaatggcataccccttagattccagttcctaagtcagaatgttaatttccaggtagcctagtaaaagagatactagattggaagtcagaagccaggagttctaatcctatttttccctctaagtaggtttgtgaccttggacaactcacttccattctttgcgctgttttctcaagtgcaaaaggaaaggttgaactaagatggatgggttttaatcttagctgcgtattagaatgccctggagagctttgaaaactacagtgatactcaggcccttagatcaattaaatcagactttctcatgagggtgcatggacctgggcattggtgtctctactaaacactgcccaggtggttctatcatcaagccagagatgaggacccctggtgcaggtgatctcagatgtccctccagatttctggttcctcagtgttatgagctgggcagtgatgtcagtccagccaaggctggtgagatgtatttgcagacaagtgggccgcaatcacaggattgtgattctgtgctggggttcgaggtgtctccgctgggagactctggggagatcctgaatggaattgaatttctcttagtatcaggtctgggttggggcaggtaaatcttcctttctttgtgggctcatggtgctgagaagatggatgagctggggccggtaaaatagctttgttccttggagaaagtcatgtagagagataaggtaggcttattatttttcgagtggaactgggactgtttagcctagaaaaggggggacttggggagaggcgtgatttgcggtcttcaagaggctgaaaggctgtcatgtggaagagggattggagtgatttgagatgctctggggggctgaactcaggtctgtgggtagagagtcagggaaagacattttggtgcattatgaggaagaattgtaatgtagagctgtgcttcatattccccgtgcatacctctgccttagcacctgcttttatgacagtcttctctacaatgagacgacatctttctcatctctgtattctcagcacctaatccagttcctggcacagtcctcaataaatgtttattgtcattcctgtgattattaattactgtcatgaatgcccactatgcagatcacttttcttgctttatcttgtttaactctcctaatgctttagaagtaagtatatttattaccccactctacagttaaggaaaccagagctttgggaggttaaggaatgggcaaaatcacagccagtaggtagcagaggctggatgtgaaattaggtctgtctgactcaaaaacctgtgttcctaaccatcctgcccaccaggatcctggaggtattcaagctgaagatagacaaccacttgggggacctagttgtgccatggcaataagtatggattgagttaggacagtcccagatgatgatggagccaggagctgagtagatttttagagtctgaggtcacccagttactgctctatcagccacctaccccacattcctccagtgaggtgttggcccggtccagaggcagagccttactacctttggctacataggctctgggatggcagtgctctctcagcagttatggtcttttccaggtaataagtattgcggcctcctctgccacttgcctgcattaagccttttggtcatatgtctggggagcagacttctttgtatgcccccggggacaggacaggatggagggaggagccctgggtgtgtgtgtgtggggtgcgtgggtggggagatgcatgactgctttggttatgaaacattgtgttagtgtgtccgttcacttcacatagacacagtgattgcattactacgcggccgagcatacgtggcagagggtggaagcagctgaggaaggagcaggtgctccaaggaaatctttcatcaaagtgatggcatagctaaaggcacagaaagaaatgcattactgagatggcgttgcccgttcatgggcggctgcaaggaaggctgaaatggtggcttgggagaatgaatgggagaggggctggaattggctggaaagacaggaaaaggaaagagggggagaaacaagttcgtgggaatggtgattcctttcaaatggggtgcacagcctgacaagctgtgcgttcttcttaaacacagcccaaatcaagtcttaacttgaaagaaaattaagtcagattcagtcatgaccctcctgttagcctggttgggcatagaggctttccagaaaactctctctggaggggttaggtggtggttgtagcagtggtaagcacaaaaaagggagccagcatttgagaatcaagtgcttaaaatacatcatcccatttgtttctgataatgaacacacagagtgggtgataggattttccttttacagatgagaagactgaggctcacagggcttttgttgttgttggtttagagataaagtcttgctctgtcacccaggttgaggtttcatggtatgatcatggctcactccagcattgaattcctgggctccagtgatcctcgagccttagcctcccaagtagctgagactacaggtgcacaccactgtgattggctatttttaattttttttgcagaggcagggtctcactattttgcccaggctggtcttgaactcctgggctcaagtgatcctcctgccttggcctcccaaagtgttgggattacaggtgtgagccacttggcctggcctcatagatgtttcaaagactaaattataagtgaaagccagagagtcttacttaaacatgacttaaaaattgtttattttaccacatcatgtgatcttccagttttccatcagagcaggcaggttggaggttgggggcttaggagtttgctttcacagcctcactaaataaattttggggaatggccacagattctagtgggcctgttagcctgacgaggctgaggttgcagacaggacccacagaatgggagaagctgagttacttgcaagttggaaaggtgatgtcatcatgaaacaaaatggatttggttggtgggcttgcccacgcagttagatggcaggtggtgaagaaacatggcctcttctctcttataactctgaggggcaggaggagagagctgggaatcactagattcactgcagagaagtttggggctgtatctaggtcatgggtaaactgataattggaaaagaaattcaaggttggacattcattttgatttttggttttcaaagtttatacttatctactttcaaaaataattttaagagacatactattttctcaggaaaagaaatatatgccctctaaatagttttcttccttgaatattgccagcaaatcagccatctcattgaatattgatggttgtagagcaaatcacgaatgctgacctagagctgccatttattgagttcctactagggatttgactctgttttaggtacattgcacatattagctttataaacattccccacaacccagcaagataggcatttttatccccatttttcagatgaggaaactgaggttcacagaggttaactgacttgctcaaagtcccactgtatataagtagcaaaactaagatttgaactcagatctgtctgacttcaaaatcaggtgctctttctactctgtgacatgaggctatgaacatgtgaatctcagaggtaaaaagcagagttggatatggtttggatctgtgtccccacccaagtcttatgttcagttgtgatcctcaatgttggaggtggggcctggtgggaggtgattggataatgtggttggtgttctcatgaatggcttagcaccatcccttcagtgttgttctcatgatagtgagtatgtgagatatcacgagatctggttgtttaaaattgtgtagcacctccccactcccctctcctcctgctctggccatgtgagacatctcgcttctcctacaacttctgccatgattgtaagtttcctgaggcctcagctaggctgaggcagatttatagttacgcattggccagggtggtgctaactcactcatgagaactcacccacatgatccaaaccatattagtgagccaaactctaccttttagctctgagattcatgtgcgcagaaaccgccatgtttcttgtacggcctatggaaccaggagccaattaaacttcttttctttataaattacccagtctcttttgtctttctttttttttgtttttagacagagtctcattctgtcatctgtcacccaggttggagtgcagtggcacaatcttggctcactgcaaactccgcctcctgggttcaagcgattctcctgcgtcagcctcctgagtagctggtattacaggcatgcaccaccatacctggctaatttttatgtctttagtagagacaaggttgcgccatgttggccaggctggtctcaaactcctgacctcaggtgatccacctgccttggcctcccaaagcgctgggattacaagcatgagccacctagtttcagatatttcattatagcaatgcgagaacaacctaatacactcacccttacctcttcaacacaaagagtcttcccagagcatccctgctaagggctgtgacttgaatcaccctcctctactaatgaaagactcgttaatgactccacgaggtgtcaggtccactgtttgatcctgcattggttcacccaaggaatatttaatacgtgtccactgtgtgtcaggtactattctagaacctggcaggccagacaagggcctggttctcatggatcttgacttctagttggagaagcaagcccttgaaaacaaagtaaataacaaagagtttcaggtgctgataaatgcattggagataatgagacagcggtctagagggtgtctggccatagggatccctttagatggaataatcagggaagattttgctaaagagatagcaactgagttgagatctgaatgacaaggatatgccttccaaagatctgggagaaaggggatttaaggcagaggaaacaggagatgccaaagctttgaggccagactgagtttggcacattaagtaagcccaatagcctggagagaacaatcaactagggggagaatgggaggagatgagcccagagaggaaggcggaagccagatggtgtagggcccacctgccatagcgagggctttggattttatcctaagtgtggtgggatgccatcggatgggtttgaatgggaaaatgacataatctgattcacattttaaaaaaagatcctatgtggagactggattgcaggaggcacttctaattgttggaaggactgttctctcttctactgatcaaagttggttcttcaagtaatgacccttatgaaactgtcctcacaacattaatgagaattacaaaccagactttaggcggatttgtagttaggcattggccagggtgcactggtgcactttgacccacttcctagcagctgctgactgaccaagagtcacacagcatgctgaccacctgctttcccattgttcctaaagatagaatctctgacactggacctttttactcaagaattacttaagttatttttcggatcctgaaatccagtggaatggctcatacccaccagtcttaagacccccaatcaaggaactgacccagcacaggcatgcggtttcttcatctccctgtcccatgacttcattcctcacttcttgaccaattagtgatcccctattcccttacaaaatcaaactccttaaaaatcccatcctaagtttctcggggaggcagatttaaggtttcctctcatttggctgccgtgtgattattaaactctctctctgctgcaacttccactgttttgctgtttgcccacacagtgggcaatcgaatctggtggtcttataacacttgaccaaaaaccaaacaacaaaaacaaggctactttcttccttcttaaaatttttccaatcagctattatagttccctttagttctttctaaacttcccttgttctttgaattgatccttggattctagacccaaggtggattctagacccattatcttgatcattctttatcagcaaatctcttgcttgtccatgtccttattaacatgtggcatccagtaccaaacactctttcaccagcccaggattctgaggggctgtgaattccaaggacatccattaatgaaaagtattagactaagtctttgttgagtagtaattcttaatgtgaggctctaggtccatgaaagggcccacatacaccacacaccattgtctatggggtgcctgtgcatgtgtgttgtgtatgcatttctaggaggagagtccatagctctcattaaagtctcaagcagagcctcctccttgagaaccactgccctaggaagttaaatcaaaggatttctctactaagcagatgttacaattagttccttcctggtcccacattcattcccttgctgccttcttcaatgcttttataggtctcttgatctcttcttcctgcctcataccccactttaaattccttctttagcttctaataaatcatccaaacccagagaagataacttctgctttcttcttggagcagcaactagtgaggaaggccgtaccccacttgctggatgagaacatactgacaaataggcctaagaccagaggctttttgttttttcttctcttctctggactcataggtctttggaactgacctgtgtgcctgacttgcagacttcttaagagcagggcacagagagactggaaagggcttgagtgtaagcgaatgcaaagggcaaagtcatcttaaaagaattattattcatttcccattgcagttaattttggcaccttcatcagggtttaaattctagtaccatatcatatcaaaggaaaaaagtatttgatgtacgtgttaattactgctaagatgtagctacttaaatcaagagtttaatcttcatttgactattcagaacagctctgagtgggggatggggagaaccccttttgatttgggttactttaataggtgatgagaacttcaagcaaaatggctttctaatttcagtatttggatgtcttgcaattagtacccagctaaaggaaaaataggaaaatcaggttcctccaggaattcccaagtttttgcttgttctgtgaagtggaagaatgttctgaataatttaatttcatgtgctcaaaggcttgagaatctgcagagtgatagcctaatggtaagtgatatcttaaaagcgtgtgagaggcttaaaaagtagatccatgtataaaataataaactattatttaaaagcacaaattgtcaaaatgatactactcttagatacactctttataagaaccatcttggttgaatcctaatgtgcattttttttaataccacgaaactataaaacccattgaaacaccacattatttaccaagtgattaaatcatagtcatctattatagttttactagaacattgttttcttggaattccaaggctttattgcctcagatataacactttactcctaataatccctattgattttattatattaccttatatttttagatttgttttaatgccttgcattacattttagccttaatgtgctatataaaatgagatacatcatcatgtttctcaaaccttctgaaggtaattatcttaactaacatggataaaaaaatgctcattgttggctgctgacagtggtgggagtctgggggtggggaaggtacattgtagtctctgggactgttggttgtatttctggacagttgaggtgctgcccatgggctgggtgaatggtggtgggtgtggtaatggggcattgccacagattaggtatctcatttgtgtcattattttgctatccttgcctctcttgggatttgtggctcacactgcatttacaaggtgttttacatacagtaattgttcacttgctaaatcagccagtagagaacttggtattcttagagaaagttgttgcacctttgggtgctgttttaattactttttcaaggtgccttctaaatgttaaaaatggtgacacattttatctcaagttgaactttgcatccccattctctggatttggggtcattctcttgccttggagtctggagggaggagaggagtcggttctggcttgtgagccatggtgctactggtccctctggaggaagggtagctactgatgagccttccctgcagcaattgtgtcccaagatctgacacactcttatcagggccccagcaaataactcagcaccttcattacaaaagttagccaggtatggtggcatgtgcctgtaatcccagctactcaggaggctgaggcagaagaatcacttgaaccctggaggcggaggttgcagtgagctgagatcacgccagtgcactccagcctgggcgacaagagcgaaactctgtctcaaaaaacaaaaaaacaaataaaaactccacaaaacttcagtggagactagattcttgactactaggaactcaaactctaaaaggagaaaataatcacaccagctacactttttacagtgctaactatactttttgtagagttaactacatgcacaattttatttgctttatctatattaattcttttcatccttatgaaaagcagatactatcattagctacatttcataatgaggaaatggaagtacctagaggttaagtattttgcccaaggtcacacagctagagagtggtagaccgagaattcaaacccaggcaatctgatgctcagaacctagactcttaattacactaatatgatatttacaatttacaaagcgttatccactagttatctcactgattttcccaagagactttggctccactttagacataagaaaacagaaataggtcatcatttgtctaaggtgacagagcccaaacccactaacaggacagttttcttcaccttcaactcatctcaatgggtggaaaaacctacccacatgctatgaggatgggaaaccaaagtgtctttgcacataaacagactgcctccctggaaaccaggcctgtccttggtggtgtatgagcaggcccctgggatcgacacatggatgaagggagccctctgaattctcccacatctctgggcacccctctaatgtgctcttctcagcttgttgctccttcactgtaagtccaagttctttgaaggaaggaactatgttggtattctgtgatgtacgcggctctgtgtgctggtgagattttgtagccactggaatgatcagaaaaacgtctgtgtgaatcttgcatgatggaagaggaaaccaggtaagagtgagcaagcaggatggtaaaagggataacagctgatgggccagcaaggatgcggggaggatacctgtggtcaggaccaggttgtgtgcagggcagctctgattgctttcttagcagaaagcacaagaccaggcaaagcaggcgaggagaaagccattgaataaatactaagctagaaaacaaagatatacatagaaattctaggttctcaagaaaataaacaaaccaacttacagaaaacccctttccctgtgttgaggccctctgttgaacctggcaataaacgttatgcctctccccaaccccagtccagaaggggctggcaggtacctctttttattcattgagaaagtaacggtgagcagttttgtgaattctgtgaattacccttgaactggtcagaaagatccaacagctcagacaaggagaagggaagagctaatctcctcttcacctgtgatgactgtttttccacctgtggcttgggaaggaccatccttgctggtgatggatgttgatttagtgctttgagatccctggaagacaggtcaggcaactaacaaggaaaatggcattttgggtcaagtcactaggaatgaagaactagaatacagggagccagggggtggcggtgtggcggggaggaggccagaatgaaagataggaggatcagagaatggtgataagtttgtacaggtgggatcatcagttattctccccaaacagatcattcttgtcttctcctctgatttccactaggaaaaaacaaaacaaaacaaaacaaaacctgaggtatttcttagaacacgaagcatgaatcacttacaccagagatgagaaaagcaccatcaggtgcttaaaacacaattataattggaaagaccaagaatttgtggttcatttctagcaggtgaacaaatgtatgtttataatggtgtaaaaaccctggtttccccttcccattcccggtgccttcccagtgtgcttggaacactctactgtgttattcacctgacggattaagctcagcagaggcaagctgcctaggcatgtcgtgtaattcagcattaagtatcctattgattcactgaagtgctgccatggatgttaatggagacaaatattgtggctgtgatttttcaaagggctgagtaattcccgagcatcaataacgtgtgtcatgatgtaatgcagggagacctccagatgcttgacttgaggccaactacggagggcagagctgatggaagggcccgttggatactgacccagggcttggggagatagcctgcactttctccagacctaccatcagtaaggatggtggaaattggggtggggcagggactgctgatggcgtttcctagtcactcatcacaaggtcactgattgttggatggcatgggcacgcttcccattatggaagcttgctgggccttaggagcttataccataccctgtttcagggaacagggtgggttttctcccctctccagttggaaacactacatatccctgatgataatgcagcaaaactactatctaatcttaacagcgtctaccctgtgccctacttgatctgagcatgtgaccacttcagtgcacgattccagtgactgctttcagagaggttacatgccttcctcaaggtcactcagcttcctcaaggtcatggactaggctacaatccaggtctcaggactgcttcccctggtctattctcagttacctttaggtagggtctctggaaatcatttgagtatatggcctgaaacaagcgacattttcttccaaaaaggctctgtaaaaatctcagggttggtcgttgtaaggaataaattattcccaaacaaatctcatttcagtcaaattctgcagactgcccaatctttcctacactccaattcattctccatactgctgcttacattatcttgaaacaagacaaatccaatcttgtcactccctagcatgaagacttccatcagcccctctctgctgacaggataaactccttgcatgatattcacaatctctcccccaagcctgcagtgtgatgtcctgcccctcctgtccccagcacttggaacatagcagaccactttatgctctttgccccctgaatattttatacaagtgattcctggtgtctagaacatctttcccccacctgctgcccagaaaacctcagcccattcttcaagagccagttctactatcccatcccaggaaaccatccccacgtctccagggtagagttatgagtggtcctttctctgagaccccacagaacactgcttatccctttattacccctgtataatgacagccttcctattgaacttactgatttattttcttgtgtatcttcctgcattggaatttggatttctgcggttgggggctgtgtctttgtcatttttgtcctcttgttggcatgcagtaagtgtactacataagtttattcactgaatggatgaatggattctggaatcagaaccctgctggggtagggactatcagtagggtatagggcaaataaattggccctgtgagatacatgtttctatagtcctgggtctaggagggacccttgggggcttgagaactggaggcagaaaaactgtccttcaactcagcagcatgctggggtcttggagagagtctctggggctgggtgtgccctttaactaccatgtcccttgaaaatggtagccctgagaacatatgcaaacatgtattcccttgggaaacagagtctgacattctaatgaagaaccagcacacttgactttgatcaacaccagccttataagcagcatggatattgaaacattcagtaaccagcatggcatgtgcatgggtcagtcagaatgcacacaggccacagggctgaagcagaggtctggagggctccattgtgccaaccattaactctttagtagctggacagtagggggtatcttggaggagggtctgagaatagcaggagaaacatgagtaagggggcttgcagcggtgactactgaccagccagtataaaaatatttcattattttaacaaccggccctggtactgctccaccggtgcctatcagcccgttgataagtcttgttaaagaataaccacagttttggctgggcgcggtggctcacgcctgtaatcccagcactttggaaggccgaggcgggcagatcgcctgaggtcaggaatttgagaccagccttggccaacatggcgaaaccccatgtttcaccccatgtttctactaaaaattcaaaaattagccaggcgtggtggcgcatgcctgtaatcccagctactcaggaggctgaggcaggagaatcgcttgaacccagtggggcggaggttgcagtttgcaccattgcactccagcctgggccacaagagtgaaacactgtctcaagaaaaaaaaaaaacaaaaaaaaaagaataaccacagttttgaagcctcaaaggaaggtgtgtgtgcatgcatgtgtgtgtatgtgtgtgtgaaggaatgaggcagagctctataaaggcagtactagagtggaatctttcatttttagttgtatttcaatataagcataaggaggtggaggtgagagaatttcagactgaggaactgaaagagccagggcacagagtgtgaaagggacctatttgggagaggtggctgtaggatgctgaggattcctgggggagatgaggaaggagacagaggctggagcaggtggccaagggccttgaaaaccatgttgaagcatggtgacctggtctgtgttcctataggccgccctttaggcaaaccttattgcttaggctggcttttgggtggtccttgctgggacaaccagtggcgtcatcttcaccaagtctagggtggtcacctggtgatgggaacaagcttctccttaattaagaatgtcatagcagcctccctggctccatggtgactgacgctgccagtccagctgccatgtggccgatgtgtcctaccgtggtacatcatctcctaattaacatgtcttgtcaggtccagcggttggctttagtaaatatgcctcaagcagctgtcactgggaccctgcgtggggcctgctgcctcattagctccagagaagggagatggcattggcggcaggagggagggagaagaatgttctttatggggggtgttggcaggattagagggatgtcagatgctcagagagaactcacaggccccagtggagggcttggatctgagcaccatgagcctctctctctcccatgtgtagtgagaggataggtgggtagcagtgtgggcaggaaaacagcccaggagttgggagacccacatcttcattctgtctctcccaccaccgagcaaggctcggtctcctggtttgagaaacaggaatgatcccagctctacctatcctgaagtttgttgagtggttctaatgagcaaatgacctatactattctgaaggacaagaaatgctaaattttacagaaatcaagccagggcatggttgtaatttggggctatcagagagaagtctttgctcagacaagactggtccctctgaacacacttcgcccacccctccaaggcttctggcctgcatcccactgcactgtctgagcactcatcaagacctgctcaccacccaccaatcctgtcagactctttctctccagcctggcctcgccttctctgtgagaaggaaaatgagaacattccggaaggaagcactcttctttctctggctgctggagtaccttccaggctgtggaggcagggagctgacttcacagtgactgaggagacataccttagcccacccccactggattttgagcacatgcctaaactttgtacccatgagagcacatagtaggtggttaatgaatgtttgctgagcaggaagaacagtatatcccgttctcctagctctcaaaacaatggtgggtgatttcatagtttctttcagcaacttgttctattgccaacctttctataagccttcttctgagatccagcccagtctccttgggcagtgtgtatctgtttcctctttgtccccagcagagaatagaaactgactgtcattctctctgcctctcctgaaagactaatactaagcactcttatctcaccccttcccatctttcctattcatcagatttcctggagcccagcctgctacctggagccagggcctcgcctctactgccccctccgctcgctctgcctgtgcagggtccatcctgaggagagtctgagcaactgaggatgttgtgaaagcatctgacagcacagggaggcagggcttccccagcccagcagaggcaccaaacccacgcaatttgtaaatctttgataatgagcatttaaagggcacgtcctaatgaagggagccaggaatgactggccatggaatgcaggcagaagattttaattaaaatgcttgtctttttagttttcctcttcccttgtctcttccaaacaccacctccccccaacccctgccaatgatgcacatgtcttgcttctggaccaggcctgtgcaaaaaatgtgcgtctcatatttcccttgatttagttgctctctgggggactgggtgctcttcttcagctgggcgcgctgtgtgggtttgacagggactgtgcacatgtgggtagaggcggaccaggactgtgctgcctgcagccaagcagatgtcctcaccccaggaagcacagtggggctctaagagagctcatgaatgagtggcagctgccagccttgtgagcttcctgtagtgaagctctggggggagctctggggggccagctgggagacttctgggccaaaggggtgttttatggggcctctcacgatacttttctctccaaatggctaaatggagtgtggcggcagagcagctgtgagggactttgcactgctctctctaggggtggagggaccgttggctggatgccttccacgtgctcctccagatccatgtccaccctgccctgtgccctgggaatctgagctgtgtggattccagcagcagacttccttgctataggcttcagattgggtctgcccaatgaggaggccttggcaggacatgggcggaaataggaaaatgaggttggactatattttctggcgctttctttgtgagatcatctcagggctggttgtgtcttttgattgaagtccacagtgcctggtaaaggtggcttctctaaaagatgctctccttcctggttctatgagccactctgtcccttcactgctgccactctttctaaccccaagatactatactcttccttgtattactcctggagcaaaaccttgtaaacagtccctttattaaactctccagattccccaatttctgtgtattgtctgttttctgccaggatcctgatagattcacctgttcttttccagactggttccttcgcaccagacacatggtcagaggggattattcatgttattcctgggatcctagctctgatgtggaatgcaatgtagtctggtgggtgataaacgtccctacttccacatagacggactgggtttggaaaagtgcttgtgaatttgtttcccaggaactgatgatagtctttggacttctccaaaggtctgtgtcgaatggaatataagccccctctctgtgtgggatgaggtgggagtggggatttattcctccccaacatgttttcatctgggctatgatgccattctcattttatagacaaggccactgtggttgagtgacttacccagaatctaagaggcacgttctcttcaactaatatttagcaaagaattaaagcaggttttctaccaattgatggaaatctttcctccttttgttccttgccccttttgctatttgttcactatgaagacctggcttcaaggatcttgtggggaagtgagtagggctttggtcttggactgggaaaaactccactcagatacactctctgtcagtcaagctctcaggcttttccttatccagcaatgacttacctcttacctctgcctggagctggcctctgagtagggtttctgatcttggcttagcagactgattgcctcctgcttgtgcctcagggccctaagcttttagaagcatgcctcactcccagcctaagagcttgtctttgactcctgattggccctttttcctgatgtgtgggttggtgttctcgaccccacagggcgctgaactccagttagaactgccacccatggcaactccacagggtgagcccgccctttggacctgacactatgtgcctgatcactctttcacagacgtctcccttccttcccactccacccgagtcaaggctcctgaccaactaggagacagaggccctttctccttgacacgtcctgcctaaagtgtcagcttccatccctgcctggtgttccccacaccaaaatatgaaaccaatctttcttctcatacacagtgacacagtagctacttcgtgttccctcttcattcagttgtctgtgcaatcagtctgtatgtatgtattcattcattcattcattcattcattcattcattcattctgctatgtattcagcaacctctaggtgccacagcttgcaaatatcatctgaattcattctcacagatctctagcagatctctagtgttcactgttactgccattttacacatgaggaaaccgggtcaaagagtaactaagcggcttgatgagggccacacagctggcaaatgtcggagccagagtttgaagcagaacgtatggcattcgcactggaattctcaaaccccagcacaaggcacctattcacagacagtttgaagttgttcatatgcagaatcggaagattctgagcagattccatccctcctccccataagccacacttccattagctctgctcaggacaggtgggcccctgtgtgttggaaattgagatggagagaggtgaggagagaacaccctgagggagaagtgtgtgggggtggtgcaggcaagaccaattcaccctgaggtgatttgcatctttagcaggagtacatgtcatgctgtcacagccttttcctgtattgacataataacaatcctttacttttgttagcactttgtagctttcaaagcagtttcaaatccattagctcattttattcctacaacaatctcacaaaaggcagaaattattatccttattttgcagatgaacaagctctgtgaggctatataacttctccagagtcaggaagcctggatgcaggcctagatacctgactcctggtcttatggattatgtaccttgcctcacttttctcattgttactttctgattttgagccatttagggggaaaggatggcttcctagactctcagaaacccctcactcttgggttccaggccacctagactacataaagcagtggttctcaaattttatttgacaccgggatcacttggaaggccatcacatagattactgggccccactaccagagctactgattcaggaggtctgggaggggcccaagaatctgaatttccaataagttcccaggtcaggttgatgctgctggtgtggtctcacactttgaggaccacagatataaggcaatgcctatgagtctttagctgaatttctctaatcagggctcttcttctgggctgcagaaacctcagatacagaaagaattgcccttgtgggtctctccctggggtgagaaatttgtgtatgtcttgcttcactgactgtggtgtgacccagagaatgggaagaaaacctcaggctttttggtttatacacacacacgaaaggaaaatgtccacacatgagattattaattcattgttcaattaagttatgatctctaaaattatcacaatatttggctcggaggaaggcagcactgaatagcttgttacacgtaatgtgtgaataatgtaactttattacttttcccactcgtaagtaattgtgactgacacattggcaataacacagattgccttcttaccttcccctctctctactctcagcacggagcgtttactttcttgtctctattattttcttgctcatcctccttccctgccacaagcctcctccactgcatattagccactgctgtaacaagtatactaatgtctcctcatcaatttttatctcccaatgcccaggcacttggagtctaaacttaaaaaaaaaaaaaaaaaagaccaggcgcggtagctcatgcctgtaatcccagcactttggcaggccgaggtgggcagatcacttgaggtcaggattttgagaccagcctggccaatatggtgaaaccccttctttactaaaaatacaaaaattagcctggtgtggtggtgcacgcctgtagtcccagctattcgggaggctgaggcaggagaatcacttgaacctgggaggcagaggttgctctatcaccactgcacttcagcctgggcaatagagtgagaccctgtctaaaaaaaataaataaacttaaaaaatcattctctattaaaatccagtctaagcactgccatgatttgggtatggtatgtttggccatgccgagtcccaagtctcgtgttaaaatctgatttcccaacacacaccggggcctgttgtggggtgggggtgaggggagggaatgtagaggatgggtcaataagtgcagcaaaccaccatggcacacgtatccctatggaacaaacctgcaagtctgcacacctatctcatttttagaagaaataaagagaaacaaacaaacaaaaaaattgattcctagtgttagaggtgggggctggtgggaggtgtttgggttgtgggggtggatctgtcatgaatggcttggtgtcattctcatgctcctgggagtgagtgagttctcattcttcgttcccacaagaattggttgttgaaaagagcctggcacctccccctcgccttgcttcctctcttgctctgtgatctgcacatcccagctccatttccccttctgccatgagcggaagattcctgaagccctcaccaaaagaaaatgctggcacaatgcttcttgcacaccctacataaccatgagccaattagatctcttttctttacaaattacccagcctccagtattcctttacagcaatgaaaagggtctaagaaaaacactgtcttgtcttccttttccatcatccatcagtgtatgtttttgtaccagcaagtatgtttatttaggcagaaccacaggtactggcaacgtatctacagtgtagacatgaaaagaacaggaagagcataagtaacagagattttgttcacatggtttagtcatgttcccactgcaatgtccctcttcatacagtatttcttacctccttccacctcttcagaaagtacagcgtagtccacatgaatgagacctgagtgcactggggcatccttccctcctgctctgggggtcaggtgtggtaatctggcttagcttcctccaaagctccagttggaagggaacacgttctctttttctggggtgatccagtgtcgaaggccaatttacatgcagactgggtgtgttgtctgtattgctctgttcaccggtaccgaaggctctgagtaaggtggaatcagaccctactctactttccctgaacagtgagagcagcaagagctaacagctgagcatctactttgtgccggaccctatgacatgcactttccatgcattcatgcagtcttcacaataattgaatgtggaaggtgccattgttccctgtattgtaccgctggccagtgagagccaggagcctgtgctcatcacaataccatagttttcagccccccaggctaacatctaccctctctcgtggtgcctgggacccttctggacctgatcaaggtgtagcagctaatggactcggaacaagtctctgtagatttgagtggaggcgccacttgggctggagaggcttgcggggagctttgcaggggaaatgaagcttgactcttgggtcctcagggtttaaggtttgccttttttctcaaaaaagacttaaagggaaccaggtcccttgtacctgctgtgtgcacctggcaaagagtgcatcgggtggaatgcagtcctctctcaccaagctcttgcactccattgccccctagcctagaatacttgctccctgctcagtaaagaatcaaattcctgcaaatatccatcctcggtcctaggctacaggtctgcgccctctcggaggcccttgctggtgctctttccactaagcctcactgcctctcctgtcttcaaggggactgattgcactagggaagtgtggagggagggtatatgcacccagggaagaaagcagcacagcacttctcacagctctggtctacagttgctccactcagcaagtggggacagttccagcttctgggctcttcttgcccctaaacttctcctcgatcaggagtaatatagtctgagaatgagcacaaagaacactttttcttttaaggattgaccttttgctcaatgagcaggattgaaccttgaacccaacaaaagggtctgcagtgaggcagggctggacagctccacctctaggcaggcacagcaagtgtgggcattgcttactgcagagaggcttcccttctaaatccactcatggggggtgccaggtgcttccctccaaggcagaaggtaacccctcccagtccagagcaaatcacggtctccatgtttttcctccctggtcccacataggtgagtgatatatacagaggttagacctcagggttatgttatggattggagggagcagagaagcttcctcattaaaagggctgggctggttggctggctccaaggccctcagcacctctgggcttctgagccatgggagagttggacagaaggctgaacagtggctgatggcctggaggaggagatagggagggaggagaaggctggatgctgggttcccattgtacacccccagcaacgagcccccctgccagcccagagtaaccagagatcttgggccacaagtcagacacacctagactaagatgtggctttgaccccagctggatatctgctcacgtcatcaaagctcttgaggcctcagcttccttatctgtaaaatgtggctgggaatacctgttctactgatctgaagaattgttgtggtaatctgaagaggcgattggtataaaaataccaggtaaaaggcagagtgtgtcccatgaatgagacaccctgtccttctccctcaagacatcctctttgtttctcattcccaatatgaaaataacaaaccattctagggaacaacttggttatttttgggtcatgggcagggccagcaggcctacaggtagcgggagggatcagtggaggaagcgacgtgattcctgtaagacttgaatgcccctgagtcaaagtctgctctgaagaccagcccccttagagtgacagagatggggctacctcacaactctgccacttactatttttaggaccttggggaagtcatatagaattttgaattttagttccttcatttgtaaaaatgggaagggtaatagcactatccttagcattataaaataatggatacttatggcatacccagggcatggcatgtgctaagcattcaataaatgtggactattattgttatttcctttttgagctagttgtgtttgcttgctacggaggaaatacccatttcaaagaattgggaggataaaattaagagactggtaacccagcatctgccgtttaacagatgccctgtaagtgagtgccttcctctttctcccttctggcacttgttctgttgagagtctgtgatgcccaaaccttggaattaaccctgatagaaaaaaggcataaagccactggatatgtggcagctctgccttcgtgttgggctcacattacagacatttgagtgtctgcccctcatcctgccccccagatctcactgctctctgagtcttaccttagtctcctgtcttttcttctgccctcctggacccagcttactgcctgctctgctgccagcaccctttcttgtgtcttggtatctgcctgagacctttgttttgctggttacggttgtggcctgatgggctaagctaggccctttgtaccacctcagaacagcaggggatgcagcaataatgccaactaggagtccggatgatctggacttgaatttgtatcccggtttaaccacttactctatagccttaggcaaggcacttaatgccattgcatgccattgtcacatcaatacaatgaaagtaacacctatatcatggcattactggaagataaaaagagatgactgagggataaaaaggcgatgtgaaagtccctaggagggtaggcacttagtaatactaggctacctcccttcctcctcacttctctagtctcaatgcctgcttaggggaggggtagagatcagggtggtgagttgtctcctctgcaggatgactcagcccctccctactcccctactctgttactgcctttgcctcatcatactctggaaaacctagactaaagtaagttttttagctggacctatttttggaggtggagaatggaacttcctcactggtatgctgagttttgatttccatatgggctgatttcagagtaactgggaaaattcagtaattagcagtagcagcattagtgaatcatgttgtaatcatcctcttctcgcttcttccctcttctgcatgttccaaatgctattaccgacactatctttccctccactggcccttggcctcatgttcccactgcagacgttgtgcttcctgcttagcactatgggtcagcctctgggtactttcctccctcccagcctccagcctcctgctcaagcctctgcctatttgtccagaaccctggtgggcacatttagctagtttctcctcttgcaaattcaacctacaggtttatttcaattcaaagaaaaaaatgactcatctaaatcctgataaaaacatggctagtgctgtctgggctgatgaaatctacttggagaatggagaacctaagagaaccttctctgtctaagtctggatatctctgcggatggtcacttaaaaaaagataaaaatgcagaggagggttttccttagcaaaaactaataatcagtggctccatccatttatccatctatccatctaggaaacatttacacaatgtctacaatgtgccaagcctagcactgggctttaaggacatacacatgatagctgagaagactagcaagtaaaccgatgaccattgtacagtggaaaacatgccaagagcacagtgggagcatgagtcagtgagcagcaggggcagctcctctgagagggaaatgcttaaatattgaggaatggagagaatttagctttgcagagtttgctttcattggtatgcgtgtggaactaaggctcaacaaatggaaacctgtaaaatctatacttactcaaatttttgtagagcattgtaatgtgctgggaatgggaagctcagaagaggaataataatgggctttgctttggggtttagcactgacttctcagaatttgagaatttggaacatttaagtaatcccatttcctcttgacagaattttcctaaaacatgccagagagataggaatagaaacaccttgcttgttcttaaagaatctaaatctccacaatgttccctgttcattccatcatctcctgttgttggaaaaacgtacttgtctgtcctctggctgcaactaaagtcagtcctctccttagggcacccaggaactcttgatgtttcaccagtcctcttgctgagctaaacccaagagttgttctgtgttctatactgagtctggcctagtgtcacagaatctgcattagacatagaaatcattactgcataaatgtggagcaatattaacaaaaagctgaagcattcagatgaagaggcagctgttttgccttaggcgggctggggtgggtagccccatagtccgtggataattctccctccgtatctttccctcacttatcctatatgttcacgtcactgcagttatttggtgggcagttgtagtcttagatgagctttagtgaatgggagcccagcttgagggcttgaaattcatttagtgtaggaaccttggtgagaaggttgctgctgtggaggaatcgctatgtgaaaggactttagtcttcaaaagccggctaatgacccaggcatcaccccgtctccccatggccccagtgacagcaggcacaatgtctggatattgagtaattacctatttccttttctagatgatgtaagctctgttttgcttaccactgcatccccgggggctggacagtacactttaatgatttttttttaattgaatgaattaagattcacaagtaatttgaaaggcatctctatttatctcgctggtgtttctcagtcctgggctgcattgccaaagtttccagtttcttcatgacttggccagccccccaatcatcccaaagcccagttaagagaaacacttcggtgctaatagatctggaaacttaagctctggagggccacctgtcagatgagatttgccttcaaaggccactggctctgaccttttgataacattttaaaaaaagaaaccttacatattgactgaatcaggcctgtctccaatgaagatctaggcagctatttgtatttctgtttggatttttgggtccttttctttttgtacctctgggtaagcaaaaggaaaaacgttcctttgctttaccaaacctcatttaaaagttgtttgtatatattttttaatggaacccaatcccttaagcctttaaaagtaacctctactgagctcaataaaccatttccaatgtggcagcttctaatccaggagagttaagaaggcagatgctaaccaaccaccaattgcatcccaggacagttgctgaaagtctcagggctctgcaagctggagatgagatcggctaatcctgactctattctttcgtctgctctgctagctggccctacttgtacaattaatattctccctggtgttgattttgttcaaatatattgggcccatcaatcacccactttccaactcatctgtctggatcagtcatttacaaagttatttttgagccactaggattcttgtgaaatagacacaagaaggagctaaactcatttcaggtttgacctctgtggctgggatctgagaaggcttagtttgattacgcttcatggccatccaatccaatctggcttgtagaatagaaaggccacttgcttaattgggaacactttaatatagatatccattaacttatgctaaattacagtaaagcatctatggaggaacttgatgtgacatctgcatgaatactaaataacttcattacgatcagtactgtgacaatgaatatgaaatgaacgtgcccagagaagacaattaatctcccaccttcccaagccagtactgttttattttaccctgcattgtactaaaaaaataaggcatagaagctctatgattttctgtctatctcactcacccttcagctggtgagtggtccccgagagcttctgtcatttgtagagtggaaactgacccaccctgaggaatagccatgggcagtgggtatgtggggctcctggggacccactttggtttgggaaaggaggttgtcaagactaactgaacacaacacacacacagacgcgcgtgtgcgcgcgcacacacacgcacacgcgcacacacagaattaaaaggcatcctcatccggaactagcaaacagactgtcagttcagattagcaacatcaaaagcattccaatctgttccctgcatacattacatgcatagatctgagagaagaatttggcctctgaattaagtcagctttttccttctgggctgcttgtacctgaaatgtgtggcgaagagggtccagcagtcagattaatacacctcatagcatttagtctgaaccttacagcatggtcttaaagagacaccctctcatattacttgctgctgtttcacatgggttctttctgaatctggaatgaaccatgggacccttgggttgaagactatgcctaactctgtatgaggggtcgctcagaatggaggcatgcatgaaagaatattcctgggttctccattctagtcatttccctcctacgtcactgacttattgctggcatctcctccccttgaccttcatattggagtccttggatctcttctcaatcttatggctttaaacaccgactctactctgatgtctctcaattttgtatccacagcctagaccaccccctaaactctggactcatctatccaattgcctagttctcccctccacttgcaatgtgtaacaggcatctcaaatttcacatgctccgaaaagaactcctggtcttctcccacaggcctgcccctctcacggtcttcttcatctttgaagaagatgataaacttgtcagtggcaattttatccttccagttactcagaccaggaaacttgaagtgagtgatcctagactcttctcttcctttcacacccacatccaatctgtcaatgtagcctgttgtctcaaaatatattataaaccaaccacctctcaccacttcctctgctactttcttggcccgagcctcatcacttgttgctcagatggttgttacagtcatggttctgggtttagcagggtctctactccaggccttgtctctgaagagcctcttggtggtcacaaagctacttgccactctcatcagatcagggtgcagggtgtcatgagttttacagattctggctacaaatacctgaggtaaaaggatacctttgacattagcaacaacaggaagggagaaaattgctattaccacctagactgtgagcaaataacattctggccagtgggatatgtctcaccaatccatttacaggtcgcagacatttacaacaccagcctcctggcttcttatggggatagtggctgcatcatgtcccactgcacccttgcagctgactccatacccctattacataacacaagtctttctccttctctctttgtacccagaggctccagcatatttgcatagcatttattatgctatgtaaatacaccattatatatgaatttatagcatatgtgagaactcagagtaaatccaattccatctaaaaccacgtaatactcactgaggttcccaccacagtccccttgcttacatgtgcacatcctcaacttccactctttctcaggtcaggaacgtgtcaattctgcaacttcaagtggcagttagggaaggatcctctctccattatatgaaaagtaggtgtctagtggggaggagcttccttctgaaatgctcagaaatgtaccgatgtccttagatgctgcagatggagcccagatcccagtgagcgactgctgggctgttcacagagagccagaggcccctttggaaagggtggatctccataacccatgggaggggagggacctccaacaatcttgttagtgcatcaagtaatagatttttgacagatgctttcctgccttctagtccaaacttcaaaatccttcctgcactggtctcattggggttggtggttagttctcactttccccatttctgagaccagcaagaggctctgtttgcgccaagtctccctgtaaacactgtggttatgcccacactaggcaatgccttcctgggagataacattgcatttattccaggactcctacagggaacaggaggggaagaaaattgcctctctgtgaaagcacattacaatgtggcctagcccaagctagactcactagaaatgttaactctgccctgcactttccattccccatcccctttcctctgccttttccaagcaaactcttactctaggaaatacatgtttgattttcttgggtgaccaccatctccaagagaacctcttagaagtaggccaaggagcaaagaagaagtcccataaaggtcaagagcatcttacaggaaaggaaagtggttacggcagattgcaattgtaggaggaatgacacaaaaggggtaggctagaaccagagtcacataagaacagccttctggaggcagggggatggatgaaagaatgtctttatgtcccttcaagggttatgattttgtatgtgcaaaattctgaactgtacatccagttgaacaaagtaaacatttatcaagcatctcctctgtgtcaggcttgaagtgagaaattcaaaggtgaaccaagcatggttccagagtacaaggatcctacaaagtaaaagggtaaaaaaaaggtactttggcctcccttcttccctcccatccatccatccatccatccatccatccatctatccatccatccaatgcaaggcatattgtaataaaggagacacaactctaggcagatgtcatgagcactggaatcagattggaaaactgagtctgccacttactaattctgtaatattgggcagaaaatgtaaacaagcatagcttcaattttcctatttctataacaagaatattaatggtatctatttcatagggttaacatgggaattaaagaagataatgcatattaaagttcttggtacatagcagatgctcaataaattaatatttattaaactaatgaattacaaataaagaaaatgttagggaaacacagaggggagctcatcaatagttgaagagattgggctaaaatttacaggaaggatggaatttgagatggtcttgaagaggattttaacacatgcagatggaagctatttcagacagagggaaaaaacatgagtattgaagtggaaaagaggaggtcatggttcagggaaaggtgactagtgggaaataggactgaagatgtaggctgaggcgatatcatggcaaatctttatctctacactgatgatatagacttgatccttgggcaaaagtgcattagtagggattctggagcaaggcataactgtggtttaggaagatcaatgtggcaacacaatgagtaggattgtactgaagatgaattggagatagggagaggagtttggaggcagcagtaatctcagcgagattacgtgaggattttaacaaagctggtgacagtagaaatggaggaaatagaaaagagttattatgaactggtgaccaaaaagatgaagagaatgaggggaggaagagcaaagctgaccctgagcatttagggagaaagaattgaaaagatcatgatgtcaactctagctcgagaacacagagaaaaggcaagagtttttgcaggaaggtaagctatgtgctagatggagagttagggaccttgtaggaaaccacgtgcagatgctcagtctagctggaactatgtgcctacagtccaggccatcgtccagaactagatataaggaagtggcatcagcctcatagggttaatggctgaaagtgtgggaaaggatgtcattgaaaaggggctaaaataactcttgatttaggggactagcatggtagattgaagtagatccagtgtatagtgggctatgagaactgggaactggaaaatcaagtaggcagaaggacgaaaagctgagtgttactaatagtagaggtaaaacatgaggctaatagagttcagggactggagccaccaagggaagtgggaaaataggaaaggatgaaaagattgaagaccaagggaaggccaaaaagtaggtcaagagggagtgagaaaatgagtgaggacagagaagaactttgacaattggagctgaatgttcagtagttttgagtcgtgcatttcaagatgcaaatggggtagatgcaggtcacttgggggaagactgctgggacctgaggaggtcagaggcttgggaggactgaaatcaccaaggatgaagctggtgaagacatgggttgggggtgggggctgaaagcctggtactaaaatcctagaggaagatggagtcatgtccagaaaacctgcagatgaggtgagaagaataaagagatggtacagtggatggaaatattggggcaaattgctgaaattgaagtgagtctgtggaaaacaatatgcaggatgaatttatccgtctcctattaaatgcctcaaagagttaaagtttttaagttggagggtcaaagaacatctatggaacaaataataatctatagatgtacaaagctagcaaatattttaagtgctaaaatgtgtggtgctggtcacaaatagcttgagcctggtgcctttgaccagccctcctgacaaacagcgaacgtgccaagtcctacaaggcaccgttgcagcccaggagagctaaaatctatgccctggaagaggtgaggacttgggatgaaccttgagggaggggttggggttgaagtgggaggagcatttcagtcaatgggagagtggataaatgagcagaggtgaagtgaacacagcatattctgaatatatcgcaagaggggtgcagactgggcgttatgaaggaaaaagctggaggaagatagagtgggaccagaaagtgaagggatgcagactgacatcgtaacaattcaaatgctaatgaaatattctcaacttgagttccctgcggttgtggtcatgggccaattgcagtattcagtttttatgaagacctccagcgtcttcatgtgtggtcctcaaatcctgaatacttctctcccagagcatttaccacacggtgctgctggtatgccagcctttctccttccaccgtgagccatttgagggcagagaccagaccatctccgcagcctctcaggctacagggtaccctgcattatgcagactgagagctctagaaatatttgtggcatgaatgaaagaattcatgagtaatagccgggcataaatcagaatatgcacttgaactgggctacagtgttccaccagaggccttccacatctaaatggaagcatcatggcacgaggtgaaattctaggtttctgaagaagaaaaggtaagaaggactctcaaagcctttgttaattaaaaacacacacagctcttcagggaacatttccctgcctcccattctccctcgttgtactgaatggcagataaggtggtgtcttcgcctatgctttggaccacatttaattaaatgcctacattactgcttcctcacacaccttattttatttcctttccttccttccatgctaaagagggccagggctaatactaatgcatatgctgttaaacctttttaattaacttcaacttctcccagagatttatgtttaaacagtaaattttttgttgatactcaaatacataggcggcactcggaatgatgtacgagtactcttgtcctcaaaatgattcttcatgagttaccaccagagacgttttcatgagcctcttttattaaaataataatactcagcaaggcaataatgctttacagccggcagctaattaacccaccccaccccccaaacaggtcagcattagcatctgcaggttcgcgatatgatcgcccagtgggtcccccttgtaccttcgagtcagcactgaatcggtctgggtttgtgctctagcatctgtgaataatgattttcatttaaaacacatctttgttcttagactgtagctcaatctattattattgttatttattttgttcttgttagtgccttcctgcactgggtatcagtatttctgatctgcagttgacctcttgaaacaaaatttaaccatgccttggaaaatccaattgatttaaaactcttgtctaattgcaaaatccatttatttttctgcaactctaaatttgtgccccaagtatttttttttttttttttttgagacagagtctcgttctgttgctcaggctggagtgcagtggcatgacctcggctcactgcaaacttcaactcctgggttcaggtgattctcctgcttcagcctcctgagtagctgggattacaggcatgcaccaccacacccagctaacttttgtatttttagtagagacggggtttcaccatgttggccagactggtctcgaactcctgaccttgagtgattcacccgccttgggctcccaaagtgctgggattacaggagtgagccactgcgcccggccaccccaagtatttttaatcatgatctatgctgtcaattgtaattgcaatgtagcaattctttgccaacaaaaccaatctacctacccaagctcctgttcttttcttcatgttgagacaacgtttttccccacaagccaatgtggtcatatcacatgttgcaccaccgatgagccaattatttcaattttggcatcagatttaaaagagactttaatgatcctcaatggtataaactgaatttttattcctacagcaatttagtaatgatgatgacacttaagcatttagaaagtattactcatcttccaaccactgacaaacaggaggctcggcacttttcattttaggcacttttctaggcaagtctgatggggacctcagcatggacagcatttcacaatatttagggagcccaggctcacccctgctactctgccaggagctatagaaagaaaaatctccaagccccagtgcttgtctgctggggtttctagctggaaatcagaataagctcccaagccttgcatgcccgttttaattaacttgtctattcacgcatccaacaaatatttaatgagtttctgctaggtaaggaaacccagccccaggagggagactgagatatatgaggtatacccctttccctctaatcaaattcaaccccacccctctcaccagggtccaagttatttgaatacttcatttatgcatacgtttactcctttcattcagcaaacgtttatcaggcaccttttagtgtaaggtactctgctgggagcccaaaagtttacagcgaagatcaaatctgtcagcaaatccctttggttcttccttcaaagtaaatttggaatctggtcttcttgcccctccaaggctaccccctggtccaagtcacttggaccctgtgcctggatggcggccagagcctcctaattggtctcgcagcttccatccttgtcttctgctgtctagtttcaacagggcagtctgagtagtgcttttaaaaacctaagtcagagggagccgttcctttgttcagaacggtgcagagcattccatctcactgagaatgaaagccaacaccctctccatgactcatggtgctctccggggtctggcctcgttgttacactttgacttaatcttcactcttccttttgcttgcttatacagtttggatttgtgtccccacccaaatgtcatgtcatattgtaatccccagtgttggaggaggggcctggtaggaggtgattggatcacaggggtggatttcccccttgctgttcttgtgatggtgagttctcacgagatttggttgtttgaaagtgtgtatcacctcctccttcacttcttcctcctgctctggccatctaatatgggcctacttcccctttgccttccaccatgattgtaagttttctgaggcctccccagctgtgcctgcctacagaaccgtgagtcaattaaacttctttcctttttaccccgtctcacgtacttctttatagtaatgagagaatggatgagtgcacttgtgctggcctctttgctgttcctgaaactcaccaggcatgctcctgcctcagggtctttgcacttatgcagttccctctgcctgggatgtcctgtcctcggtccctcccctgcttcaagacattgctcggtggccaccttcttggggactgaccatcttatttaaaatgtgcaccccacgcctataggagtactttatatccctctccctgttttacctggctgtagagtgcctatctccatctgacatgattcatctttatttgttcatttcatgtctcctccactagaatgtcagccccatgaagtcttagctatttgttttattgactgatgtatcaatgcctagtgcacagatatttaaaatttgttgaacatatatatgtatgtaatgagtgcatgtaataaatagtgctgtgataatcttcaagaagcacatgatcaaataggaactatatctaaaataaataatgagctatgttttaagaaagctagaaataaatatggtagcccaaagggtagaaaattcattttgcctggttgaatgagtggctaaaatcacagtcctacaatttcaggtgtgtcatgttggaaaatgtattagtcagttttcacactgctgataaagacatactcgagaatgggaagaaaaacaggtttaattggacttacagttccacatgggtggggaggcctcagaatcatggagggaggtgaaaggcacttcttaaatggagatggcaagagaaaaatgaggaaaatgcaaaagtgaaaacgcctgatataaccatcagatcttgtgagacatattcactacccctagaacagtaagggggaaaccaccctcatgattaaaattatctcctattgggtccctcccacaacacgtgggaattattggagtataattcaagatgggatttgggtgggaacagagccaaaccatatcattctgctcctggcccctccaaatctaaggttctcatatttcaaaacctatcaggccttcccctcagtcccccaaattcttaactcatttcaccattaacccaaaagtccacagtccaaactctcatctgagacaaggcaaatcccttctacctatgagcctgtaaaatcaaaagcaagctagttactccctagataaaatgagggtacaggtattgggtaaatacagccattccaaatgggagaaattgaccaaaacaaaggggttacaaggcccatgcaagtctgaaatccagtggggcaaattgtaaagctgcaaaatgatctcctttgactccaggtctcatatccaggtcatgctgatgcaagaggtgggttcccatggtcttgggtagctctatccttgtggctttgcagggtacagcctccctcccagctgctttcacaggctgacattgagtgtctgcggctcttccaggtgaacggtgcaagctgttggtggatctaccattctgggatctggagggcgatggccctcctctcacagctccactaggcagtgccctagtagggactctgtatgagggctctgaccccacatttcccttctgcactgctttagcagaagttctccatgaggttcccacccctgcagcaaacttctgcctgggcatccaggagtttccatacattttctgaaatctaggtggaggttcccaaaccccaattcttgacttctgtgcactctcaggctcaacaccacatggaagctgccaaggcttggggcttgcaccccatgaagccatggcctgagctctacattggcccctttcagccatggctgtagcggctgggatgcagggcaccaagtccctaggctgcacacagcgtggggaccctgggcccgtcccatgaaaccattttctcctaggcctatgggcctgtgataggaagggctgccacgaaaacctctgacatgccctagagaattttctccatcatcgtggggattaacattcgactcctcattacttatgcaaatttctgcagccagcttgtatttttcctcagaaaatgggcttttcttttctattacattgtcaggctgcatattttctgaacttttatgcttggcttcccttataaaactgaatgcctttaatggcacccaagtcacatctagaatgctttgctccttagaaatttcttccactagataccctagatcatctatgtcaagttcaaagttccacaaatctctagggcaggggcaaaatgctgccagtctgtttgctaaaacataacaagaatctcctttgctccatttccaaacaagttccttatctccatctgagacaacctcagcctggaccttattgtccatatcactatcaggcttctggtcaaagccattcaacaagtctctaggaagttccaaactttcccacattttcgtgtcttcttctgggccctctaacctctccctgttgccaagttccaaagtcacttccacatctttgggtatctttttagcaactctactggtaccaatttactgtattagtctgttttcatgctgctgataaagacatacccaagactgggaagaaaaagaggtttaactggacttacagttccacatggctgggaagatctcagaatcatggcaggaagtaaaaggcacttcttacatggcagtggtaagagaagaatgaggaagatgcaaaagtgaaaatccctgataaaaccatcagatctcatgagacacattcacttccatgagaacagtatgggggaaaccacccccatgattcaaattatctcccaccgggtccctcccacaacacataggaattatgggagtacaattcaagatgatatgtgggtggggacacagcaaaaccatatcagaaaagaactgcaatccacgtctaaatgagaaaatggttccttgctataggatttctcagctagactaagaaagtcttttgggaattggtgggatggtgcacagtttgcgtgtttcactgagtcttgataattattccaactgggaatccctctccatcttccccaaatctcacaaattccagtgataaactccactccatgtctcaaacagggactatttttgagaaccatgcatgctctttccagatatcagtggacagcatccaggggggcagagtcagtgtaatttctcatggctgattttgacaggagatgtcaggttagtcttagttatcctggagcctaactggatcttgggaataaatctcttattttggtagcactttcaaataagtggcagcagttcatgcataattacttctgaattatctaggggatttatcaggtttgattatagatgcataatgaatttaccaaatttgtgggtattatggagatattaattccatatgaaacctcacaattcattcatgtgccatttgttttcattccttttttataataagctaattagtttaaattatttgtacttgtacaaggtcttgaaacacatattaggaatgattataccagagaacccaataaatgagaagttttggagacagcattaattgtgatgaagggttcataaagcagtggatgttcaattttcccatttggggtggtaataacaggtctaatcatgacacctccataaagtcatgggaagtccctaatgaaagtttctgaattcagatatttaaatgatggtagggtaagtcattatgccaatgggagaatgaggcaaaaagcggagttcatccttgtgctaaccaaagaaaagatgaaatggtgagggctcatcaattctgggccaggaggaagataggcactagtaggtctgatctgtctggaggattcctttaaaaaaacccaaggttctggaggtcactggcaggctggaatttcagcccctcagagtgaagggatgggcttctttggttgagttccggtgtctgttaaccccccaccccttgttctttgtgtgaaaccagcacccactggccaaaaagcccgggttggggtctctgtgggttgatggatataaaccatcttctttacttagggcacaaagaagaaccaagacaggagaggaagcctgggccaagcctgcctagggagtctatcgtggtaggaacaagagctaccatgccttgagcccattctaaatggtaggcaagtgctagatatttggctcacacatttcatcctcataacagccctatggtgtagagaatatcattatctccacttcacaggtcagggggctgtggacaagaggtcaggccatttgccaaagtcctccactcaatctataggtagcggggctgggttcctaaggatgtctgattctgaagcctggtccttgatctctgtgctccatgaccttctgtaatccccacagtctcccaaacatcaatgctgtcattacaaccccatcacctacccttacccttaccacaccaaagagttactcttttttgaaatctgaatctcagattttcactttccaggcaattcaccaggacagaggcctttcaactttcctccctgagatcttcctccgtgaaccaacaacaaaaggaccagccacctcactggtcctctgttgccagtagaaaaagccctacaaggattaatgcaagaagaagttctgctttgggtgagacatcagtttaatttatatttgattaaaaaagtcattcattcatgcattcagcagccagtatttgttaaatgtctcctacactcttaattgggttttgtcgggttgtgggggtgggggaggggaaaaagagagcaggtataataaagcttatgccagacaccttgtttgtaattgtcttgtgaggaatatatgtacacaactgaaaagttaagtaaacaagagaatgatggaataactaggcaagtgagagaggcagacagtgcactatctacagaatccaacggaggaggcggtactggggcccgtggtggcagaggatgacggctttgcagaggcagaggaacgactgacttgctcagtgaaggatgggcagacttggggtggcagaagaggcaccagctggacccgcccaggaagccaagcccctgtgctgcctcagtttgtaagtaggcatttgaccttgtggggaatcactctctagcgcctcaccgtctttgctgtaagatggagataatgatacctcatggggttgtcatgaaattcaaatcaggaaatggatatgaaatggttctgaaagatgtaaagagcaatataaacaccagatacggaatgagaaaaaagcggcaccggaagtggcattttgcaaactccaatcccccaggaccacatgtgaaggagctcttttcaaggtcacacggacactctgacccgactctctcctggcagcattcaatgtgacacgccagggcaatgagaaacgggaggggctgcgtgagacatggcaaggctgaggccaagccccaaagttcacggacattccataaaaagtgcacggtggaacctgagaaggtggagaagggcagggatgcccctggcactttttttgtctctggtgctatcaaacagaaaatgtcacctttgttcctctatagccatttttagttgcaccaaaggggggagttgaaaaatagaccttgtagctgcctccatgcgattcaggggaaggtgataccacttctgcctagagggtgacccccacgcccagcacatatctcaccctcagtcacagcgaggccacagccctcgattctagaatctgatgtccttgaatctccctatcacgggctcccagtttcaagggcctctggacacatgaatttctactttgagaatcagtttggctgtgtttcggtatctgcattcagcttcacaaggctggtgagcgagggctcgtggttgggacacctgacaggtggcggggaagacctccactggggacactgattttattgctagaagttgctaaaggatgagcaacttagcagctaggacttttaccacttcagtgatagaatgtaaagtcaaccccgagaagatggatctaggatacctaaactgaaagtttttttttttttttttttcacagcatattgcaatgcaacagtgaaaggaattttaaatgggcagcttctccttttctcctacctccaggcatctgcctctgaaatgttgaaggtggagggagataggattggcctttctgggaagacctctaagaaaggggtttccattgagaagaaactacgggtaacagttaaagaggaagagcatgtgtaatgtaggaagcgcttttgcttcagatagatgtccttccctcaccccagagcacagtaaccctaatgctatgtcctgcatctgtctggaggggttgtctagcctggcccacatcctgagccctctccacatgggcaaccacacagccgacatcgtgagaggtctgagcccctcagactcttgaaggtcaatggatattgtgtatcttttttctacactgcttcaatgcttttcaaccattatttttttttatttttttatttttttacaaccttgagtgttttaacgatttgcttctttaaaggctttgcttccctctgaatattatgactagcctattgggtcagaggccaggagtctgcagaggaccattcattcaccccagaggccgctccttgcttttatcctgtcctcaacatgatagctcaaactgccagattttacataggaggaaggaagacaccgaaagatgttcctagctggcacaggctgtgctgaacacaggtctcaccccactgtgggcaggtggtggtggagcacatctgtctctctccgtgttggtggctgtgatttggcagctctgccgaagatttgtgagatggagaagaaagtgcagggttggggtacggggaaaggggtaagaaaggagattagtcacttgagtcaggataatttttcctgatgtcaaagcctcacccaggagagctctcgctgttgcctgcttttatctggaaaacaatgtgagcagtatctctcaaaattaggtcagggcttgcagaggcagggacttgccaaggtgctaactgcctgaatcctcggtgggtttgcacagctctctgctctgacaaatgcctcctttgtctccctgaaaagcctgcctcttttctccttcacccctccactccccccacaaacaactgaatttggaaggttaaaaatcacttcacttgtcaactcgaaagctctccctcccacctcaagttgtttctcttcctgcccagggaaggcagctactgtgtgtccccctggggactggaaccactttgcaaagagcgcagatctgcagttttcacaacgcagttgtcatctcgggagcagtgtgtgcccgtccaccctgggagaggcttatgaaggctgtgtctcaagcatttcagggggctgcagatttagggggacagtcctggtggcttggtcttaggcttgtcttggctcaggtttctgtgtggcaacagcatgataaaaattctgtccactctaccaaaatgggagaagcaatagcaagacagcagggcagcaacagtcagttcttgtctggctttccaggacaacgtgactttctcttattttttgttcctgacactgtttgcactgactaagatatcacgatgatgaaacactgttgaatctaaaaggtgggtggggctgaaggaggggtgggaggaggccttagaagctaattagaatcctctagaagtgtgtggaaatgggaacctgagccaggagagtcctgtggattcactagattctgggactataccttatctatgctgtgcaaaggaataagaaactagtgctgtctcgggaaccagcaacacagatgttcccaggagcaatgtttgcaggtgagtgaggtcagggagggctacagagttaggactccgaagtcagaaagatgcctgttggttctgccgttcatatctgtgagatatcaggctggtttcttaaccataacctccatgattcagtttcttcatttgcaaaataatttaaataagataatatgttgaaaactcttagcacccaataagccttcaaaattataattgttttgtatgttttggcaagaaaatagaataatattattattggagtctctggaaaacctaggtttccaaacctttcaccttaagtagatttttataaaatgagacttcacgtggaatctcaacatacaaaattggcataagtgggggataaggcagcaggtgacagtggttgcgtgctcctgggcaccgcctgcccagcccctgcactgattgtcttacccacaggggcagtttaaatcttcatgcttttaccaccttatactgagtaagaagatgaatttgcacagatttctccctgcataatttctccgtatctttagcacagtttggtgatgacttttaagctttgacatcatgtactcataacctatctcttatgaaaataaatgaaactggctaggcgtggtggctcatgcctgtggtcccagcactttgggaggccaaggtgtgtgcatcgcttggggctgggagtcccagaccagcctggctgtcgtggtgggaccccgtctctactaggaatacaggggttggctgggcatggtggtgtgtgcttgtggtcctggctgcttgggaggctgaggcatgagagtggcttgaacccaggaggctagggttgtggtgagctgagatcatgccactgcactccatccagcctgggcaatggagtgagactgtgtctcaaaaaaaaagaaacaaaaaaaaacagaaaaaataaatgaaaccatgattttctctcacactgtattgtgtttaattttcatttgtttattctataaacatgacaggcttttgaactttgtattacctatatattttataatagatcatgcataatctctcaggagaataaaatgagaattccaaataaataattaaataaataaataaataaataaataaataaatcttcatggaatctcaaggctctgaggggcctagttagacaactgctggtttaaaatattagagaaatagtgggccagttccaaaaaagtagagccctgatgacatccagccagttaacatgttttagtaaccaagcaaaccaacccagaaagacatggatcaggagaaacctccatatgtggcagggcacaggtctgagaggtgagtgctggaggaaccaaggccagagtgggacaagctgtttagcaaagaagggcagtgtcattcctcttctcacccagtgtggggctgggacgtgtgggaactcagggcctgtagatgggttgggggtgaggtggagtagggagatggagacaatgacacagagacagtccgtccccagcccaaagaggactgcgctagcttgggagggaatgagactcagttggcatttctgcacatggtctgggtggacctgcgcaactctgattgtgtccatgtagaaacctgtgctgtgttcagtcactgtaatgcttttgtagttctatggctttttccccttttgcttccccttagttttcagagaaattccaatcaggctttactgctatctaccggaagagacaagaaggtaatttgaccagatcaagaccacccagcccagcagagcgcaattcatgaccagtccacagagctctcctcccggatcccatcagtttcacagagaagatggcattgccaaagcctggggctgctcacccaatccctttgtgtctgtcacagctctcccatttctggaggagtcgagttagcccctccttctcctttgaatctcttctctttaagactcgcagcttcaatacccaaatgctgccatgtctgtagtggtaatgcttggaataacaagtagttattgtcatacaagaagaataaggaagcttttgatgatctcgaataatgtggatatctacatcatttttgcatgtcagtgggtatacccagctttgagggaatggttatttttatacctttcaagacttggtatgcttaattatctagggaaactcataaccccaacttcctaagccactcctaaagaaaaagcacagatgcagtgactaaaaactttctggcctccttatacttcatctcagggctggaggtgactcagatgtaccttgctattttcatgatccattggtgtctcagtaatgaatgttcaccactgcagtgccctcatttagcctaataacctcagtaaggtaatgtttgatttgtgctaagtatctgattaaacaacataaagtatttaacctattgatcttttatactttgccagccctacattgctggatatactttaattactgactcggagagctttcctgaatgggatctgcatctcgttaagactttttctttgtctttaaggtgccatatcaacagcttctccttcttgttgcctctaggcttttcttccacttcctgctcctccgccagaccctgcttgattctgcaagactgacgtttggttaatctactgaaagtagagtcctttatgtaaccatgaatcttactgcttattttagaaagtcaatgaccacataaacaatcggacttgttactttgtccaccctgatctttggagcatgggaagttgtccaaagtgacaaccccattttaggcagttggtcacagctgttggatggacctaacccttctatctcacaaggagacgaggccagtgggcatccatcaagagaaattataggaaaccatttagactggccaattggttagctaattgctctagtctaaaccacttcttagaaaactacagaaaatgatacattttccctcttgcctgcaaggatatagtcatgaacgttaataataattagctgctttacatgctgtcttttcttcaagaatctcagacatggtgagtttatttattttttctcttattttaaaactagatctacaaaggctgagatagcttctccatgggtcctcccaaaatgagagtgacacctcataggattaagagaattcaatgagaaaattcatattgaacacttatcataatgccactgagtaagcactcaaaaaataggagttatactattagttattattagttatatcatctaagaagcctgcgacttgtgggttgcccatgaatttctgaatagagtcaggctgggaggaaggcacactggtccaagtgtctagttactttgtccagaccacctgataaagactgtctcaccctgtgtgccaacatcctttggtctctgctggcccatcacacataggtcttggacaaaaaagagtggtttgtggaggattaaaggtcatgaaaaggcgaacattcaccttcactcaagatgctgcccgaagtcagatcagaagcagagtcagaatggctctctaaacagcttctcaaaggatgccttccacgggctgatgtgcttgataacaatgcaaatgcaaggaacatgccccagacaactgaactggaatttctatgagcacagcccaggaatttgcaattaaatcaagctcgtgggtgattcttatgttcaataaagtttgagaagcatactactaagtgttgcctttaaaggcaactcgaaaacttgcagaaaacatctaaagaaggctggaggtggcctggtgcttattgtataagagcatctggcaagctccaccctctaggtggcattctggtcttgaaaagcatgataaaaatttggggttgctactaagcagggacaattgcgcagcttgtggagtggcttggagacctccaatagccctgctaggatctggggcagacagtgggcaccagccgatgccagggtatgtgaagggcaaaggaggccctttgggggaagagaactgtgaggccacaggactactgaaatagagctccatgcccttctccattgcctctgtaaataccctggggatcacttttactctattttctggcttctctgtcacttgtggtgcagttgggatgcttactttcacttccaaatgatgatacctcagagaatgcaaactgtaatgcacataagacacagacaatccatggaaaacatgatactgctgagacgtaggcacatgttcacactgacgtgcattgcatcattgcatttgttccaaagccggtaaaaatgattttcagataatctgctattttggatcgtctgcactgctgcttgcttccattagcatggctaattgagaactgactgtgtgtcttggaccatttccaggaagggaacccattgcctgtataatacaggctccctgagagagccaagtaaatggctggaaatgtcaggttgaatgcccacattggaggagcaaacttttgaggacgacctgaccattctcaggccagagaagcaatcttgttcagcatgtcacattgattgccaagtcagtaaaccataaaactgtcccacagctagaacatgcactgactctgagaaagatgaggcttggttagtaaaggatgaagccattccaagaccaataaaagatgcaatatggttttccctgggctgtatattaacaccatcctggcagctataggggatagaggcttggcaaacaactgtgttttgctttgacttttgcagagtgaggatgagatagaggccaatggggagatcatctgaggccagatgaaaggcttggaaagagtaagtctttacagaaacctagtctctaaagaaaccactgatgtttatgtgtcttggccagtgtcttctgtcatataacatcttggtgaaataccccaaatagatcttaaaaccaaaacatactaagaaaaaaggaaaatagaaagcacaatgttgtaactgccttctgggtaaccatgttttggatggtgtcatttttcttatgacataagctcccagatggcacagacactgtgtctcagaaaaaatagcaactagcagagggtcatgcctcatgtgagtttctgtaagtattgtttggttgtgtgttgtttatcacaaagagaacagatactattgtcagacaatctcaccagctgcattttgcaagaagaatgagagaagtcccctacaacttttacaattctgtgttctgtcccaaataacgacgagagatgaatcacctgggctgaaggataattgaaggaggaggcacattactcaagaaggtcagaaagcctatgtctaggattaatctgtgctcatggaatcgtttctatgtgttgctaatagctagagggtctgctgatttcatctgtgcccagtcaactccctgggcccacctctaatcaaaagcagaggacataaactgtgaagatttccaggatggatttctgaggacagctgtctatagcttcagatatggcactagacacagtggtgctcatcattggctgcatgttagaatcacctgagggagctagaaaactatggatacccaggctccatccccagagattctgatttaattggtcagggatgggtcctctgtatgaataattttaaaaatcacctaggagattttacttgcaagcagggttgagacagcccgagctaaagcctctttagtggtatgagggaaaacaggaggctctggctcagttcacaaagttgaagatcaaacccagccttcgaaacagcattcttcttctttacaggatgacaggaaataaaagactgtgggagttggggtttgggtaaagaggaaagaagggaagggagaaaaaaggagagagccaaaacgcccattgagaggaagggaataagattgattttcccctagtagtttttattcaaccagggtctgaaatgtgctcagtctacctcatgaaaagtgtgtcacccagggcacactggtgtttctatcgctagtcacagaggcttcgggcaactgctgaatggcagcattagggacccataaaaggaaaaatgcattgctatgactaagagcccattaccataacaattgtaaatgactttggggagtctgcccattgaccatcaaagaaaccagaaaacggggccaggccccttggagagcactagaggcttatgaaagccatgcactggtaatgttagtgtcttagtcccttcgtgctgctgtcacagagtacctgagagtgggtaatttataaaaaacagaaatttatttcttacagttctagaggccgggaagtgcaagatctagaggctggcatctggtctggtgagggccttcttgctgcatccttatatgcagaaggtggaaggcaagctagaacaagttagccaaacactgcataaagcctcttgcataagggcattaatcccattaatgaggaaggaagtctcatagcctgatcacctcttggaggccccacctctcaatactgtcacgttggcaacacctgaattttggaggcgattaggtttcaacatgaattttggaggagtccaaaacattcaaatcctagcagttggagatagcaaagcacattgtatgatgtgacaagaaagtcacatggaggcagaaaaagaagaagagacccagtgggtcaccccaacttcaaatgggttctcaacattaactttctagagtgtaggattttactttttccaaagtcctttctttttttttttttttttttttgctccatctctctgattcttactcatgtatttctactcagaactggagccaggaatccatactccctgttcactgtcccttctggcagaaatactatggaagagcagatgtcagtgatactgcccgatcttggcaagggaagaaccagcaagaagagtgcagggcatctccacacgtgggactgatgagcatggggagtgtggagtgtgagaggcaggagagggatgtgggggaggttttgatatcatgtctggctttttttttttttttttttttgagatggagtctcgctctgtcacccaggctggagtgcagtggctcgatcttctttcaccgcaaactctgcctcccggggtcaagtgattctcctgcctcagcctcctgagtagctgggactacaggtgcatgccaccacacccggctaattttttgtatttttagtagagacggggtttcaccatgttagccaggatggtctcgatgtcctgacctcgtgatccgcctgcctcggcctcccaacgtgctgggattacaatgtctggctttaacaagacaaagcttttgatagtttatctcctgcaattcctggttttctctaaggtggtgctggtttctactacacagggagagggatccacttgtcataattaaaacatctcatggaagcgtatgcttctgtgctttcctggaaaatgtactaatagctggggatggcaggttcccagggaagtggcacatgacatgtcaggggagtccagcaatggggaggcacaactcctaggcccttagatttgtagcctctgaacccattgcatcctggagccagttacagatttcatctgagggacaaaaggagagtgagagacttggaggctccctttggagctctctggcaattcatgattgttgagcaagaaagatggggaatgaggaattagttttcactgaattgccacagggcctgctctgactataagcataggagagccaccccagtcctgtaaagccctagagttgggctagcaggggaaagcacaaggtctggagattggaaggaattttcctgagagtgtgtgtgtctgtgcttttgagcctgtgcccctggcacaagggaaattaaccagactctgcatgttgtgggaattctgcatggcaacctaatagaggcttagcttttcattaaaatttccattaatactggagctgtttagagcaagttgaatgggaatatccataatgcacctcctatcctctattaccattctgaggatcagagtgaggtttcaggcttttgctggggccattagcattttttttttttttaccatcattatgatcatcaacccagcaccaattatgtagagcaggcaaagtacaaagaggctcacacagaacctatccttgtcctatgtgacaggcagggcaagagtaagagagcaggcacgcagaggcagagagtgaagtctagtgagaccacacggacatggactttccagtgttgagaagcacctccttcctcccacctgcctactctaaatgaaacagctctgtcatactgggctagagcaatctcaggtgcagggaaggcatagatcttctgttggaactggggatactgaaagggatgaagaagttcggcctcacctcttgaggatcatttctacagcagagctgcccagaggatcaccattgttaccagctccgatgtgcccttcctgcatgccaaagccagttctctcttggagatggccactgttgctctctgggctgtgggacatctaggaagctgatgtccttgtttcagggtcctgggaggctgtttcaatgacatctcatagagacactttcctttctaaccctggctgcagcctcatggcactacttcctcatctatgaacctcttgtgcccttagacaggggggcattccctgcctcaaccacaggtagctggagctcattctacagtgtccagagtgaaacctgtcccctccaggcagaatgaactgtgctcttactctgcagccttcgacacattattcataacatgatgattattttggagtgcgttcttttgcttctcacaatgagcagacactctactttatccagcttgtatcctctatgctaagtgcacagcagattacatggtagttccttataaattttttaaaaattgttgtagatttccttccacctgcctgaggtgaggctcaacactgttactgatgaaacagtccatgtgtggaaaaacagagcccattaaaaagaaaacccaaacacagctaatagtctgggaatggtgtctgcaggatgatgcagttgacacattctgtttgtgccacacgtgtgttttgtcactgagactgccagctctgaggggaaaaattctactataagaatatttaaaataagattgagtacagtggctctttgccaggtgtgtgtttcaggaggcattttaatgagaacatgctgtcatggtctgaatgtttgtgtttctccaaaattcatgtgttgaaatcctcacccccgaggtgatgctattaggaggtggggcctttgggaggtgattagggcatgagggtggagccctcatgaatgaaattagtgaccttgtgaaagaggccccagagagctgccctcttccaccatgtgaggacagagaaagaaggtgccatccatgaaccaggaggcgggtctggaccagacatcagatctgccagcaccttgatcttggacttctccacctccagaatggtgagaaatacatttctgttgttcagtctaagatcgtttgttactgcagcccaaatggactgaggcacatgcttcagccccagtggtgaagagcacagactttggaaacatgctatgtggacctgaggtctgcctgcaacacttagctgtgtgacctcaggaaggtttcttaatctctatgtgcattcatttttcatttgtaaaactggaatcataatagacccatcaccttgtgccattgtgaggatgacatgaggtaaaaatatatacaaacttagagtagtttatacttatactgtgtcagtctaaagcgttgttgctattaatgaatcagaaagcctggaactatgatctggacctttttattttgaaggcgctcctcggagattctgatttgcatccatggttcagaaccacttgcctactgcattgtctgtatcatagaagttgaggaaccattaagcattaataaataagtgcagcaggatcttggttccgcaggaagagtgtggattcttggaatgcaattgtcatgtggcaagttatttcaggttttcttgttatcctcctccctgtatctataatggacagccttgggttttacctcctgtccaggcacccgttcctctttctgcagggataagagtgagcatggaagtacttaagcaccagggaaaggggagaaagaaaaagtgggggtaatccaccaactgtctaaccatttcctgaaaaatagagggccaactaccattagagctcttagaggattgctgagccttctaagggtttaccaagaagggacaaatctaatgataagaaagttacagccaagtttattgaacaataacccatttccttcatgtagaaacaatgaagaaacattttttctcacttacatggcacaaggaaaacaatatcaatgatttgtgctgcctgcttgtcgagtctgtttaccaacttggcttatttttttactgcatgatatgaacacttagggttaaacagagctctctttttctctctggtgaggtttttgcttttcccatttttatttgtattgactaggaggtctttcaccagaagaataaaagaccatgcttttgaggagccagtcactgagtttctctgttgatcaatcaccattgctggtacaggtatattcattttgggtctgggatggatacaggtttgatgaaaggtccctggggaatgagagggcttagccaacagtctcagggtcagcatttcctagtcctacaagattcagatccctgatgtggagccaaggaaaggcttgagtgactaggggtctttttgaacaaggcactttaatttgccaagaactctacatcattttgtacaatttatttcagggagagatatcactttaagctaaaaaacaaaggaaaaaagctccagactactccatgatggaggacaaagcatctcagtaaataactttgaaagtcaagagttacaggaaataaaaaaagaagacaatcagagaatgtgccactaatgaattcaatcgcagcaaaagtccatttccattcccttgaactctacacaatttccagttgcaaatatctttcagaagtactgtacacacacagttggatattgagttgcttgacaaacatttctgatcaaaactgcttgcctagaaatggctgctggagcaacaataatgtggatttagaatgagccgggctgtttgcacataggtgtagtctatgagtttaatggagttttgcagaaggcaattgcctagaaaatagtgggtttttaaggatgaacttttgactcccaatgcgaggtgaagggaagatcgggggagaatagggagagaagggctgtcttttctgttttctctggggcaccatggctataataacttctactttgctgtgatggactcagcaatcaatttattctacgatcttttcccagacacactctcaactcatgtcggcttagttgaatggtcaccctacctggattctgagacccttcttggggcctcaattgggatatttacagcttccatttttgagaagtgtgtgtgtagaggcactaatttaagaacaaaaaaggccagtgacatctagggaaatgtcttcactttgggcaggagtgggatgaccctctgaaagctgcacaaaaggccacagatctggccgatctgaggagactggtgttttctgatcttgggacaaagcagttaaaatcctggagctcttgcatcttggagaaaaatcctgtagcttctttctctggggcaaggggcaaggctgtttggtcacactgtttagtgattcacagctgggaatcttctgtgtctgaacaatttcagcccctcataaggggttgatagctgagcccctgtgtcttagtcagtttcggctataacaaaacaccataaactgggtggtttataaacaacagaaatttatttcttacagatctagaggctgaaagatcaagatcaaggtgatggcagatttggtgactggtgagggctggcttcttcataggcagtgccttctctctgtgtccttacatcgtggaagggacaagaggcctttcttggacatctttcataaaggcactaatcccattcatgaactccgttttcatgacctaatcacctcccaaaggcctcacctcctaataccgtagccttggaggtgagaattttagcttatgaatttgggggaatataaccattcagaataaaacaccctggctatagaagagaggtggcttttcctctccccagacagcttccctttccccacagtccaaccggctgtctaagcttagggagctgcccctggggaagaggagccctgtcaactgcacccggaatgatggcctttcttcctgttcttcctcgttagtttcttcccacttctctaggatgacagagaggccccccttctcggttttctcagatagcatgccatttgctgtctcaaatctataaagagctgttgggaagtttctgtttttctttctttctttctttctttctttctttctttctttctttctttctttctttctttcttttttctctttctttctttcaaaaaagttcaattctcctaggtggctcacctgggcttttaataatgtttggctccattttaaacccctggctctgagtgtgctgctaagaatctattcctataggcgtttggtcattgcagggttaagaaaatttgagccgttcctttcctgcctatgttggggtgctgggtactgacagtaagagtgtccaggatgagggaatgcatgtttccagtgactcctgaagttttattcacctgttagggctttccatcccaattttcatccctttttgacaattcttggtaaaagctttgcaagtatggagctaatcaaaggatttctggctcccaacttgtctgctctttgttttgtttttgctttggttttttgcttctctggggtatgggtcttcatcttgtttgttatggcaagaattccctttagtgactagtgttgggagttgttagacccattgaacagatgaaaataaaaggggtctctagatctgggatcctggcactgagtgaagttttccttcagcgtatttcaaacacgtgcaagatcttcctccttccctgagacacttacctctcctttagttctcaggtgttggatcatgtcctctagaaaacttttccctatttaatcccatgtatttttaacccactaacataatccccaatgtttccatgtctttagttaatgcttgtaatatctatgtatttaagggcttaatcatgggcggttagatttttaacttctggttcggactaatacatcttttccagtgcatgggtacagatctcagtagcacacatggaacatttgctaactccgtggttgactcattcaagccctcccacgagtcagattacccagtcagccagtaaatgttggaggactcctgcacttcctcgtgggcttttctctcttctccatttacatttttctctcaaggttttgcatgaaactccaaggctttaaataccattgagatacagatgattttttaaattataaatccagtcttgacctatcccttgggctaaagatttgtagagtcaactgtcttcctaaatctttttttggaggtctaataattaccgaaaactgtaacatgtacaaaacagacttgtagcccccaccctgcacatctgtctctctcccagtcttcagcatgtcagtgcattgcagcaccatccaccccgttgctcaagctcatgcctcagtctcccctgactcttcccattccttctcccagcacattccacacaccagcatgtcctgttggctcttgtttcaagatacatccagaatctgttcacttctctgcactgccactgttccagtccaagcctccatcaactcttgcctgagcttctgtattagtcttcccaactggtctccctgcttctctccttgccacctaaaatctatgccccacatagcaggcataatgattttaaaaaatcagcatttgaccaaatcgaatggctgttcataataaaaactatcaaataactaggaattgaagagaatttcactaacttaatataaagagtataagaaaaacctagagttaacatcatacttaatggtaagagactgaatgcttttgtcctaagattggaacaaggtgagaatatctgttctcaccacccctattgaccactgtactggaagtcctagcttagtgcaataagataagtaaaagaaataaaaagtgtggagacttggaaggaagaaataaaactgtctttattctcgggtaacataattatctacataaaaaacccaaagaatctgtaagaaaacacctagtaagtcaatatagcaagattgtaggatacaaggtgaataaacagaagttaattttttcaatagaaagttggaatcgtggtaagctgcctaccttgccccacccttgggggctacattttagcttttactgaatggaatgaagaaagataaatacaaatttgtgtctttaacgaagaaaaaattaactgctttcctccataccaaaaataatctcaggaagtgattttgtagatacaacaaacttaatgtaaattttgtatagaatggcgaaggacctagaacagtcaccacaatactaaataagaaataagttggaggactcatactacctgatttcaagacttactataatataaagccacagtaatcaagacagtataatactggtgaaggaatacacaaatagatcagtggaacaggatagagagcccagaaatagacccacacaaataaagggacagtgttttcaacaaatggtggaggaacaattggccatctatattagaaacagagactagacacagatcttacatccttcataaaaaattgcttaaaatgaattatacacctagatataaaacatgaaacaataaaacttccagaagaaaacactggagaaaatctatggccttagattggtgatgagtttttctccttttttttttttttttgagtcgaggtcttgctgcactgcccacaccactcttgaactcctgagctcaaaaaatccccctgcctcagcctcctgagtagctgagattacgggcatgagccaccatgcctggttggtgatgagtttttagatattacaccaaatgcatgatccataaaacaaaaaattgaaaattttggctttattaaaattaaaaacttttgctctgctgaagacattcttaacatgtgaaaaagacaagtcattgaccaggagaaaatatttgtaaatcacatatcagataaaacacttgcatctaaaatataccaagaatcctgaaaactcaacagtaagaaagcaaatggtccaacttaaaaaatgggcaagagatctgaacagacacttcaccaaagaagatacacagatggcaaagaaacatatcaaaagatgatctatagcatctgtcattagggaaatgcaaattaaaattacaacatacctctacacacctcttagcatggctaaaatccagaaaagctgacaatactggcaaggatatggagcaacaggagctctcattcattgctgctgggaatgcaaagtggtacagccactttggaaaatagttttgagagtttcttaccatgctaaacatagttttaccacatgatcaagtaactgcagtcctagatatttacccagctgatttgaaaacttacgtgcacacaaaaacctccacgagaaggtttatagtacctttacttgcaatcatcaaaactggaagcaacaaagatgttctccagtaggtgaatgggttaataaacttgggttttttaaatacacaattaagctataattaatagcatgccccatgcataatcacagagtaaaacaagaaaggcccagcccattaggtcaaacatgctgagtgttgtggaacagcaaaaatctatttctaaagacttgaacagtagctggaaacataaaagttcagattattggctcagttggacttgattatatgagactagtgtgtatataaagaccctaaagttgggagggtatgtttaagagatacatgaaaccagcaggacagggtggtgctgacatcactttactacaaataaagttgttataaatccatatagtgggatactattcggcaataaaaagaaatgagctatcaggcgacaacatggatgtatcttagatacatattgctaagtgaaagaagccagtctgaaaaaacatattgaatgattccatttatatgacacttgaaaaggcaaaactatagaaaaagagcagtagttgccaggggcgtgggcagaggagagggttgaatagatgaagcacaggggatgtttttaaggccgtgaaaatattctgtacaatactgtaatggtggtagggtataataaaaatatacatattggatctttgtccttggttcccagcatggagctgggaggatacaaagaataataccaacagctctgagagtacatagggaatttgctatctagtcaggtacgtgttacagtgtctcttttcttctatgtccagtgagttcctcccttacttgttaaggacctaaactaacaatctagttaattaaccaaccaattccctcactcgtatttgcattagtgtttcaattgctttgcgttaaccttaagtttcaaaatttcttaagccggttttcagtaatctgcccttcatcaaattatagaaagtagcataacaaataggcttgagtttcctcatctcctggccctcctccgtctctggggaaaatattaaagacagaaatggtcccccagtgtagagctggagccaggaagcaggaatacagttgagggctaggataaccaaatgaaaagcagagctgggtgttgggcaaattggttgtattccgcgaatgcagacagctacacctgcaaagacgcaggaatgcagatgatcagataaaccaagttcaaagaaatgaggccacacttggctcgaaagagcggagaggttggtgggtcagtgagataattgtgctgcttgttcagaatctgaaccagtcccgtctgttatctggtcaggacaggtggcttgcaggcagagtttgggctcaggcaggtggcaccaagaggaaaatttatggatagacctttaactctggtcactttggagcccagcagctctggaaattggatccagatggatagtattttgatagcttctcctaaccaaggaatttatgctgattttcaggacccaaggggaaggaggaagctcctaaaggcaaggaattcataattgcttcttaccatgtttccaaaattcatctgtgttttcactcaccaccacagtcagggctggcacagggactggggaatgaaaaataaatgagggctcagggcctcactcatcacacgtgtgccttccatgggatgtcctggagcaggacagggaggagtgtggggaatagtctcctaattcaggaaaaagtctaggttgggtctgtaagatcttcctccactgagaaatgtattaatccttgccctgctcatagaagcaatgaaagaagctctaaacaccgggatggatgttcctccctccacatttgggtttttgcgtgagttaaactactggaagggtggagggttctccctctgtacggagctcagtacaggccaggagggcccatctatgtgaacacttctctgaaaatgaagctacttctggtcatagctctgctgttaactgtgtaatatgggtaaccccttaactgcctctgggccatggtgtcttcaccggacatttgcatgagagccagaggatggccaggaccctttcaagctctcatcttcaatgctcctagaatctccgttggaaaccatttggctctgctggaatgttacagaaagaaggcaagggcaattcttcttttctcatgaatgttttgggaattctgttgcttggaagagacttcaaagactgtatcttctgcttctctgtgagattcatctccaatttatgtcacaaggagatgggattttgaaggcatactaggtgatctccatccaggttttcatagcttttgcaagcacttactgagcacctgctatgtgccagaccttgttctcataagtcctgatttcatactaagacatccagacaaagaggtagcataaacaaagggcttgagccagtaaagatgataagcaggatgaagaatactgttgctcagtccccagtcagatagagcatccaacaacagcctgcccagctactctcagaatcctgacactgtggcccagtgcccatctcctttcctaattccaagcaagaaatcatccccaatactgacattcaccaacagcccttgcactgcttggggacctacaaaaggagattcttttcatttctcttccaaatttcatggcaagggcatttggaggagttagtggagaaggatggcaggggctttgagttgtcatcttttcttaggagctaagaattttaaattgtacttaattgctggtcacagtcaatggattctaagaatctgatgtgcttaccctgcacactcccaccagtccctcagcctgggccagccataaaaacacattactggtgtctgccatttggatggctggaggagatggcgtagtgagttttatttttacctgaatagtggggagccagctgatgtggtgcacctcgtgttaaccaataagcacctgatgggatttgcctcacgtcaagaggaagaaggggctcttggctctactgggccacatcccagttcagtgtttgtggaaggcattcaccttggagcttgttgcctgccaggccccactcttagggcctcttcgatgctggggagaatgatgtcagcaccacccattcctgctggtttcatttatctcttaaacataccatcctggcattggagcctttacatgctagtctcatataatcaagcccaacagaggcaatgatctgaccttctatgtttccagctactatttatgtctttagaaatggttttctacattccatagcactcagcatgtttgacctaatgggctgggtctttcttgctttcctctgtgattatgcaccaggcatgtaattaattatggctcaattctatattttaaaagcccacaactttggactgagattacaatgaacaacatttagcattggcttacctctgctttcacgtggagctgagagatggagttaggtagtagggagtgaagtttgttatgataggattgaaacctgcaggcagcagtattagataatttttctctagctggggatctgggggtggtggagaccaagaggtcaatcaccagcatgtaatgtggggccatcccaatgcctactgtcgttgccactcccaagaacaaagagcctgcttcctggatgactgggagccaaccatggtggaagtagggagtaaaaaggaactaacagggtcagctcatgaaaggttttgtaagccaagcataggaatttgaactttattctgtaggtaaagggaagtcatttgaagcagggaaatgatcacttcagcagctgtatgggtaatggattaatgaggagagactggaagcttggaggccacttaggaggccacagcagtaatccaagcagagaagaggaagctgtttaataggcagaattgaatgaacgtgttgactgaaagatagaaggagagggaggtgttgatgactccatgcttttggtttgagaagctggatggatgatgatgttaacaccaagaataagaaatccagtaggagggagaagtttgagaaaggaagaggatgccaggtccagtttgggacatactgaatttcagatggtttggggacattcaggtgtttcattgtttggccatgtaggtctagagctctgaagagagacttcattagagattacaagcaggggtgtcatcagcatcaaggtgctagtaactatcacgggcaaagatgaaatcagctaggaaagaaagcacagaaccatcaggagggaaacactcagggccaggccgaggcagagaagcttctggagggcagagactgagaagatgctttcatagcctggagtgaagtctgtcccatctgtcctatctcagttcaggctagaattctctcctaccctggggcctctctagtcccccagggccactgggctggctctgcagttggccacactgaggctgttctttgaccagtgtttctcaaatttgcacctgcagatgttgtattgttttgttttgtttgagttggggggagatgctgcgagtcctttaaagaacctcccatagcagtctgtgaatacgtattctgaggggtctttgagttctcaagttcaggaaactcagacgtggtcctggactctccttgcctggacttgaggtaactgccttggcctccctaagccaaagatgcatctgggccccatatgcgacccagggcttcccatggcaacatgtggtgttgtttttactactgcaactttttatttttctttagagctgattttttttttttccttttgagacagagtctccctctgccatctggactggtatacagtggctcaaccacaggtcaccgcagcctcgatctcccaggctcaagcggtcgtcctgcctaaacctcccgagtagctgggactacaggcatgcaccaccacaccacgctaatttttaaaaaattttttgtagagacagggtcttgctgtgttgccagggctgatcttgaactcctgggctcaagtgatcctcccgccttggcctctcaaagattttttttttttaacagctgtattgagatacagttcacatatggcccacttaaagaatacaattcagtgatttttaatatattcgcagatttgcacaaccaccaccacagtccatttagaaccttttaaaatcaccccaaagaaaccctgtacattttagctatccccttagcctcagcctctccctccccatcacctgggttttaggcgactactaatttactttctggctaatggattaatgaggagaggctatagattcccctattctggacatttcgtataagtggaaccatagactgtaactttttaggattgcacgttcccatctgataaccgaatctccattctggagaaaggatgttggcatagtctgggtgctttgctatctattatctcctctaattctcaccacctctttggaaagccagccttatcaaccccattttagttgagagtgctgaggttcggaggtgaaatgacttgtcagaggccccagggacagtcagtggaagcacgctgaacagggaggggcacccagctctgtctggctgcattcgctgagctgtcgctgtgctaggtgctgaagcagggctgggatgggggtgtgaagacagaaaatccaccagcagctcgcacgagtgggtcctcccagaatgagtccaggggagccccctggaccaaagcaggacagagctaattccaggaacaactgcacatttgtccactggttggagtgagcctcccccttttactgcatctccacgaggcagaggaagtggcagtggcctgagccctcagatacctggtgccctgggaatgttcccaaccagatgattatggctgttgtcaccaccaagccctgtcttgtcatcagcctcagtgtcaggccctgggacccagagacacaccccgtccccaggctccagcttcatggagcttcagaatcaggccctgttacacccactgcagggaacttatcatctcattataaaggataaggcatattttttcagtatggttatacgcggtaatgaagcatgcaggaaaccacacaagatagatggcagctttcactagtgaagctgaaaacttggttaccttaatagtctatttattacattcactctctgagcttacagcacctgattaatatctcccatcttctcccttgctatacaattaaaactagtaatatgtgattgcacatgctgactccagcacagatgggtgtgtggagttgaaggccgagataagaagtgaaggggtcaggcgtggtggctcacgcctgtaatctcaccactttgggaggccgaggcgggcagatcacgaggtcaggagattgagaccaccctggctaacatggtgaaaccctgtctctactaaaaatacaaaaaattagccaggcatggtggcaggcgcctgtagtcccagctactcagaaggctgaggcaggagaatggcgtgaacctgggagacggagcttacagtgagccgagattgtgccactgcacaccagcctgggcgatagagcaagactctgtctcaaaaaaaaaaaaaaaaaaaaaaaaaaagaagtggagaaggaatgttcttcctgggtcatgatagaggagtcagatcccttgctggtaagggagtgatcttacagaattaattacactcgaggagaaaaggaccctatgtccactgcccagtctcacccattgccgtggcttctggcaggggagtggtgaagcctgcacagagagaggatatcagtggaggtggccatacggcctttaatcagcaaaaggaaagatggctggactttaactcatttgcttggatgagaatgtttgaggttgaattcgattacaatgatgtagctactcaaaagccgctcccaacttcctgctcccctgcccacctgctcctgaagagctgagcatttggccaagttctgaccaatgagatgtaaggagaactctgctgaggggtttctgggagagatgctttgctttttgacaaaatggcaagtcacattatgagaacttgctggtgctgccctctgccccttcttcctgaatgtggatgtgatgactgagtttgggctgccatcttgtgagcatgaggatgaaaacgtaacatgccatggatggtggagaatcaccagggagagcctaggttcatgattacatcacccagctgacagcccaaccctggggtcatctacttctggaccttttgttaagcaaacaatatatagccttgtggttgaagccacagttagaagggcattatgttccttgcagctgagaaacatacctacataatctaaatggctccatttattgagcagcatatgcgtgtcctttgctaagtgctttgtgttcattttgaagcttcaaaacatgttccctttaagggagctactatgacctctgttttataaaggaggacacgagttttaagtgtataaggtcacacacctattccaggaaagagcagagctaagatttgaatccaagtctttctgactagagagttattactattaatcataatattgtgactttgtagacagttcatctcaacactgaactctgggaatgagtgttacttaaagtctggttggcataatagtactcagtataaatcacgaagtttttccacatgacccactaaaataaggtgaaattcagtcttattggtgattgaaaattgcatattttttacctgcctcaacccactccaaatagccggggttgaaattagtttagctaacctaacttgccccagccaattggatggccaaaaagtgaaatgtgtatgaagggaaaaggtcccagagagagaatttgagttaaaagaccaccagtccgagcctgtgtgcagcccatctcatagcttttgagtacaaagcaggaagcctctccttccgtggcatttgaagactcagagcaaggttaagatggctttgaaacctgggtctggttctcccagaaacacttctgttgcttctcctcattaaagaaaacattccaagtgtgcaattgttctctgagatgaatttctcaaaacacatgtgaactacttgagactattctaattcctggaggtgcctagtcagtgctggccatataacagatgctcagtaaagatcggttgctttcatgaccagtgagggcaacagaaaaaacaaaagatctcttaatgaatatgattcatcctcctagcctcagtgaaaaggcaaaaaataggctgctttcttggaaacgtgccagctaatggtacttagcatgcaagggaccgcgtactgatccatacccattagcccaatgctcatcaactcttctactggagatatatatatatatatatacacatagccagcagccaacagagggacttggccacatgctgattctctctcccctcccagtccatcagaccattattcagcaggaggtagtagggtcttcccctccctcttatgccctttagggcaggagctatctagagagggaaaaaaagtcagaataaacatatgcaaggactggggtttaaacatcccatgaagattaacttatctggagtaattgccttaactaggggatttttaatgcttttcaaagttttttagaggaagaaaaatatgcagaatgagtcttaaagcagccaacagaggagatacttagagcaaaaaaaaaaaaaagatatcaaccataagaagcccatagctaggaaattttaaggcactgattctaggggatttaataagaatgtaatttgtataattaaccattcatcaatgtcaatttcattaaatgaatgccagaaatattaccttcagcagcacgacctaacaggattgaatatattatatgaaaaatgaacacttagtggtttcccccactgctctgtctgtcacagcaagatttgcaaggctgagaaataatttaaagggtagtaaatgaaaccggctaaggcaaatgtgtgcattttggtaactaacctccgtcatgatgtatgagagttcatgtcaaaatgttttcctgcagcaatgactaaagggacttgtagctctctcccaggtggcaaaatgtgagaaataatgccaggaacttcccaaaggtcccccttgtcactcgcctggatacagcttactctttccctagataggctgcctagggtctaagaccagaagccatgtgtttttgtgtccagaatttgtagaccttcccttcatacctccaggttagccttacatccaatcacttgcctacctgtccaggaaaagtgatgattgatgtgcaggagacagaaatcattctgagttttatttatgttattgcctacagtcatcaggggagcacgaagcttgaggtaggtgggctgatgaaatatatgtaaataggacttatttccaaggttgctcatgagggaggcagtttatggagggaggcagtttatggggatttatccatttcagtgcatcataggaaaagtggaggacttgggagcgggggctgtagtaacttgtccatgtgtgtgctcctgggaatgtatatacagacacacacacacacacaccagatcaagcacacactggagatcagtgcttgagatttgcaaattgttgtcactggagttggcctggtgcctcgtgtatagtaggtgatcaataaacatttgtttaattgaatttctcttagtgttaactccactcccattctcttctgtttcagggttctatgaggctgaaaatattggatcagtattcctgaggaatctgcgtttcagaatcccaggtccggaaggacaagaagtactttgcaaacaaatcaaatgtacgtttaggaagatgaaatcatgcaacagaaagatttttcagaatttttcagcaacagattttacacacaattcagaaggaagaaagaacagatgagtttgggaatcaggagaccagatgtcaagactggactacatctttatattcatttccagatttaaagttctatgttgtattttatttgatgcaaagcaataaaatattcctccctcctgtgaccaccgaaaaggtcatatttaggacctgggtgaaggaagagtgggcatcacagagctgctgtggagtgtgtgcacagattctgtgtactaggtctgtgggctctgcaagactcaaaatcaattgctgaaacacttcttaaatgtgttccctcctatgcattctgctatgcatagtcgccctctcttccttctaggttagagtgggtgacactgagcatgtaacttaacctctctgaagcacagtttcctcatctgcaaaatgaggatgataatatcctcctcccagtgttgctgggaggatgaagtgagatgaatctggtgatactgagtaggtgtgcaatcaatatttgttttttcctgccactcctttaccaggctttttttcacctcaaatgagtgatgacctctgagtgcggagcttttttgtcaattttttaaagacagtggtccccagcatttttggcaccagggacaggtttcatggatggcaatttttccatggacctgggtagggggtggtttctggatgaaactgttccatcatagatcttcaggcactagttagattctcataagagacacagcacacagcctagatccatcacatgcgcagttcacaacagggctggtgctcctaggagaatctaacgcctctgctgatctgacaggaggcagagttcgggcggcaatgttcactcacctgccgctcacctcctgctgtgtagtctggttcctaacaggctgaggaccggtaccccggggctggggatccctgttctatgaggatagaaaatctggtaaagtaattcaccctaagatgccattaaattactatgacctcctgggctcaagcaatcctcgcacctcagcctcccaagtagctaggacttcaggcatgcactactatgcctgggtaacttttttgatttttattagagatgaggtctcaccatgttgcctaggctggttttgaccccctgaactccagtgatcttaccgcctcagccttccaaagtgttgcaattacaagcgtgagccacagcaccgggttactttgttactctttaggggtattggaaatattaagaaaatacagcagggagagattgatttttaggatttaagaagaacaagaatagttttgggagttctgggagctacttccaagggcatgaaccaaatctggaaagtagagttggggttgtgaaatattagaacgtgtggatagtctgatggtttgcaagtaagtgggatcgaccgtggggtctctggacagctccccagagggccgtggtccacaaagggaaacactgtcccatccaactctgagaaatgggtctgggcatccactgctttcaccgagggtctctgcatgactttaggaaagtcactagacttctttaaccatttctttcttatctgcaaaatgggaagagtaagggcacccatcttggaggagatttggcacgtgatgctcagcacattgcctgacaatactaagtgttcaaccaatgctcatgattggccagggcattgacggcagaatcgtaaggatcacagagacctcaggaacatggctctgaaggatagaagctgaaaatcagtgtgctgatatcaccccttttgtctatgaggagtgaatgtctccaattaggctgcattcagcaggcctggcagcctcctctctcttgggatgcaaactgcttatgtggtagaaacaggaagccgtcttgaaaccctcgccaggccccagacgcgcgtgggtccacctaccgtccatctaccggggtcactgagtcactcctgcccaggtcccccttcagggactgtcgtgggctgtggcctcagaggtcccttacagggtggtgggacccagggcccagggtttggctccgggtttttgggcagctccgccttcataccgaaggcagcttagcatggcactgtctgatctgctgacagccgcgaccctgccacctgctcagtgggatggcatcttgggggagcaccttgggcagggctgcccagagccctggaactggactctccctgtgcagggctgatgggaaggaggtgtgtgcaatatggtgggaggagccgggctggaggctgcagactctgcctctgtgcccgttctgggaaagcccctgggcttgctggacccatttctgcccttctgaaagcgggagttagactagattggggctttcaacattgctgatattttgaacagcagaatccttatcacaaagccaatggaaacaaagaagtgatacattaaaaacacatcgaagcaaaacctcctggttgaactggcttccctgcccctccaaagtggttccaaggtgcctccacaaagcctcagggctctgagggtgttagggaaaccacaggtgtccacaatgcctgccatgctatgatttcatctggccgatgtgtcacttcagtattctgatgaatttaccctaccaggccagtcagaatcgactcactgatgatcaaaaaagagaggacacttagaattaaattcatttctttgggccagtctcctttgtctgcacttgctgagaaggcatttatgatgccagtgtgacttatagttatcctggtaggtactgaagcttgtaaaggccacctaatcactttgctttggtattcattagtcatttaacacctctaaagaaaggaaaggtgcggcaggttgcgtgtgcgggaggggagaggtagtgttggcttggaccacagcgggagggacctgggaagagggagaagttgatggtctggtcactaatggtcctcagcaggacaggcttctttgtccttgtctcccccctcccttttgtcctcttctctcttcctctctccctcatttctggcttccctctttttctccttcctcttctcctcctctaatatggaaggaacgttagacacacattcctgtagatgctggagtggaaaggcaggttggaggaaatacaaagatgaaggacatagtcaatctcttcaaggaggtcatggccaagtgtgcaaggggacctcgaagaagcccagtgtgacaaggattgagaggtgtgctcaagatgtgctgagagcagaggatagccccagctctgctctggggagtcaggggcagggcggcagatgcttggggtcacatgaacacacaattgagcaacaaaacatagtcacacagggcctgcctcacacccagcactgggtgggttttgtgcaggagaacttcttgcaggagacttggagacagaaattctttgggaaggagatggggtagctgccttaccagagagagcgggatttctcagacactgctaacttcccacctccacacaagctgatgagactggctcagaaaaggggtctgcccccagtgcataataatagcagtgataattaataatctatagttaatgagattaaattaattattattttaattatgacatgttttcctcctctctttcccctgccagggcaggcttggcacttcccaggattacagtcataatggtaacagataaaccttaattaaaacattccaaaataccatggctgagttaaagtgctgtgacacgtcgtttccatctcattttgagatcttgcctatgacggcaaatgtctccccaccgtcggcagcatcttggccattcagagctgttgccctcacagcattcagtgatgtttgccagagtggctccacgccccttgggggcagatggccgacccactggatcggggccactggagactttttccctcatgctgggctcttcacgtggcatcctgtgcctgctcaatgctgaatctgcttcccatgtgcacagcttactcctttgctccacccggctctgcctctgttcccttcacctgcttcttctcaggccaaggtagacctgaggaaaggattgaaaggattgtctactctggctctgtgggcactgttcctgaggtgtgagcaaaccctgcctcagatggcccccgagtccatcagcagctccttccctgtggtccgagttactggcagggtctctgcgttctgcctttgtgttgagcttctcctccacagcccacccacctgcaggggctttctcacgtgtggcgcgggtgtggaggcaggtctccatggattgtacggctttcccaaggcctgctccagactggtggcctttttatggaggttagcattcttttgttagtccactcacatattttcactcattactaaacatttatggaccattctaggaactgtgcttggtgatgagctgcagagacagaagacaccatcctatttttataagccttgtgggtctgtggaagagaatggaagatacacaaaggaagggagtcccaagctgaatgttctgatagggtcagtgctggccactgagcggggagggtggggagggactgtgcgttcctgcgcatgttaccctacactgaattttatttttttattattttattttaattttgagacagagtctcactgtgtggcacaggctggagtgcagtggcgtgatcttggctcactgcaacctcggcctctccagttcaagcagttctcctgcctcagcctcccaagtagctgggattataagtgtctgctcccacccctggctaatttctgtatttttagtagagatggggcttcgcatgttggccaggctggtctcgaactcctgacctcaagtgattcacccaccttggcctcccaaagtgccaggattacaggtgtgagccaccatgcctggatcctacactgaattttgaaacataagaaggagttatccagatgataagaggggaaggaaggtcacattgagaagagtcaaattcagaaggcctgacagagatgacatccctggaactgcagtagaggagtatggctagaaggcaggacaatgaggatgacaggccagaggtgaggttgcaagtgtggttggggccaagaccacaacacgtgttcaaggtatgtctaagaaggctcaagttcatgaatgggtgcatcaaagaaccacaccccagaaataagctaagtaacacctgcaacactgtcatcaaacgtgctgagccctgccttgcgccaggcagtgagctagtccttattttcacacctggctttcttgcctaagcaaattcagagtcaccctaacttgggtcatttgcatcacaaaattgccttcaaattagcacagagagggaaaaatcaacgcatacctcccaacataacatccccaaatttacctagcccagagttttaaaaaatttatatttttaaccttgatacccaagaaagcaggaaatctcacccagctggaagctctcctgtaaagaattcacaaaaatccacaccaaaacctctagatattcccatggagctgctagttctggaaacactatgggggaaattgcagggttttctattagtttgaaggaggtctacttcctaagacattcttctgctaccatctcttgcatgctcagttcattgattgatagagtaaatcattgatatttttccccattgcttcattcaacaaatttacattgcactctcctacatgccaggcattgttttggatgctggggatacaaagataagtgctctgaggcccctattctcagagtgctcagtccagtgagaaactagaaaagtctgcaggtaatgacaggcaaagagagatgcggtgaaatggccatgggagcacagccttgaagagacgcctgtgcaaggcacaggctccactgccagcgagggagaaagccctcctaggcccgaagcagcaaaagaaagcatctagaaaaaggaaataaagggctgtaggtgtatcaaaggtattccagtgccagttaaatttgagagagaaatcattttatttacgaaaatgtcaaggggaagaagatgcataacttctttaggaacgactcctgcctctgctagtatgtcaattccgagaggcctaaaataatttgggcttgaagatggatggaggtggagagcttggccttattgccaacactgtaaattagcagtaccaagagcagcctgtcccacttctggtctctggctacctcttcacccagctctggccacagtcaggtgatctctgatgagtgcattcaatcaccttccttttccatttggaacatgattgtgtgcatgctgtacataagcgatattgattgcaaataagttgttgactggaagacatgcctctgtggacatgtttgggtgggggatagaggggaaataaaattaaaaagagagtaagaaaacacctgtggcccccagttggaaacttctcaaatatttgaagctaacaatgttttggttgcctatttcttttttcttttttttctaggagctaaacgtcaatattgcatttattgctgaacaaactaaaatcataacaaatataataaaaggagagagttagcctcagctttctgcagagaatgattggcacttttgagccctggattggttgggcctttatcttagctgcgtcagctcataattaaacaataaaaggaggaattgttacttgcttggaatatatacagtcagttttctgtaaggtgggggcagtgtgtattttataagccctgttgctgtcccagttttctgtaagaagggaaatgtgggtattttataaactctcttcttgtctctgtcagttctaaaagactgagagatgacatgatagctgtcacaagaaatttctgcttaataacaatgaacactcagagctctttaggccctgaagaggaatgggaagatgatgagggaggaggaaataaaagcaagaaaatggtaggacaggaagattttttttttccgctctcaatcttgtctttgtttggctgaccatagagcagctatgtagaactatgtgtgtgtgtgtaagggggagagaagagagagagagagagagagagagagagagagagagagagtattgtaataacgtattgagcatgagctgcctgatctttgccaggtgataaactggcccactgtgatcttgcaggaaacatcaacagtctgagaattgttgtttcaggaactagaaagaatcctggaaatagttaagaaagacgattttccaatggccaataccttctcccagtggcttgtgagattaagatttggtattggaatttgtcccatctcgacttggaagaatgagacaccttggaagatgaggctgaccaggccatggagctgcccagaccccctgggagcccagagtccccatccttgcatctcatgatctatcatttaacagccctgtccaaagtgcttgctggagatcacagggctaggccacttctgctccttgcaagctccaaagaggaggtctcctatgcacccgaggaggatgagtcttcagagtttccagctgccttcttgtcacctggctctaccttaccttgacactcccaagtgtagacatgcctgattattctatccaaacccagccaggagatgggaagagacatcttgttagccagttgctctggtagcctgcattgcaagggcctggcttttacgcagtttcgcttcaagtcagtgcaactagctacctgtcttcctgtcacttttctttggccacctgggtctcagcagaggccctcccaagactgacaggttagcacggaaggtataatctgctagtcagatttcacatggctgcacagagaatcggtgcccttggcaggtaagtgaataaatatgggaagacatttgctattaactgcaaatggcaagcagcatcttagaaagctagttagtgaaacagggatgggagtgtgagagttgatgcttcttttagaccctatttgtctcccggcctcacactgccttcctcttgctcagactttccctcttgcagtatctcctaagtcactggaggaggcccgagaagaaagccacgacccccatttgtgtgactgagatgttttcccagcgtcagtctctcaacctccccagtttcagctgcactacttcagaatgggacctctcctggctttatctgtagtgcggactatgtgtaagatcactggcagtgagtgtttatgcgccttaattcatgtatgtgctgatagcttataccccatctctgtattctccatcagaaacccacaccccagcagggaaattctttgaagcctaaatacttaaccatttctttggctccagggaatgtttgaaagaaattagttctaagcaggggttttttttttttttcccattagtttcagagcagttttagggcaagaaaaataatcccccttccctcagtggatggataatgatgggaagtcacctcccttcccctgggattaacctagaagggctctggttgggaaaatgttacctggttctttggggaaggatgacggttttgtgccttatgttttggggttttctgggtgtccctaggtaaccatctgtgagagcatcttgggcttggagtttttgtcactgtgaacaccttctgtggactcaggtgaattctccagttggcaaaagagggaatgcaggcttcgctgactaatccctgaaccagctaaggacaaggccttagaaagtttcgtctacaataaagaagcttttatctgatgtcgaggaatctttaccagtagctgctgtcgtgaatacaagtgcacctttatggcccacagtaagcactgggggattttctgtgaaatccttgtcatttcttttacccattttcctaggaagtgagttgtgctcttgtatatgctcttcacactgtgcgaagtcagttacgtgtgtggcaaagaacttgccttggtttctaacttgttttacactttctttgcagtgtcttgatgaacagaagttcttatttggattaaagaaacacatatggtcaataaacatatgatgggatgttcaacctcattaatgatcagggaaatgcatatcaagggcacaagagataccaatctcacccactcggctgttaagagtatggaagtatgacaatatcgggtgttggagggagtgtggatctgcagaaggttttgtgcagtgctgatgggaaggagaaattgtacagccactttgtcatgatctcgtaaagttgatcattcaaatgctccatcatccatcaatcccactcttaggaagtcagacaagggcaactctctctcacgtataccagcagacatgtatgagaacggtcatttcagcactatttatataaagcaaaacttgggggcaatacaaatgttctctgacaggagactggatcaatatattgtggtgtgcctatttaatggaataataaacctcagtcaaaatgaatgaacaatagtcccatgcaacaatatgaattagttttagcagcagaattcaagtgcaaaaagtctcagaagaatgcatattgcatgataccctttgtagacggttaaaataaatccaaactgaaaattcttctttttttaaaaaaaatatatgtagcagtagtaaaactttgtttgaaaaaagggaaagcaagtcaatgatgaacataagattcgagaaagtgcttagttactttgggtagaggaagagaaaggatgcattgaagattgatgttgctactctagttttcttgtttgtttggtaatttaaagaatgtttattatagtactgaagagaaatacataaatacagcaataaaaaatcaaataaccagatttaaaaaaaatgggaaaaggacttgaatagacatttctccaaagatgatttacaaatggccaagaagcatatggaaagatgttaaacatcactaatcatcagagatttgcaaatcgaaatgatagtgaggtatcacctcacacccattacgatagccactatagagaaaagccagaatatagcaaatgtcggtaagagcgtggagaaattgggacccttgtgcactgttggtggtgttgtaaaatggtgcaactgctatggataacacaatgaaggttccttaaaaaattaaaaataggaccaccatctgatgcagcagttccacttctgagtagacatccagaaacattaaaagcagggtgtcgattcgcacacccacgttcacagccacactattcacaataaatagctaagaggtggaaataggctgggcacggtggttcaggcctgtaatcctagcactttcggaagccaaggcaggaagatcacttgaggtcaggagttcgagaccagtctggccaacatggagaaaccctgcgtctattaaaaatacaaaaattagctgggtgtggtggcacacacctgtagtctcagctcctcaggaggctgaggcaggaggatcacttgaacccatgaggcggaggttgcagtgagctaagactgcaccaatgcactccagcctgggtgacagaccaagactctgtctcaaaaaaaaaaaaaaaaaaaaaaaaaaaaggaggtggaaacaacccaagtattcatcaatgatgaatggataaacaaaatatagcatatacatacaatggaatattcttcagctttaaaaaggaaggaaaaccttccatatgctacaacatagatgaaccttgaagacattacgctaagtgaaacaagccagtcacaaaaggacaaatattgtatgacttcacatctatgagggtctaacatggtcagattcatagaaaaaacagaaagtaggatgttgattactagggacaggtgacccctccttggatctacccgctttgcaatgtgactctgcagctcttcccaccaacaggtggagactgctttcccatcccttggatctgagctggcctggtgacttgctttggcccatagcctgtggtggaagcgaggctgtgctggtgctgagccaagacctcaagaagcttgcatgctcctgctcacgcccttggaaaacagacatgtgaggccatcctagaccagccaccctctaggtgaccctccaggtgactgcagatagatgagtgagtgcagttaaattcagctgtgctgggccaggcactgtggctcacgcctgtaatcccagtactttgggaggcgaaggcaggcagactgcctgagatcaggagtttgagaccagcctgggcaacacagcgaaaccctgtctccagtaaaatacaaaaaaaattagccgggcgtggtggcgcgcacctgtaatcccagctactcaggaggctgaggcaggagaattgtttgaacctgggaggtagatgttgcagtgagctgagattgcgccattgtactccagcctgggtgacagagtgagactctgtctcaaacacaaacaaacaaacaaacaaaaaaacaacaaaaaaactggctatcaggagatgaagaatgcatctgaaagtcaacaaggagagaaagagactctgccggcatgccgtaaaagcgtgcaagtcatggcaggggaacacataagtgtgttacatctgtatgcacatgcatgtgagtgcctgtgaccacacacacacacacacacacacacccatagtcagaggaagcctcaaatcaggctgagtttccgaagggaaaatctcatttgtccaccagtgatagcgtatgtagccttctacattaatgtaaattgaggcaggattaccttctagtgataaagtcgcatctggtagcagagaaaaagtgagtggaaacggacacatttccaatcaggctctggcctgggctgcagccccactccgctgaacacctagatacacctttttaaaacccaggatccttcgggctcagcctcctagtccttgccccttccccagatcccacccctgtctgcccaccttgtcttctcgggccctcaaaacttaagccagaagtctgggcaggccagtagaggaaggagctggggcccaggcagccacaggttgaagaggcggagggaagcggcacagctcacagtcacactaggacaacttggaagttgaattggcaagttgcagcaggagatgggagcatgggctccatccctaagggagccacattcgttttttttcctttcaaagtcgtcaggcagtaaaagaaaattgcagggatggggaaataatgaaaaaggctctttgtttttcccccagtccgaactcctagctcatcaaaccttggaaatgctcactgcaaatggttgttcttgttttattgcttatttatgggaatctatttaaagtgaattgcacttttccattgtatcctagtgagcgtgcaccggagttgtgtctcccctggctgtggggctgtctggactggggattctgtctgattgtgtcagcatcacgctccgtgacatttaaaagtggggaaggaaaatactgcagaggaagcagggcgagcgtggagaatgattgctcaggcctccatcagctccaggcgggtgtggggaatgctgttctagggcaggtttgggggtgctgactaggccttcacacaaagaggaatctgctcttgtggatgaatgaatggcggtgacaaatcaaactttaatctggctctgctgtaagcattgtgaccttagggcaggtactgacttctatgagccaccttttttaaaaaaaattctctacagagaggtgaatactgggctgttgttaataatgatgatggaattcattatatatatgagagtgcttactcagtatcaggtagatgctcactaaatgtaaaactcccttataagggtggctggaatggggactggaagagacaggtaagtccccaacctatcttcattttcttaacctatgccttttgactcaaaaagaatgaaggctccctcactcctttgctttgattgggagatgagatgcgagtctcaatgcctagaatgctctatagcaggggtcagcaaactggctgaatcgggctgctgttctggtagctaaagcattatgggaacccatccctcacccccttctgtctgcgagccatctatgacagctttcctgctacagcggcagagcaggatagctatgaaagagaccgtggggcccacaaagccgaaagtatttactttttggccctttacagaaaaagtttgccaatccctgctctaattcattggtattttggggttctcttatctgtgtgatcagaaggtctgagcctcagagaaaggaagcagcaacttgtccaagatcacaaagttagtgtttgagttagaactgcaatcaggtttcccaattcctggcccagtgcttttccattgtttaactgtaccatttcacagagatcccaaagccattgggattagctttaccaaaaaaaaaaaaaaaaaaaaaaaaagagtctctaagtcacgtggcatctgagctccatgtgattggtaaagttggcattagtccctgccacatttcccaagtccccaccttctctgctcaccacaccgctgtctctccaggctcagcaaatacttctagagacaccggtgtgtccttgtcctgaaacctttgtgagtcagctgcattgactcctgctccaggatgacgagggccaattccttgatgaagggccatctgcctgtgtctggctgcctgtctgtgagctttcgtgtcttgggggctctgctgcattgcaagaaggagctgggacagagctctgagagaggggaaggaggcagggagagggagtttgattcctgaagaatcttccttttcccatgaagacaagcaagctgatggccagcgtagagccacagcctggaaaactttatttttaaatttatttttggtggggaaagagttgggttagctctaatttacggcaacctccccagttccctgacactgctgcctcctcatatgctttgctaagaaaacctggatgagtcgggcgaggtggcttatgcctgtaatcccagcactttgggaggctgaggcgggtggattacctgaggtcaggagttcaagaccagcctgaccaacatggtgaaaccccatctctactaaaaatacaaaaaaaattagcctgacatggtgacacgtgcctgtagtcccagctacttgggaggctgaggtatgagaattgcttgaacctgagtggcagaggttgcagtgagccaacatcccgccactccactccagcctgggccactgagcgagactctatctcaattaaaaaaaaaaaaaaaagcctggatggcctagtgcttccttattgcttaattaacccttctccctttctttgacccttctcctccttggttgccttgtgtggttgatggtgacatcatccatccaatttcttatcctgtaacttccaagttacccttaactcctgcctttgcccaatccccagccttctatgagataccacatgcagcctgcaaactcccacagctgtacgcaggcatgtggcctcttgcctcgacatctggccccaccgtccaacccacctttcagcctccaggcaggtcctcacctctgccatcctccacgtgatccccaaacgttgctgatcaacacaccacagctggaatccacagaggcgccacagtaccgaaagggtggctcaaaccacatcgcatggctcataaggcccttggcgagttgacatcaggctccctctctcccaaagccacaccgtcttcctgcaggcaccgccagtggacacaccgaacacccctcttgtccaaacacactgcagctccctacatacaaagggcaggagctagactgtggaatgaggttgactagcgcttacatccagacactactgtaccacttgctttccgggcagattatcttccctttctgagtctcagtttcttcatctgtattaatggagatgacctaagagctgccctgaggattaagtggtataatgcacttaaacatgacaaaaaaaatgcactaaataagtgtcatctccttcctttccagcctctgcctgcacaaacccactgttctttcgctcagggtgctctgccctgcgactcagcctccttcgggctgcggcttagcatgttcccctcagcctccttgcaaatgaaggcttagtcacttcctccgctggtcccccagacctgtgttcacctggctcacagccctccttaattacaattgtaattgtttatgtgcttgtttatgcgggagatgacaggactacaagaaggcgggacttcctctattgccctaggccctggggtgaactgcagccagcactggccttgccggctcactgcacagggtgggcacttagtccctgacttggacaagccactcaacccctaggaacctgttttcttatctagaacatgagggtaatagttcccagttgccaaagcttttcccacagaccctgactcagaggagatattcaatgaatgctggttctactctacctttccagggctaagtcctacgactgtgacacaactgatgctcagtggctctttgtttaatgaatgaatacatgaatagtgattagagatgaggccccaggacctatagctttagatccaaaagaggtcagaagatttagaccaaccctaataacctgaactcatgtaaaagtggctctttcctcccagtccaaaccacaaatcctaaatgctcattcagcctcacttgccggggactcagcttctcccggggcctccgggtgggtcccatgattgctctgatcacctccctattattggatattaatcaagtcctactcagaccacaaacaagcagccctgctcttgacagtcatctgaggatctttgttggtgatgaggagagtgggaggaagggagagtgaaggaagaagagagggaaagtgatgagaagagagagccagggaggctcagagactgagcaagtgccaagaagggaagatgacaacgctggtgaagtctgaacaaatgcaaagtcaagcacaataataatttgggcaaaatggcaaatggcacagctgaggaggaaatagcattgtgaatgtaaaaactcctaaatggagcgcagatgggagggaaaagtgtaatcttctggaaaagcctctaattgtctgcccacactaataatttcagcaaacgctccctctctccctcctgcgtataattacaccattccatctgtctatcagcaggttttttactgtgccttactgctaccacgttctcatgctcacggagagatgaggggtttttgaagatttaagaatccttctgacacatatcctgaagaaaaaacactcaggcagacaaatccctctcccaggcctgctaagactctattttaaaaagttgtataatctctccaaacgctattatgaagtccaaaggaggcagggccacatggaccctccaccttgggtgttctcatctgccggcttgtcttagtaggtcagctctggagagacgacaggtcaggggctgcagggagaaaggggctggcagagacaccggcccgtgcatcccgcaggtggcaagtcataagagcatctgctcagggctatccctttagagtgtcttaggtgtcaaggccagggttctgctgcgtgaggaggaagaggaatgcaaatgaaagagaagaagccagccgggagtggtgggggagtgtctgtggccatgtattagctcagctcagctggcctgaggagcgctgcccagcgcccaaatccagggctctgagtgactccaactgccattggcttctctccctgctctggcagtgagttccagagaagacaggtggcctcgtgcacagagcccagtaggaaaggctccaggtttcccacccaagtcactgcccttcgtgcaggaggtacagagcttcccatttgcttgctccacgggcaggagctgcgatcttaaggggctgggagctgcctgcaggttcttcatcaggaagttttcttttcatgtgaaaaatcacatcccagctcttctccctttcctttccaataagtgggtcctaagtagttactggaaggggtgccaggagagaggcaggacaggtcaaaaaggggaatgaaggccaatgcccccaagaggatcttgaaggctagaggtgtggtggtggcagtgggtgccacgaggtgtgacctattcaccagatgtggattgggccaaggaaatgtcacacagaggcgattttgacagagccagagcccctccatccagcttgtcctcacatagcctgatatcataaccgcatcttccccagaattgctgagtggatggggagaagagttgactcacatcacaattcattcgacaaatattgatagtgttcccacaaggtgcagtaaaggctgaatacaacacgtttccaattctctatggcagcaacatctaatagaaatataatgcgagctgcagctgcaattttaaattttctagtagccacactcagcgagtaaaaagaaatgtgaaatttcttcgaatagtatgttttattttagtaatatttcaaatattattaattcaatagattataattataaaattatttgttagctattttacctttttttaggtaatgtcttcaaagtctggtatatatttatatttccagcatacttcagtttgagctggccatgcttcaaatgctcactgccacatgtggctagtgatgagtgtatcagatggtatagagccagagcttattaaggagaaaaaattgtatgtataattataattctagtatgtgcattattattattatagtttaggcccgcgaagtaattcgctaaacactttcacatacattatctctgatcttagcaattttgtgagatgattagttattgatattttttatcagataaataaaaataaggccggacatggaggctcatgtgtgtaatcccaacactttgggaggctgaggtgggaggatcagttgagttctggggttcgagaccagcccgagcaacaaagtgagaccccatctttacaaaaaataaaaaaattcattgagcgtggtggctcatgcctgtggtcccagctacatgggaggttgaggcaggaggatggcttgattccaggaggttgaggctgcagtgaattatgcttgtgccactgcagctcagcctaggagacagagtaagactttgtcacaaaaaaaaaaaaaagagagagagagatattcagagaaccgaagtgacttgtgacttcagagcagtaacttgacatccttatttcctactttctgaaacaagtatatgtacacacacatttttctgtgtgactcagtatggcacattggaagaggcagcgtaccaccttattttcctcttcattacagctgctttcttcttaagaacactctgaagaacaggaccggaaaacgatgtgaggtccccacactgtgttccacatacaattattagattggtgcaaaagcaattgaggtttttgcaattacttttaatggcaaaactgcaattacttttgcactaacctaatatctccctttactaatctctgctgctgtccccagatcagctgaggccccacctttggccgatcctctgcctcctagcctttctggcggaccccattcttagaaggctggggagtgggcctcaggaagcagccggggctctgaggagcccaggcattgtcttttctgtgagactcatcccgctattcagcaggtgaaacctctccgcctgtcattctctccccaccccataatgtgcaacaggcctgactttgtgatgggcaaatatctctctgagatcttctttacaggcattcaccccccacaccctcctcagcagtcttgggctaatgagctcagttcctttaaacccagctcctgcctcagcccttctcagaaacttatatccggccatgtagacaaagctagaattaaggcttccagatttatttcatttaacaagaacccacaaagccagcccagtagcccattcatcccaaaatagcttctgaaagcctgaacatacgtcagtgtctctttgcagaaaccacactgcattgtcatgaaagggccatttgaacaaggtagctacaatgaaattatctcaatgcatttcaatcactttgcaacatcaaggttcatttctcagtaacagtctctttgacaataaatgaattgcgtgattggtgtgtgtttgcgtgtgtgcatgtgtgtgacaccccttcatgatgaattcctgggtatgccaatgttacaagtgattggtctttgcatccatctcttagcataaatccccagcatcaacgtgacatgttgagcagcaccgagccccctggattctctcagtcttggtgagagagggagtggggactgtgttcacgctgttacaaaaggacatctaagagggacagcagggaggaagctgggcagaaatgctccgaatcaatagctctttcttcttggtggcttggagcttgcaatctctcagcctgtgtcgagtcatcatgaaactgaagaatccttggaaagtcactgggttgggcacttttaaaagtagagtcttttctgttctgcttagaaactctcatggcatgctacagagaaaagaggagcagaggcccacagagctcccttcaccagagaagggagcgaggaggtcagagggtggaggaggtgggctgggatctcccagggcagcacctgggcggagttctggagccactcccagcctggggagaagccctgcccctactgtttgctaaaagtttggacaaatccttctctgccctgtacctcaggttttccatctgtaaagtgggaagacaaccatcccacagaggtgccatgaaagatttttagggagtacctaaaaggttctttaggtgctagtcaagtcccggggtctcgatgtgtcattaacttgctgtgtggtcttgagcaagttacttaagatttgttaggtctccttcctttctttataacagggtaataacctacctccctatttaacttatgagtaaagcagaatggctgtgagagtgggcctggagccaaagatacctgactgtaaatctgagctctgctccatcatcttgggtagtctgctaaggtttctgtctcctgtccaaaccttcatctgtaaacgggagcaaatcatctctaatttgtagacctgttgtgagaatttaatgataatgcatgtaaaatgcctagcaggggcctgtcacatagaatgtaccctattgatggtagctgcaggtatattacaaggttgtactgaaaaacaaatgaaagaaagcaatctttccttgaaaaatgcacagagctccacaaatctatgacatcatgatgattatgatgattgttgcaaatgtcacatcttcatgtggagtcgaggtgggcattagccacactgttcccattactcaaaccccagatgctccaatgacagagcctctgctgagaggctgacgtcagggagaggtggaggagggcagatctcccaacccttggcttccaccagcttcctctcaccgtggagccctaaggcctcagcagacacgctgacttcttttcagaacaaagcacagcaaaacaaaacacacagcggctgctgaatggaaaacacttgcactctagaaaggctggcaaattccctgcctcgtcccaccctgcacggacagggccctctctgcccagccacctcctggtgcaccccgctgtatctctgaccacactttaaatgtgcaccctaggaggtggatgctctgcagagagtgtgtgtgtctgatctgaggcctgtggtcccctgaagaaagaccaacaggactgggtgccatcctgtgcccaagttgttcccaggaggagaaagcctgtaggaggggagcaagctcccattctgcctccattccttgcaaggtcagccagctacatgctttcttctggctgggcccctgagggcaattgttgctttttcctcttgaggagtctttttattttcagagtggcagggaggatggtttatggtgagtatggacctaaatgagaagggtgagtagtagatggcgtattctctgggctgtgaatcctggtcaggtgggggtggctgggctggggcaggagacactgtaaagagccagtaggcctggattccttccagccgtgctgcttcctgccatttactccatctgacctacttcacaggctgggctgccatgagcggctgctgcaggctgtgcactgcacaaggccaaggcttaccatttgcatggtctgcggaggaatggtgctcctgagagctgttctctgcagcagctttgctcatggggcactggtgagcagcaaacagaatcatcgtcttcatcaccatcagcaggagcagtgactttaccaatgattgatcagctgttatgtgccaggctctgtgctaagtgctttacattttatcctcccctccaccctatatcaggtaagtactgttatatctcatccccattttataagtgagaacactgaggccaaaggaattaagtgatcggtcagaggtcagtcagatcgggagtgatggggctgtaatccaaatgctgggctggctgactcctaagttcacactttgtcttcattcatgatacaaaagagatgtctgttttcctgaggcccacgggcaggggaggcaggactcctaagcctgggccctctgactgcctgggccagtgtttccgtgccagaaaccctgtctcagagggcaggaaagagaatggggagcccttgcagaatgtggttggatccttctctcttggctctgtcatccttgccttgggatgtcctcccaacacaggccattaatctcactcaagggccagtgctggcagcggttatgctggggacatctacataccttgcattcctcccctttcacagaaaggaagaagaaatggaatttctgtcagattgcttgaactcactctctggaatcactgcgcccatcttttcagagatgttgctaccagaatcattccccccttctcttatttatatacactcacacaattagatataactatattcacacatagacacatattacaacttgaacttagcacctgctcttgatatgtatgcccagaaggctgtcacacaatcttgcacacacccacacatttgcacatgcccatccagctgagcaacatgtatttacacagcacacacatttgcatcatatctgttcatgtgcatgcatgtgcacagctgttccccttaactgcagaatgaagtgagcacagcagcacagaacaacagctggtaggaagcatgtttgtcggggtgtggggagtgcaggagagaggaggtggggtggggccgggaagaagtgagtactagcagaacagaggcttgcaaaagactgcagcaaccagccccagctggctgtaggggctcacagtcttgtcacttagaaggtctgtctgagagaccttggtggagtgcagcttcagcatttggggccacagctctgcaggctttttctctaaaaggctgccctatttgtgttgtgtgtccctgtacacgtgcgtatttggctcaggctgactttccatacacagacagggctctatttttggatgtcttggttctcatgagttgtggctaagtgaggaagtctgagtctctcctgatgcccacgcttccaggatggctcctggctgtctgcgttagcaggtcacttttgggctagctacctataccagtccaaaggcttgatacaggaaccacatcagaattggtgacaaaacaagctggggggctcctaaaggaagatactgggattctcaataggccatcacccaagggaagcagtattctcctcctgcgaccatgccatgggatgaaagcctctgccctgtatgtctggccaccttgctaaaaactgtcagccagctctaggcagctccagagctgtatgacaggagtgggaggactcttgggtcagaactgtatttgtgggtggtaaatttatatcttacccactgaatatagctttttatggctcaagacataggtttggttttcttaaaaaaaggttttcttaattcaaaaaatgtacacatttatagtaagaatacaaacagtacaaagatgtcagtccttttctactcgtgccaaaattataaacagtttatttgcatcattctgcaaattttatatatgtctttgtgatatggtttggaggtttgtcctcttcaaatctcatgttgaaatgtgatccccagtattgaaggtggggcctggtgggaggtgattgggtcatgaggtcggattcctcaggaatggtttggcactaacctcttggtgataagtgagttgttgatcagtttgttcacatgagatctggttgtttaaaagtctgagacctctccttccctctctcttgcaccttctctccccatgtgatgtacctgctcctgcttcaccttctgccatgattggaagcttcctgaggcctcaccagaagctgagaagatactggaaccgtgcttcctgtacagcctgcagaactgtgagccaattaaacctcttttctttataaattatcccacctcagatatttctttatagtaatgtaagaatggtctaacactacgtatgtgcaagtgtatatgtatatgtaatgtatacctatgtgtatgtgcataaatggaaaatgcactgtggtaaattacagatggctacaaacacttagccactcctcccagaaagaggtggaggctacctctcctattttagaactgccatggcactgtgacttgccttgaccactaaaatgttgagaaagtgatgctgcgtaacttctgggaaaaactttaagagatttgctgtttctgcttgcagtcacttagaatgctccttttcagaatctggcccctgtgctgtgagaagcctaccccacatggaaatatacacagaggaaaatggaggcagtggccaaaaacataagtcaagctcctagtcaacagccagtgctgattatcagccatgtgagtgaaccactagggccttctagcccagtcaagccttcagatgactgcagcccccgatgtcactatacggagcaggtgaaccactcaactgaacattgccaagccacagaaccatgaaagttagtacatggtgggttttatttccagtggctatattttgggatagtttgtcacatagaaatagagaactgaaacatgaagatatatttgattcatttaaataaatatttagtaattttctgattggctataccattttctttttaattaataccacacttaataggtaaatgtacagctatgtgtataatggaaagtgtactggggacatgcaaatatcgtttaagtacaattaggtttttatctagttatttgcaaaaatgcagcaatagacatcctgtgtgtggatatttgttcacatgtataaatatatgtctctaggttaaatttctaggaacaaaatgcttaataaatgacatgtaaatttaaaattttaatagacattgacaaattctcttccaaaggtaccatgccaccagtggtatgaatgtgcctgattccccacttccttgtacacaggacatggagatatgctcaaacctttcatcttcggttgtgtaataaatttttaaaaatcatttattttgcttttcttcaataacaattgaagttgttcatcttttgatatgtttatcagctatatttttctttttctgtaaacatcttttgcccatttttctactggttcataagagcttttttctgtattgaattttaataattctttttcctttttgaactgtaagaactcttagatgacaaatgaaagaaattagctctttatcagtcatttgtgctatacatttttttccacagattgttttttgactttttttttttttttaagagatggggtctcactgtacatacatcacacattttaagagatggaatgcaatggtgtgatcatagttcactgtaatctcaacctcctaggctcaagcaatcttcttggctcagcctctcaagcagctgggactacaggtgcatgccaccacattggctaatttttaaattttttgttgagatggggaccttgcccaggctggtcttgaactgctggcctcaggtgatcctcccgcctcagcctctcaaagtgtttggattgcagacataagacaccttgtccatggcttttttttttttttttttggcttttgactgtacatacatcacacatatatacatctgacacattttatttttgtctgattttatggtttcgtctttcatctaggcggaatttgtcttgctacaaggggtgaggaagggatcctgtctaattttttctccacaaatgtctagctagttccccatagctttcattgatcattgatttatcccccactgcttcaaaacactgcttggtcatatactaactgcccaggtatatatttgggcctatgtctatactctatgtcagtccattgttctctctgttcatatgccaatactgaaggctgcttcttagcctttccagtctgcatttcctctgagtctgctgttcgctgttggagccaggggctaaagtactcagcctgtactgtcagtcccggatagaatgcttccatttaaattctcatctaactcattctattccccctgtggattcttctcagcacttctttagaaagtctcctttccctgggtcatttctcccagactagaaaaattccttcccataatagctcttaagtgcttcctcttggtccttgtgatgagcttttttttttttggctttcctaggaatccttccactctgggccaaaacttcacccttcttgcctcccttgagaaagcagttatctttttgtgggccatccccatgcattcattctcctgcctgttcgctcgcttgcagtattacatggggtagcggggtcaagtcggtggagggtgaaacaggcgattggcaatactcccctccgcatccctgaagcaggtgatgatctccataggtcccagggtatccgtgccccgtttgatcagaaagaaacacacccaatcttcctcttccactgacttttcccgtgtgaaaggactccctggtcaggcggtattcatgccgcctggaaactcatctgcctgtgccgctgctttttcctggcagtttacaatgttatattgctaccaaagcgggcaaaatgaggatgtgaagtcgagcatctgagaaggctcagaaagtctgaataagcaatactggaataacaatgtactcctcaccaaggcatttagccagaaaagtgctcctgcttaggaattctatttgtttttctcttggaaaatggggaagtacatctgtaattcagctgtgaataccctattttctttgcaggggaagactggaaatagagtcctttatctcagatatcaaaccctggcccaggatacacaagaccaggagtcatcaccatcagtaacagtaacaacagcttcattaacaagttgctgttccgacgtgggctccggggtggggaaggaaggagggcgttcggctcaacgtccaggagaggcaccggcgaactcgagagccaagagcggcactcccacctgggcactccttgctgatggaccgggacctcctctcccatttctccggggcctccagggccctcccgcacattcagcatgatctctgaggagttcactagctttcctccctccgctctccagctcccgttcctaccaaatgcaccaatcatcactaagccaggtcaaaggccatgggatcagctgtgatctctcccttcctttttcattctcctctcctcatatccaaactgtcattaaactcagtgtttcttccttcaggctgtttcttgaattggtttcttctctatcccactattactgtcctgatccgtgctaatccaacagtttctgcccccaccccaggacagcttgtgttatcacggccaggtggatctttctagaacaccaagctcagcgtatcccttctgatcaacagagaaggagaggagagcctacactgtgctgggtcactgtgttacgctatgtgcttgtttcatttaataccgtcaacgaccatataaagtgtgtttgattatccttaagcaaaaaggtcaagaaattattagatcaatttcaagtcctcttcctggcattcagaactcgccccaaaatatggctgccttgactagttggctttatcatctcctctatcccaagatgacctttggggttccaatcagtcctatctcttccccgggagtaggggtggaggggcagcacccccgggcagaagatgcagccaaacaggaaagacagagttcacacctaactggctaaagtacaggcaaacacctgctaatgagtggtggtggcagtggtagggagtaggttgaactgtgtccccaacattcatatgccccaatacttcagaatgtgtctatatttggagatagggtctttaaaaaggtgattaagttaaaatgaggtcattagggtgcgtcctaatcctgcatgactggtgtccttataaaaagagaaaatttggacacagaggtacagagggaagaccatgtgaagatgagggaaggcagacatctataagccaaggggaggcctcgggagaaaccaaccctgtagacacctccatctcagacctcctgcctgcagaattgtgagaaaataagtttctgttgtttaagccacaagatcgtggtattttgttacagcagcccagggaaactaatacaggaggccgggcaggcattgtccaagggagctggagaggctgagcactggggcacgagggtaggtaatgatgtgagctaccttactgagcatcttctatacagcaagcaccaggctacgctgtgaacattctgcattcattatcactaatccttacacatgccctgccaggaagttactgtcacagccattttagagatataagatccaaagttcagggtggaaagaaatgtccctaggagacacacataatgagtatcaagtctggcattggaatcccaatctcctcctcactaagcccatgcttattctactattctgtcctgtgtccatcagtagatgggctggcatcagtggaccccagatctgtccacaggcagcagggccctgaccaacaggtggcttctcggagcagtgccttgtcttaggggggcatgttcactgaactcatgaggtcagaacacaggacttcacaaagctgaggagagaagggagatagctagctcagtgtggcaccccattcttcccattgagccctctcctcttcctgttgaagttcagcgtggttctggaagtacctgagtgggaagtagctttagcttcccacgactgttcaatagcattcaagtaacccttcatggcatgccgagattcctaatgagatgagaatacattctttaaagctccagttaacgtgtatgcagatgggagcttggaggactattttgctaaatgatgcaccctgtgaataaccatcacccccatatctactagggcaggcaccccttctctgtcctcagctggggacccctctcatcccacttggactcagagtccctggtgccccgaaggaaagcaaatcagcctcacttataattaagtgtctcaaataaagttttgttttaggctaaataagaaaagtgataccaagtcaaacagatcacaactgattattaagaacagatctactacagtttgacaactgccacaaacacaaatcttatttgggagttgctaaaactcagtaaatatcattttaataattaattaaactttaattaatgtcttgacagtagtctcaacctgataggcctcttcacaatgtgcaggctgtgatgaggatggtggctgctgggacggccaagggcagctaggtttcaggtgtcccctccttggggcaaggagaactaagttcactttcccccaagaaaaatctgtggtctacacaaatcaacctaaccactgaatcatcaaacactctgagaattcaggttaccaacagtgactgcaggagaatctaaagtgcttttgcatccttagagaaaaatctctgctccatctttttatggatccagtgggtggcagaaggaatggagttactgcaacatgacaatctccatcctgcctgatgcgcgagcacataaccgcctaagtttaaagagaattctggatataatttattatataagcctgtaatcccagcactttgggaggccaaggcaagtggatcacctgaggccaggagtttgagaccagcctggccaatatggtgaaccccccacctctactaaaaatacagaaattagctggggggtggtggctcatgcctataatcccagctacttgggaggctgaggcatgagaatcacttgaacccaggaggcagaggttgcatggaactgagatcgcgccactgcactccagcctgggcgacagagcaagactccgtctcaaaaaaacccaaaaaacaacaacaaaaaataatttattacatgagtagctcccaaatagcataattagtatcatgttagctgtaaaattaaacaaaaaagacttctgtccagttccctagaaattctaatttagtaggaatgagctaaaaggtctgatttagtaaggtgagaatttagtaggctcaggaatctatatttttaaccagttcccactgtgcgaggatgctgtgccagcaaagggcttcttcaagccacagagcctcccctcccagctgccctctctccactgagcctgaagcatgggcggcggtgggagccgcttcattataaaaagcagaacatccctaaaaacaggatattctagggacaccaaagagccgacactccattggaaacgcctcctctggggtccaggaaggccactccacagtggcgctgaactactgtttctcagcaaggtggtccgggccttctgccgtcagccagccacgccccactcccagtggtcctcttccgacatgaaagatgccaggaacaggaaaagcaaaacagcgcgcagcgactttcctactctagtagcattttctttctgtgtctctggtgagtcagagtttgtttgaatgtgaattatctgcaatcacgaaagtgacagtacagctggctgccgggcccgaaggaaatgtgtgctccagataagggcgagtgtgtgtgtgtgtgtgtgtgcgcgcgtgcatgcattttggggggctggggctgtcctcacttatcaaagcaattcccaaggcggcctctctgagtgaggcagggtctggcagggccgagcccctcagagccctctgccccgttggtgctgtgccggcgaaaggccacgcctcttcaatctggggcacccctgccgcctgctccacctcgcccgtccttgggttctggtcaatgttgggttgcccccttttcctagggatgtgggaggagaagagaaaatggaggtctatattgccacctcattctccgggtgcgggaaactttccctcagaggcaggacgcaggcaggtgaggatcacccgccacggcttttgtccactcatggtgtgagtctcaagaggagggaaagtgggtagggtctttaagtttggtactgtggccctctgaggttggcgacaacctgaaagctaccagcagagaaaagtaggtggagacagtgcttttggccacgacccgtttttgtcatcctcgttcctcctacaaaatgaaaaatggtccagaggccattcagatccccgcaccagtcactgaaaagaaaccagtttaggtgtccaaggctttttggtcatttactagacatttattgagtgccttcgaagctctggcgtggtgctaggtattaggtgctaggtgttaggtgttgagtgttgggtgctaggtgctaggcactgggtgctgggtgctaggttcctcatctcagggagctcaatctctcataggagtggcagataggtaaatagctataacaaagtgtgagaaacctgaaactgaggaagcacagggggctgtggaagcccacattgctgattcctaaccaagagcggaggagttggggctgtgaggatgaatggtctgagaaggccatttagggtacggactgatgctgggatgtgcagaaagggagaaaggaggctccatgcagaggtcacagcccatgcaaaggcctggaagccagagagagcctcatgcatttaggaagtagcggacaataggcagggtagcatcactgaagcaaagcaggtgggccaaggtggggaggggatgagggcagggctaggggcagggccccagatgtgaagcgccttttatgccattcttagaagtttggacgtcctcatggaggtaaaggggagccccaggatgcctcaaggtatgtaggaagatggggcaggaggccattgcagagacccaggtaagaaacgatgaaggcctgggacagggctgcgctgcctgaggtgatgaggagggaaagactccaggcttattaggaagtagacgcaacaggctctggtaactgacaggagtgtacattctgcagagggcgacagacattcaacaacaaatgacacaatcaactatgcaattaccatggtgataagtgtgctgagggagagtggagggtgtggggttccgtagggggatctgacctggccagaagtgggcgagacctccttgaagaggtgatgttcaacctgaggctgacgggcgaggaggaaatatccaggtgaggtgttgagtggggagcacggaacagcatctgaaaatgggttgcagggggagcacagtgcttggaggacctaaaagaccagtctggctagatagggcaggtcagctaaggactgcagaccaaatttgattccctgactgtttttgtaaaggaggttttgttggaacacagccacgccctctgcattcgtattgggtagagcagcttttgcatcacatagggccagggctggggaggggaaagggaggtgcccagggtgcaatactgaagaagaccctcactcccaggctggtgcacaagccacagcccggacagtcagtgcctccctcaattttgtacctagagcaccttacctgccttacacagttctggcctctctgccacaatacaatgacataatcaatggaggagttgcaacagagaccttctggttgcaaagcttaacgtatttactctctggctctttgtagaagcatgtagacccctggcttagagcagcataaagaggggagcgtgtggcccaggccgagccctgatactgttgcagctctggccacagccccttagcattcaactagacatgcagaagaaacctgtgctaatgcctgcgattctctgtgggacagcgggtgtgatggagtcacggagatgtgatggggggcatttgggaacatgctcattctgtcttgggcaaatggcatgtgctggagagtttccgccctgggaggcagccctctacacatgataggtatggggctggtggggataaatgccccaatttcctcacttctccttggggagaatgccacgtcccagagttgcacggtgggctgactgccagttgcacacagtggtatctacatgatgatgaatcctttactggcgtctttccttcctttcctactcacttcctccctcccctaccagggtttcctgggatcgccccctgaaacaaactacttgcatttgaatccttgtctctgggtctgctttgagggaagatgtgggatatccctgagctgcctgaggtgggggcttatgtaccaaatcccaccatagagaaggaggcccctgctgggtgatcagcggagttttacttacatgaactttcctcctgcttccccatcccaggcacccgaggcgtcaagccacagggtgaagactcaggcttcatctttttctcagattctaaactcacaccccacctttctgtgtggctgcatggctggggactccatcctcctaatgatcaggttcttgtgcaagcctgtgacactttcaccttgtgacaatgcccagacaactaatagagtctctgttttgccaccggataattgtttatttcctctttcaagggaactgtgtagaggaagaaatcagttgagaaaaacagtcttgagctactcaggctatccccatctattttgtgggggaagaaaactattcagcattttcaggttccttcctttcagatcttcccaaagatctcagtgcacaaccagggctggtctgggacagttgctgtgcttctgctctgccctggccagcctctgagggggtctccaaattaaaatgcaagttttaagtcagtgctctcctttcctggggattgttgacagctcaagaccacatgggctcatcactgtgatcttaaggaaagaaatgatcagggcaaatggctccaaatgaagatgaaaaagcttttacagtgacagggaagaaatattgcaggctgcttgagaaaatgcagtttgggaatataggagaacgtggaccattttgcaaatcaaaaacaagaggaaaagggactacagcacgtgaaacatactaaagagaagagcaaaaatgagattagaaataaaagaagggcaggcaaaaggaggaaagagaatgcgggggaggcaaacatcagagagactgcacaagagcaagagggaagacagagaatgttcaaacaccatccacgatgaacacggttgcagagaggccagtgttccaccgtcaagagcgcagaaaagcccttggtgctcctctgaagaatgcaagagcaatctgcagtgttattgactagtggaaaaatggctcctctctgacttagcacaggatgcaatttatcttcagagagtaccctccatacacccaatgttagttcttaggcatgaggttgggcaggagaagggcggaggaagaggtgtgggaaaagaggcagacagggaggtgagggggaatgtgggaggtgatgagaaagaaggaaaaagaagaaaggagatggagagagtgatagggagacaggaggggagaaggaggaacagataggagggagctatgaaagaaagagtaaggttagaataaagatttgggaaggagagggaggcggaggaagaaagaggaagggagggagctggagagcaagattttgaaactcttaaactaagaagagcaaagcagctaatatgtatggagcacctgctaggtgtcacgcattgagctaggtgtcatttcattattatttgatctcatgctaacaccaccttggtgttatctccctcatttttataggtgagggatgggtgctctgagtttcaataactttgcccagaaccacagcgttgaggctgtagggaggttaggattggagctcaggggacaaagcctgtttcagatgacacaggtcagccacatcccagggaaacaggaagggactgacttttatggatctctagctcccatctaagtgatactgatggagcacagaagattcctggggacactcactgtggcctgtgaaaacctgggcctccaaacaccagggggagctatcaccctggaagaaacagccaaatgcatctgaaaactggccatatcagtcaaagaaggtatttactagcctgagtgtgagtgtgagtgtgtgtgtgttggggggggggggaagtgtgggggagagtaacagctgattctttctagctgattttcattttatactggacctcatctagatgggatccacccattatttgcagtgggtgcctgttttgtttcctttcccctgcttgttggctgctgactcatttgccctggttacctgggaaggcgggaatgagcctagggcaggcatagagctcagcgcatccaagatgatttggtgcgtttttgacagatgaatgaccaatgggaggatgaacacgtgcttgaactggaagggttctggaagaagcatttgattcttcctcacccaggtcagatcaccatctcaaacatcactttaaaacaaagaacgccacaaagggagatttctttgccttccttagaccttcacgctggtccttaccttcaaggctgtcctcgctggactttagctgttgaacccactggcatcctttcggaagcctgaggttgggagttaggagagaagctaattattctatggtgtcttggatatgctaacaataacagctcccgtccaaggctgtcatgttatttaatgaaatagtggaagcgtgattatagtttataaactcaagtactttgacagtggtcactgctctgaaggtgccactgttgtacaagtggctatgtgaaccagcagtgatagaatgtcccagctgttggctatgccttaccctattaccctagatctattgactcagatgctttgaaagttctcgcggggaactgttccttgtagactctgctcaggcaggttggcgtggccaggcttgggaatggctgtcaccacacaccttgtcctccatcctcactcatctctgtcctcctgctggccagtcacccccacctagtggttctcgtctgttttaatgagttcagagtcattgccaaactaagtagtcagcttccatcagtgctattcttcatgttgagccacaacataaaacactttattgcaattacaaatagcaaaattattttctgccgagcctcagcatctgaacttaatggcatgctgtaatgccaccctgcgctgatgtgtggcatatctaatatccatctttcttagaaataacagtgttcagaaattagaagggactttagcagtgaaataattaatgtggataaccatcataaacggcacaaatggaacaaatacagatggtagtgagccgtgattgctaatatgctaacctgttttgacagaactctacattttttcattgggaggttcatggatagaagttaaaatatcccttgcctcatgacaagagctttgtctttctgggtaagagattcaatgatctcctacctgggcaaggtagcatcaccggaatttgcgctgagaggagggcttgcatcccagctctgggctctctcacacccttccatctcctgcagccacatttctgccctctgcctcaggctcaggcaggcgggcccacccagaactgcagccagacacccacctcttctgtgctatggctctgagggaggggcaggggctccctggctgggctcactcagtgggaagcagctctttgaagatcctagctgcatgcaggtgcaagttgcggaacccaactccaagaggctgcacggaaatgaaaaattgccatagaaagatgactcaccaaatcacagacactaagctattgagacaaatataaggacgagggtgtttgggggcactggaaacacttggctgtgcctgcttttggccctgctggcctttaagcagcattagcagcagaagggccatccaagtttctctggatgagtcagaggtcctcagagaaatgctggagggcaaactggggaaggaaggtagaaaggatctagctttaacttattaaggataagtgctgtgctttacacatattttatttactctcaataataatcatttgccgtgggcatggtaagttaatatttaagatggggaacctaagaattagacaataagtgatttgccaagttcaccaggggcagggaagctatgggcagagcggctagggattagggtcacaccaccccggccaggagccccattgatacgatacagggggcctcactgagtctttctgccccaggaagccaagccctcctctctgatgctgaatcccagcccccttctcccactcaagggcgttgatagaaacctttgtctcctttccctccagagtcatcattccccctttatttaatcatcttcttacaaatatgctgtaatatctctaacttttttaaaatggagaagcctttctcatgtttgttttcctcctgctatacctcctttgctgtgttctcttttacagaactcagaagagctgtctctcactgtctccttcatctagacaaacgcatttcccttcattccgacactcggtaacccacttattctggttttgtctcaaatctaaaaatacgccactgaaacggcttcttcctaaattaccaatgactccatgttgacaaatccaatggtcaactccttgttgacacaaatggccagctcttctgtttgaacgccttcttctcttagcctctgggagagcagtctcttacgggtctactcttactcacagctactccttctccatctcctttgctagttcctccccatctctattattcccaaatgttggaggacctcagggcttctccgagctgtctacattcactgcctaggtgatcttacttagtcccatggctttcattccacccgcatgctgaagtctacttccttgctgggcatttccatttgaacatctcttaggtttctaaaatgtaactcatccacagccaactcctgccttcaccacacagcccctcccgctagatcctgtcaaaatcatccctatctcagccaatggcaacttatccttccttttgcgacttctaaggccacaaccttagaagtcatccctgatgcctttctctaatactttatctttcaatcttttatccagaaaatgaccacttcttacaacctctgctgcccccaccctggtccaagacagcatcaccttgcatctgttgaggctcctgagagacgccctgcttcttccctgcttcagcctcttcttaacccagtggccacagccatccttacgcaatgtagcaatgtcagttggatctgatcgctcctctgtccaaacttctgatggcttagggtcagggtgtggtccctctgcctctgatttcagctcctactcatccccctttgactcatctgcttcagctgaactaacctcctttctcaagccaacctgcaggctccctcttcagcttcttggtccttactatttttcctgcctcttgactttgtcttatgtttcttcattgaacttattgcctgacacagcatatatttatttgtaaattgtctgagctcccacttgaatgtaaactctttgagggcaggggcttaatgtgtttgtccactactgtatctccagtgctcaaaatagtaggtgccaaataaatatttgctgaggggatgaatttagacctggtgagactctgcagtccttgcctgtcccaccagccctcacggcagtgtttgcatgcaggagatgccatgtttgcatggtggggctgtatctgcctggctccctagtgatatgaagttctaaattccaatgaaatctcaaatccctcaaagaaagattttaccactctggttaaaaatcagacctagaggaaatatgctagattgcagggtgtatctaaggaaataaaagcattaggtgggtgaaaaattgcaaaaaacaaaattactttcaacttagatctgaggagtttaaattagttcactcccatgcccagtgtaggtgaagacattcaccacccaaacacagacactcttgagagcgaatgagagttataattatcatagttatgttagggctgcaggcacaagccaagactgtcctaggcaaaccagttatgatcaccctcatgagagagaaaggaattggcttgtggctgggccagggcacatgcaaatgacgctgtagggctggcattgaagaggaagcctgggagaaggtgggagaagatagcgaggggacctggaggagaggagtgtccaggaaagggcagagagcaggaagatctggagtcatacattaaagggcaggggcagggaacaatctgggagaaaggtctatttcatgtgcttgagagaggggagagagagaaactgggattcctagggaagaagctaattgggcaccagccgagctggcaagggagggagccctgaaatgagaacaattttggctgagagccaaagtgttttctgagacagactgaatgagaaacaacatggtgatttggaaagaactttgagactagattgacttagtctcaaattctggtgctcattcgctttgactgtggggatgacactgcttgtgcttagcctcagtttccacaagacagcaccttccttaaagaatcatgaggccgggcatggtggctcatgcctgtagtcccagcactttgggaggccgaggtggatggatcatctgaggtcgggagttcgagaccagcttgaccaacatggagaaaccccgtctctattaaaaatacaaaattagctgggtatagtggtgcatgcctataatcctagctactcgggaggctgaggcaggagaatcgcttgaacacaggaggcagaggttgtggtgagctgagatgcgcctttgcactccagcctgggcaacaagagtaaaactccgtctcaaaaaaaaaaaaaaaaatagaatcatgaggaataaataagataacacatgcaagacatctaacacagtgcatggcacagagtaggtgcctctctggcaatagcaaagaagcctgctcaagaggacagagattgaaggccaaggcttcattttggatttgcagagagaagtcaggggatgagcttgagcccccataactgcgctctcccctagggtctggcaaggaggccttgatactgaaggaaggatgataacagggtgcgttggagggacagctgcagcttcacacctgtgaagagccatctgggtcaccagcacggtccctgacataggacagctccatgtggctgatactgggatggtgcctcacagtcaaaaagcctcacagtccaaaagcctttttgtgttccagaaccatttgtgagtgctctggtcagaagcgaagggttcccatggaagtccttccctgtgaacaatgtcaggaccccttagcatggcagtcaaggctcccaatgatatgtcataatttccacttccagccttgtcttctgtctgtaactctactgtatatacctcatgatcctgccaaactgttcctcaagcacctgctgtcacttctctcctccatcccaatctatctgcctgaaaacatcctgtttccagtcatcagcccttggctgacacttgaacatggcagagtcattccacccccaggggtctggactagctgttccctcttcccaaaaggcccttctcctggccatctgcatggttcactccctcacttcctacaggaagtctcattcaccttttggggatttttttccctactgaaatttgaagctctttctccaacatttcttgtatgtatttatttattcctgatttatgttttctgtttagctcttctgactatctaacttacaccatatcaggggttggcaaacgatggcccttggggccaaattcagtccactccctgtttttgtaaataaagttttattagaacacagacatgcttactcatttatgtattgtctatgactactttcatgccacaatggcaaaactgagtagttgcaaaaaagaccacaagatctgtaaagactggaatgtttactgactagtgattagccttttccaggaaaaatgtgctgagctgtgctctaactcatgcatgtcatgtactttatgtcttccccactagaatgtaagctccgtgtggacaaggatttttgtctgtcttctgaattactgcattccccgttatctgggaaaacaactactcagtacatatctgttggatgaatgaatgaatgttgaaaattctattcattggcaaggcctagctcaaatatcacttttcaggaagcactcctttgcatcatggtgatttccgcacgaaatctcatttctcttactagatggtaagcttcaagcgtcacctctatcatgaaactatcctttgtctcccacggtggaattggcctttcttcatctattcctcttacagtcttctgtggctgcacatagtgtacggtaggtattgcggtatttgacacatgttggactctccacttgactgagattaagtgggtagggactgtggtttgttcgtctccgtcccaggcatctatctcagagcctgcagccctgacacattgcaggtacttagcatacagagctggatttcccccactgaaacctccacagccctcctagcagagacagacacacttttagtaggggctaagctatgtttgtggagtagaatgaaaggcaaagggaacagtgctgagccagagaacacagcattagtgggagctgtggagaggaggctagaaataggcaaagaagggaggggacaggctctgtttcatttcactctaccataaagaggtaacaatttaaaaaaatcaactctcctcagcctccagacacacatgctctgtggcatcattaagcagctggtgccaacatttacctcacacctcccttagtaggcaagaaagcatttcctaaacccttctcctctatgcttttaaaataaaggccttagtggatctcaacttcagcaaacagaacattttctacttttctatactgtaagatttttgaaagcagtgactgtgtcattcttttatattcctagtacctagaccatgatgacataataatagatgcagaattaattttcattgagttacataaatgatacaatatgaaaagagaagggaagaaggaaagatggaaggaaaagacttgcacagatgctctttgtgactcagaactttggaaaaagtccaacgagcaacaaaatactcaaaatactttaaatgaaggtaaaaaccatcattgttttctctctgcctagggtttttaggaattttcttctattcaagatcataattgcagaaaactagaccaatgatctgattgctttcataagctccatgatgattaaaagaagtgtaggcagctccaaggccacacatgaaaagagaaatgctgaggctgttccatttgagcctttttgtcttgcttggctctttgtcaaaaccaagtctccttctggagatagagatgcagatcaccacctaccccaactgttcccacttgacttaagagacaatgtggggaagaacatcacccccatttcaaccttcagaggcaggttgcttctgccacggcaaggagaagatcactttctgtgtaagatttctgattcctgtctcctgcaggttggttcattttctttcaaacacctgtgctgtaatatgctaacctgatcctaagacaggccccaactagtacacacgcagatccatgcacacccacacacatgcacatgcagacttattgtcatagcttgtatctcttatggacaagatgcagagtgagtgagccagcagatggacaccctggaggttcggagccatgtcactccctatcagccctctccaaacatccaggcaggatctgggagggactgcccttgagatgggtgggctccatgaatttccagctgaagcaacacgtttctgtccccaagggatgaagaagtttcttcagctgctctgtagatatgtcatgtcgagattgaattcaggtatagttttagctgccttccttcttgaaacttccctctccccgtttgaattccaatgaggcatcttttgaatgctgagattgggaagcaagactgagacctgcttatgggccaagggttcttagtattagataagagtcaggattattagacctgcctatgggccaagggttcttactaatagattttgaataaccataaaaacaactttcctgcattcctctttatcatagatcaacttgtcagttagtcattcacttaatgagtatttattgtaccttgactttgtgtcaggtagtgtgctaggtgcaggagtagatattcttatttctgttcttcagatgaagagacagaggttcagagaggtgaggggtttcagtggaaagtggccgagtcaggaatcaaaagcctgtcttctggtgcctgcttaatggggttttaaccaatgtgggtattaggtgagaggtggccaggagaaggcaggacattaggggttatttcttaagcctgtgggtaaccactgaggcagcaggccagaaagtcacgtgacccagtgtgatgtatgggagaggacagcgtggtgcctcgtatgccatgaagaattaatctcaaggagatgctagtgagctccagagacttagcatcagtgccaagagatcaaagatatgatatctctggcagagtgcgctatcaggagcgatcaaagcaaaaaaaagggttcatttcagtgccctgtgcattagttgcctgacttgctgactctgggcacaaaggaagcagtcatggtttggaaatggtgctaacacccgcatgggcatttctttcttgacatctccatacatctcattgttgcctgtccataaacaaaaacattatcatgcccatgggtttgcccccgctcatccccaagctggctgtccccgttttcttctgagtgtgtttgtgtgctcagtggctttcctgccttccttggatgatggtggtagaggccgtccttgtctggaggaggcctgtcagggtgcactgctgcaggctggaccctgagcccgctctgccctcgctgcaaggctgctgctggggtggatgtgcggggctggtggagctctgtggcctgggtccagtctgcacaaaggcagggccagggactacagagagcatggggggaggcatcaggattggccaccaactcactgagggactttgtcaagttgcttcccctcgctgagtctcagtttccttatctgtaaatcaggcagttggtctgtgtcagtaactttcacccccagtttctctggtgatgtaagttttccaatcaaattataataacccaaatagaggagatgccccataaatacttcttgaatgaatcaaagcaaatctataaagataagcatggaaacatgtggactgcagtggacagggccctggagaacgcccttctgagtgccctccctccattctaaccccctgtgtcccgaagtgggtctctaaggcccttctgtggaaccctaaggctccactgaacccagcttgacaaccacaaatatggactttcttgtttcttaaagctctgacattcagtgattctaggggaactattaagtctcaaatcccttacaaattaatgaaagatctctgacatattttctagaatttttcctcagaaatttccctggacttctctggggctatcctgttggctttatgaaaaagtctgaactacacaagatgcctcctttttttctttttagatggagtctccctctgttgcccaggctggagggcggtggcatgaccttggctcactgcaacctcctcctcctgggttcaagcgattctcctgcctcagcttcctgagtagctgagattacaggcatgcaccgccacgcctggctaaattttgtatttttagtagagttggggtttcgccatgttggccaggctggtttcaaactcctgacctcaagtgatctgcccacctcggcctcccaaagtgctaggataacaggtgtgagccatgtgagccactgcgcccagccacaagatgcctctttatgagaggatccagtctacctttccagctgttttttcccactcctatcatttcccttctcctagcaaaactctgtattggcctacacatgccaatgtgttgagcatgccatgcgttcttgtgccctgcatctttgcttttgccattccttgtgctattgtttttccactttcttcctgcaaaactcctattcatcctctaagacctggctgtgatgtcctggctcttgaacggttctacctctcactcactcacacagggaggtcagctgcttctttctctgagccgccttaccctctgggacacgcctccagcacagatttccgcgtagcctaccttcactcatctagatacatcatcttccctggcagatggagtgcttctgaaaggcagagacttagctttgaattcccagtgcctagcatggagcctggtccataaaaaccactccatccatgttcatgaaatgactgagaaacagcaagggctcctgtgcacttgggtgtggctccagaagaggcagcttctgtggctattccccttggaggccggctggccactctccctgcacagagcaggctggcttcgccatcacaggctgcttctcagaagctcagctacctctccttcctcacctcccagacccctcggaaagtgttccccaccagaaatgtctttttggtggcctcaacctgagaaggaaggctacagagcttacagatttaaacttaaatgcataaacaattcacagtggtcccctggcttaggctgaatctcaacttggaggacttggtgtccatggtaagtctggaggcctgaaggtgggaggcgctcagctgtctgcagcagctgtaccctgcaccctgcccagcaggcatttccctgctacatggctctcctcccagctccctcgggggggtctggccctcccaccctgggtgagctgcatttttgtggtcctccttcttctaatctctctgcctgcctcacaaagtggagaattcgattttcttcccaaagaaaatcagatttgacttagctccatccattttcacaattgctacggaaacgctgtctctgtgaggacaaaagaactaaacgaaggactttcagtgggggaatgagcacgtggacacaactgtgcctcagtgagaatcccttgcagacctgggagagacatctgcaggcagtgggatgcggatcagaagccctgggtccccagagtccaatgatgaggagacccggagggaaggaattggcttgaagtagggctgtctcgggggtgagcatttctcccgcagccccacacccagcagctctgagagaagccagagcctcctgatgcacctggcatgacactgggacaaaggcaatccattatgtgactggtatatcagagtcacagaggggctgggtgcagcagggtaaagaggctgcaaggtcacagatggacaaggtgtggctgtcacagctgtggtggctggccccatgaaataattgggacaccaggaggggcagggtcagaggacctctaaatagctctgtagtcttgggtgagtcacttgaagcccccaagcctcagctttcccatctgcagaccagggagaaatatcacctacctggtggggtgtcctggggctcagtgttctcccgtggcatgctgcacatgcctctactgtgcatgagagtgtgtgtcccacctcccaccgtgttaaagcatgttgaccatgggtgtgctttcccacaggagtgtaggcttccagagcaggaaggggtgcgtcttactcactgctttattcccagggccaagcaccctgcctggcccctgcggagctcagggtgtctgatcacctgagtgagatgatgttggttagagtgcttgccacctgctgcacacaggaattagcttccaggctgaagtggggccagtgtagggcccacaggaacctggaccaccttgactctttgtatagggaggggaaaggaggcaggagaagccctgagtacttgtcagtggagtgaagcctgttaagctttaagcgggaggattcagttcagtaagtaacttcgtcccctgggagggcccccaggtcccttctgtgttggctccatggcctctcttctctcctgcattaattcaagtgaggaaggcctgagcttgcctccctgaattccctgcaccccacagacgctgccccattctcaaggtgccatgtgtaatcaggaagcagacgctagctccaaagctttcggggcagagggaggagggcaatggctgggcagtgggctgtcctgttgctgaggagaccttgaggaggaggcttttggggcaggcatgcctgttgcaggcttggagtgggccctggggaggggcagtaccctctaggccagaaaacacaactgggccatcttccctcatctctagcagaatggctgcctccttagtccagactgagtcctgtggaatgtgtggttggagcaaaaagatgaagagtgagtctaagaggtcatgaagaaggacagacccagtagactgtggctcagcctttcttgggaagcagacttctaagaaacaagcacgctggcttaacaacaaatctaattcttttagggaaaagaggtagtgcatggataaaatgtggaaagatatagaagaagaaacaggaagtggagcctggtgaggaacaaaaggtgtcacaaggctcattttagggacatattgcaggagagacaggaaattgaaattggcgccattcttctagattgcccagagtcctccagagtcacagggggagtcaaagggtcaataggtgcttctcctttgcagcctcagggagtgattacctgcaatatgccagggtactgtccctgtaaacaatgaggctggaaggcaagaaaggagcagctccctggcattttgctgctggagcacggaagcagtgctggccaggagctcacaggtgggtgtgaacctggggaccctccgtagatactcatggggccccgggcactccactggacaggtgaaaagctcacagctcagggtcccctgctattttatgagcttgggaggtttctgtgtccagaagcacaatggagggagcccctgatcataatcactaagagcacaccatgtttgctgcttttaactgtttccaaatccttctagttcataggctcctctgctcctaaaccagtcctttgaggtatctggcagacagttttctgcccttcccttccttgacatttctgtgacatttggctctgtgacggcttccttcttcaggaaactcttttgttgtcttatttctgggacaccctcctccggagtttccattccctctcagtccccgtcctgactctcattcctgtccccagccacttaaatgttgatgtccctaggttctatccccagccgtcttctcattcagaattcccctcctcaaagtagattcatcactcccagagacatttacatcacgtctccacttagcccttggccctggctctcagccccgcagaacccactgccgactagccccatccacatgggggcccacaggccccttgagtgtgacacgtccaaatgagttactcaccttctcctccctcttctcatcatctctgcaccatcaacatcccctaattgtccaccagaaatcagggaacaatcctggcctccaccctctcctcaccctatacgtctggtcaatcatgccttcctctcaacctgactcctacaggtatcttcaacctgtgcccattctcgcagctctgagcttattccatactacataagtttgcttagactggtggttctccaccatgggtgatttttgtcttccccacctaggggacatttggcaacgtccagggacaatttctgatggtcacaacgaagtggttgctactagcatcaagtgggtagaggccagggatggagctgaacacgatacaatgcaccaggcggcccctgcaaccaagaaccaaaatggcggtagtccccaggtaaagaaaacctggcttacaacatgcaatacttttctttttctttttttttgtttttgagattgagtcttgctctgtcacccaggctggagtgcagtggtgccatctcggctcactgcaacctccgcctcccaggttcacgccattctcctgcctcagcctcccgagtagctgggactacaggcacctgccaccacgcctggctaatttttttatatttttagtagagatggggtttcactgtgttaggcaggatggtctccatctcctgacctcgtgatccacccgtctcggcctcccaaagtgctgggattacaggcgtgagccaccgcgcccagccaacatgcaatacttttctaactggtgtctctgacaatcaggttccccttcaagccactctctttgctgcctcctgcgagaatgcttagcttacaaatgaatctgtctgcatgtctccatttcctaacttctcagcatagtttacaaagctccctatgatctggccctgcccaactctccagacccaccttccatttctcctgttagtccatgccccagcagtactagataatctgccgttctctgagtaaatcatgttcttccatacctctgggccactgcctaggtctcaaatgaccctatcccagggtccatcccgctgtgtccactgtttgcattgggtcagagcttacttagtccttcaagactcagcccgaataccatttcctggacaaagctttctcttggctatgcttctaccacagcttgtacgtattctcatgtctacctttcacatttctctttctgcagtcttcttgaggtcacagatgtgattttatttatctttacagacccaatgcctagcgccatgtctggtgagtgaatgcacacaggaagaaagctttgccaaaatttgcacacctcgttgctggaaggactaggactggcattcaggtctttggactcccaagctatgctcacctcatcagacctgatggctctaagtaggtcagttttaggtcctgagctacttgatccatctggctcccagttagagaacaacaagaaactaatcacatgtggtggctgctgcctccgtaagtgcttccatttattcacaagctgaaagacaaaagcttggccccccagcatatgctggatcaaaagcaaggaacaaaaaggattgtaaaagaaagacgctggaaatagtagctactttgatgcaggcagctctttgaggaagcagctgaggactgtgcccccagcagcaaagagagagagaagtcactgccagagggtgaaggaaatcactgcaggaagggtgggacctcactggcttctctgctggtttccagcgagtgccaggaatgggggaggggtgtctcattaatctcacctccttgctgccctgcctggggtctttacaatctgctccatttggagactaaggattcctacaggaatggcaatctgagccagagatttaggaaggaggtttataagtaatggctagagcgatagagtaattaataggaaactattattaacaatacagtgatttcataatgattccgcagtttataatacaaatgtatacatcatttgatgaattattgtattgagcccgaggatgcaggaatggccagattctgtccttgaaatagccaccccttctcatgaggacccctgagaaaatatagtaagcacacaaagaaaggaaagcaaagcaatgcttcattgttagctggacttgtgatcaaaaccctagcgctctctggtcaactggactagatgacgttttctactaagcaagttaggactaaacagctcataacaacagccaatccaatatacctgcttgtctcgggaaagtgtagtcagctgcagagagacagtgagagagtgactgtttcctttgaattcctgctctctggagttgacttgggcagcctggctctgaaccaggacaccatctctgggttggtggccatctgagaaaacatggagaaaagacactttgaggaaggtaacctcgtaatgctgagaggaagcttatgcccaaggagactccaaggagaatttgggatctaaccccagagcactgcagagtggaaaaggccagggggaaccccttatcttaccagaaaaccaagcaaaggagatagcaagaggctggactgaagttaaagaataatgcttaagtgtcttgtttgggactcaaagggcttgccctcccattgtattcacagatacagcaaaagactttggtgaaatgcaatgtggaaggaggaagattggttcccattgtgaataaggaaaaaatgagtcctggggttctgaaggcagcttgagatattttgagcatttcacctctgaagtaagagtgcaaccctccaattcaaaagtgtaatttctagtccctttgttgaaaagtcagttatgaaactttacagtttcacttttggctttcggctgaacttttcagagcctttaaggcaaggtgggtaagtatttttagagatggtaacgaggcctgggggctatgcacacagctggagctcagcagatgtctcagaggagaaagatgagaacctcagtcatggtcaagacccctctccgaatggcttctcatccctcagacccacaagagaggtgcatcgtaagctcaagacacctgagacaccttaattctcttccccagccctctctctgtcccttgaaaggatgcaatgcgctggggagatgaaaccagtttgcatcttaggaaggatctggattgttttccttctttctctgagctgtcacttgctataaaagcgatcattgatattcagccattatgccattatacttccataatcattaatattcttaaaaggctcttgaaacacatttatacaaggctacatgatcagttcctacatttactttcaatttaaataacagttttagccagggttttgatgtgctgtttactttaattaccatcctgcccctttctgtgtcttgacacagtgtcatttaatattttatgaatttcccttagccctttttttccctgatatgtgtgatttgaacgggttgctgcttttttagaaaaaaatttgtagttttaacttttctgagacttgctgtaaacaagatgtgtcatgcctatggattctcttcccccagtgataatgggaggaaataaataaaacagcagacagctgctttacccagatggcacagggatgccagggggttctggccctgctgcaggcacagagtgacaggccagcaacttcaggtgaggtgggaagcagcccagaagaggtcagcgtctgcctctcaaggtgtgggctgtcagcatgaggatcacctgggagccccactccagaactactgaggcagaagctgcattagaacaagatccctaggtggtttgtttgaacactggagtttgggaagcactgcactaatggaaatcaattagtggatgtaaagaaaataggcatttcacggctgttctctcccaagtcccatgctttcatcagaaaaaaagctctacttttgggatctatggcaggttcttggggtcatttataaataagtgctatactttaaatactgtgttcatgatctgcttcaagatttccccctctgttttttcagtgatccatttgtttacttaagaaatatttggccaggcgcggtggctcatgcatgtaatcccagcactttgcgtggctgaggtgggtggatcacctgaggtcaggagttcgagaccagcctgaccaacatggagaaaccctgtctctacgaaaaatacaaaatcagctgggcatggcagcgcgtgcctgtaatcccagctacttgggaggctgagacaagagaatcacttgaacctgggaagcggaggttgcagtgagccgagatgtcattgcactccagcctgggcaacaagagtgaaactctgtctcaaaagaaaaaaaaaaagaaatttagtattctatgtactaggaattacagaaagtgataaaggagactgtgtgatatggtcagtaacagagtgtgtcaaagtgctaaggaatcacagtggtggagactgatgagcaggtcagagaagttttcgttggaggggtactttctgaacgattcttgaagaatgaatgggagttaggggtggttggggaggacagtgttaattgtggcaggatggggtttgtggttggaacggtgctgtcttctggtccagctgtgcctggctccgaccaagggcagggtcaatgtgcactgcctgcagcaagcatagcagtttggcagggaggctcataacggggcgtttacccatcctcagaaagcaagggctttcctatgggactgttgttggctgctgcctgatggaggaacatgcactggaactcggggctaggaggttacatgcaaactcagttctactaattgctagttggggcctttgatgacaccttttatgtctctgtaaaagttgtaaaatgtgcttctgtgagggctagatgagataaaacccatgacagaaactggcagtcggtagtaacattagctgggtctgaacgtgaatccacgtttgacgagtacgggaaggaataatagcaaagacaaggagaataagcccaggtaagcatctctgggatcctagaacaacagagaccattgcatgaccaactggggagacagagaaagagagcttccaccggccccatttcccacctcctccacctactctttgttgacacttaatatagaaactaggcctgtaactggcgacagatcaatacttccactgaagaataaaacctctcatggggcagcccagaccagggatatgatctcaataatgtgcgtcggggaattggggcttattggagaaggtggctttggaggtaacaggcagctgtcaggccccagaaaatggaaaagaagtggatatcaaaacctgtaactctggtttagggacagatattatttccttgtctctttctgtaggaactgaagtcaattgccctttaggcagaaccaaaccaaagaggagacataaactcattttgagtgaacaaatccagctaaaaattactttctcattgcttcctttctcagatacggcatttatcatgggtaacagatgaatggataatcttaatttaaaggcaaaaataagggggatccttcctgatactgaaggtacaaaataaacatcccagtatttccaggcccccaccttccaggcattggcaattcagcagaggtctgggtttattctccagttattactgcatttatgaatcctcaattagtcctgactttgcttgagagtttttatgaaactgcctagcgtagtgcctagcagagagtacatgttgaatacatttattagtttctttctttccatagctactgctgctggctaccttgcatttctgtggatttggtcacaagagggattgtctagagagaacagatggtctggtttactttcaattgtagtcacagcaataatagcaccatttatggggccatacactatacgctagaagttttacacacatttcctcatttaatactcttgtgaaatgtgcactatcatctccattttgcagataagcaaaccgaggctcagagaagtgaaatcatttgacaagtcatacacagctaaaacgtagatgccagagccaggatttgatgagaggtccccgtgacatttcaacccaagctgtttttggtgttcatatcactttctaaacagagaactggagagctggaaggaccctcagagatcatctgggccggtggttctcacctgggggcgattttgtccccaggggacatttgagaacatctgaagatattttcggttgttacaactaagtgggggagtaggggtacctgctcctggcctccagtgaggagcccagggtgctgctaaccactctgcaatgcacaggccagcccccatgacaaggattatcctacccaaaacgtcattcgtgctgaggttgagaaaccctggtctagaccaatctcctgattttacagataagaaaacccgggtgtgggtaaggttaaaggtcatgctaatgtccatggacaaaggctgctgggaatcaccatacatcccccacagtcctcccccaccctgtgctgcccaggaaaaagagctcaaagggagtgccccagactggctgtcacaagcatggtgtggaaaggtcctacttagttttccagggagccagcaattggttacatcagaaaactttattctcaggggcagtgcccttatttagatttcagggaaaagcaaaaacagctaaagttttctcaaatagtaagtttcccaatttgctccggttgataattttctaatgtagattcagtggaatctgcctgagagggtgctgagtggggatgtgcttgccaaggggaaaatgaatgtgtcccctgattggaggccggcttgtcagacaactgtgactgtcagcacactgggctggggcctggcctcaggaagggagtggggaggagcagggatggggcctggggctcaggaagggggcagggaggagcagggatgcaccttcagggcagagagggtgctggtggatcccagctccaaagcacagagacggcacaaggcacagtgggcagggagagggcggaggagggagtgaactgtcccccctcctctgtcatgcctgcatcactgcccgggcagtctccacagtcctgggggcctggggaaggagtggaggggacagacgatggtctcctgagtcacaccgccccatggattctggggaaggatctgggcaaatctgcagcagctcggagtctcagtttgtttccctgctggtacgacgatggcagtaatacccgtgctggataaagtgagagactctcgagacacacagtacatgcctgcctcttccccagctcggaattctccagtagaggggggcatttttagacacagtgagctagaggaggcttttttcggtttcttaattctaaatgtttaattattataggcacctaatagttgtatatatttatggggtacctgtgatgttttgacacaagtatacaacatgtaatggtcaaatcgggataactggtatccatcaactcaagcatttattatttctttgtgttagaaacattccaattctactcttttagttatttaaaaatatacactaaaatactgttaactacagtcaccctgtggtactactgactattagatcttattcttctatttaactgtatttttgtccttcctcattaaccatcccactttatctctcccttcccactacccttcccagcttctggtaaccatcattctccttagtgagggctgctgtttgcagaatgttggccagggcaggagaatgtaaatacacgagtatacctagaccttccgatatgccagctgccaagcatgtgccaccaacatctaagcccaggaacaaaatccgacgcattttcattcataggggaatgaaattaattaattaattttgaattaatcataggggagtagcctccaacagcccctgttgccccctccacccctgtcttgccttatctggtccttttcctttgagcaggtgagcgctctcttgcttcctcactcagagattcccagtcacgggctgcagctggaagtgggtttcacagaaggtcccaggctggcctcacctgatatgctctgtgtggacttcacttgagtcctcagtgccaaaggcaggactgtatgtgatgcggggtttgcacagagcactaatggagtccgttagtattcagactgagtttcctattttttttccccctaggagtgcaacactgtggttcaatatttgctgggtggtaattaatagcacttaatctgtaaatctggagctggtttctcatctgctgagaaatgaggttaccatagccaccccatgtttggctccttctctccttttcccttcccagaaatgtccttttgtgtttttctcagccctagcagggctcacgacaagaaggctaaaagcacccagagagatttgctgctgcattagcaggcagctacctgaaagaaaagtttatgaagacgagaagaaatgggcttccacccacctcggaggcctgatgtgctgtcacaccagacaatcctcacaggcagaggagtctcttattcttccacacagggtcctaaacaaagcatcttcggtgatcaaactatgatttttttgactgcctactgtgttccaggtggctcagatatatattatctaattctcataacactacaacaatcttgaaaggcgggtatatatgatacaaacggtacaaatgaagaaactggctttcagagagaccaagtaacttgctcaaggccacacagctagaaattagcaggatggaaactccaatccagactgttctggctccaaagccaaacccttccacccgttccgtgctattgttggagatgtgaattccactgatgtgaatttctagccttctgcatatgacttgcccacagagcattaggtgatacttatagtattaattcgactgccttttggcatggttatggggcttctctgcaaattgcttcatcctcctctgcataacacccttgtgtaggaggctgggtagacattactaaattactttcactttacagatggagacactgaggccctgagacatgaagggatctgggtaaagcaaaacagctcttgagtagtatttgctctgtcagtcagtgtgccaggtgcaggtagcgtcatgtgccctacctgggtcttaaggaatgatgagatccaggcagctggtgctgacagtggcctgttcatactcttcctgaaggtatgtcacctggctttgtatgacagcatgttaacaacatctgtaatttgggcaggagtgaggagaaggaaaccacagttaaggtatgtgtggaggtactatgcaggcaaaccagcccacaagggatgctctggtcactggtgcagatgatggaaaacacctaaaggagaaccgtagccaacactgcaaatcaggcagcatgtatcagagtttaaaaacctcagggagttttgggccagcaaataaaatgtgctccattttgccagagctgaggggattgggcaagaaggagcacttagaattttgacactgcactttgatcagtttgacgggtttagtattatagaaatatttcattgtttcagcagagatgaggaaatctaatcatccatacagctgcactctgaatttgtcatgactcactggagggtagggtgtatggagggagggggcagagaaagaaaggaagaaagaaagaaacagctgatttaaaatgcagtttaacctgaggtaatttggcccattagttcaaattgtgtttttttcttccctccttcttttatttaagtcattgctctattttcaagatattattttttagaggtggcatctaattatgttttctctccacattcattttgagcaggtaataaaggctatagtgggggagttctacggtgattaatggaagaaaatgcagatggggctgaattgaagcaacagcatagaatatgattttataaacaggatagaaagaaattaaagtgctgcattgctaaactcagtggagatggtattcattctgtgtttggtgctgcagtagtggtctggaattgtctgcagaaaagtctttctggatataccagaccagcctttggtgtcactaggtcctctgacttgagtgtgacacaaaagccccccactcacagatccctctcctacccaggagacatgttccttatatttgtgatgtattcctatgggcaaagtatcgctctagcccagcatccccttttgtcttgagagggaaggccaataagataataatcccttagcttgactgtggctccaagggggaggtgctagtagaggggctctagtagggtgtcttgatggggcacaggggatggggctagggacagggagcacaaaaatggcctgaaagataaatttgtatttttgcattgctgggctaaaatatatcctttccttgttgggagcagagagggtaatccttgttagatttacattaaaatgaggtcgtgcttcttggaaaaagccactcactgagaaagaagatatccattgttccatgagagtcccccatggtagagtgagtgacaaggttcttggaaatatcatcagatagtgcttactttggggctgagtgagaataggaaagtggcagaacagggaaaaggttccaccacaaggagctcattcctgcagacccggaatggaaaaccatctcctggcattacataacacaggccaactctctcttcttaacaacaggaagaggcaattcaggtcaaagacagactctcctttcctatgcagagggctcttgtcactttgttaatttctttgtttgtgcttcaccttctgttctccatttccacttttcccactcccttggagcacagatccaagttttaatccagatgcccataatgctgctcacccatcacctacctgtgatatggatattaatatgcatataattttaatgatacagtctttatggtctttcaattcccttacttaatacttactatttctgtgtttgttcatagtctgttggctcccgtggggccagcacaatgactcttgcaggtctctgtaattcatacggagccagacactgaactccaccttcagatatcccatgcccatgtgttgagggtgacaaggaatgatttctttcatctaaccagagttcaacaaatgcgtcttgatcttcaaagaaaacacctgagagtccacaacaagggccataggatgaatgggaacttttagtacatcggagagtttaaaaagcacataggggaatataagttgaaaagggatattcggcaacaaatcagactcttgtgcatagaaaggagagatccctaagtggagaggatgtgaaaaattcagaatgtggggctttgctcatggagattgtagttcagtaggtcagggttagaagtccagaatcttctcctcaggcaattctaatgcagctaacatttgggaaccactgaggtcttggatggctcccaaatgaagaaactgaagcctaggaaagttcaatggctcatccaatgccatacggctaggtgagagggggagagtgagactaccattccattgctcttttcattaaccttaactccaccactcagcatttcactagcagagaatgttggtctgggggtaccaggaggttgaatggaggacgcttgtgctaagaagggagaactatttagaacacatgtgaaactctatttacaccaagctttaaattgaacttcccatttcccagtttcagcttccagaatgcaaccttaatcttgttcatttgcataagctttaaaataagcctttagaacaaatgtaaatggatcttcaaagaacaatattatgatgggttcagtgtaaatgactcaaaaacatatggatggcatttcttgaggatttcccagagagtcttgctgtctgtctgtatgcaagggaagtttattatcaaagcaaaactgggggttgggagaagtgtggtattcttaggatagtgtatcctaacctgcttgtggttctaatttattttcatgcctcagtgagctggactgataatatggaatggccaacatgaagcagaagtcaatctcttcgtcaggctgaatgtggctcacagaagcatctcacaccccaggtcataagacacacaacatggatctcagaactggaaagaacaagagattttcccataaagctcccctcaccatgggcatgaggaaaccaaggttcagagagggcaagtgacttgtcaaggtcacatagccagtacatggttgaactgggacatcagcctaggtatgtctaactccgaattttattttctctcaaatatatatcacctagcagctaagaaatcagcagacagtggactttagaaccaggcaggcaaacacagcttcagggtgaggttaggcagctagaacgttattgatcaacaactttgccacatcactggcacattcgttgctgggcaacgtggctcctctctgaagaggcaagaaaaagattctgaagatgatggatctgcattaagcaaaacccaataaccaggcactttcaggtcaaaaacttggtttgctgtggtttggagtttctaggtcagctgcccaggggctgtcccctgctcagcttatctgagatgaggccatcagtgaggacctcctcagagagaagagacaggaaaaccaatttaagattcccttagacagggcagatggagatatgggcttgttttctgcccaatgttagtattgtatcttatcttacagctaggttgaaattagagtagttggcaaacaaacaaacaaacaaacaaaaaaaacagcacaaagagatgacttggggatgggaggtgggtgctgctaaacaggggcaagtcatttactgccatgggcctcagtttccctatttatagaacggtgagcctggactagcttcatgttagtctatctacaggtgctggctggctataataatcacctggaatgtttgttaacctagagactctgaggccccaatttcagctattctgatttaggaggtttgacatgatactcaacaataatttcatccatgctatcagaggtatttactgcatgtctaggagatgttctgggctctgtgttaggtactgggaatataattgtgaatgcatattgaatgcaaagcactatataaggcaaatggggtatttaaatctttaaagaagaattcttgttggacgaatggcagtgtaatattacatatgtgagatttagtcagaattggatttgaatctttacttttctacttactagctgtgtgaccttatttatgcaatttacttaacttctttgatctcatctctaatatggggatatgattacggtgcctacttcataggatggttgattattacatgagataatctggctgagttgctcagcacagttcctggaacatagccaaggctcaccaatggcaaatacacacagattcctggggttttaggagcttgtaggagtgtgtgtggtatgtatatgagtgtgtgtgagacccacagcatgcatgcatgtacagtgtatacgtttctcagaagaaatttagtgatggggagactactatatttctgcttggcttcatcaggatggcctcatggaagaggtgacattagatttgggccttagcaatgggcagaattttgataagcagaaaagaagaggagcagaaaatgttccagaaagttgggactagccaaggggcagagggcccaggaaggtggagctgtgcttgggaaagtggtggacaggccattcatggaaggcttccaatggctgaagggccttgggtgccagtcaagggacaaaatggacattggtttgtcttctgaaacacacaactttttttttttttatgggtggaaagcctttgataagcatttgttgaatcaatgactgagatgttgagcaggggagcagccttttctgggaggttcacccgcaggaggtgtgctgaccagagaggatgaaagggaagctggaggcagggaggtcaggactgccatactgtcccagacatgcagaacaggctgctggactagacggggacaaggaaatggagaggtggcgcaggtgcgaaatgtatcttgatggaagcagcaccaagttctggagactgatcaggaagcaggtatggaagaagcagcagagacctcaattttcaaagtgtgtatctggaacaatacagaacagacagagccactaaatggggctgaggaaaagcactcagagcctttccaggctaagccagggctccctggcgtgtgccccatggtgctggcaatagtgtctcgtggaaactaaggacccgatgaacagtactcgtattactattctttataatgctcatgccaatgtcaatgttttgaatgctgccttccctgctagaatataggcttcatgaggcaggtactgtatttgccctgttgcctgctctgtccctgacacaataaattgtgtctgccacatagtaagtgctaaaaaaaaaaaaaaaggtgggaaaagtagctgagaactggtttactgaggaaagaagttgactcactttcagacacattaggttggaggtgatgcgaactgtcttgctggaagtgtccactgggtagttgcatattctggttagaggtccagtttcaagagggagaccctggtcaccactgggcacctccttccacgccaggtatcacctccctgtggccctttccttgagaggatctcatgggacctccttccaaatccatccctagtctcccggccacacatactggtttctcccccgaaaggctctgaatttgagctgtggtgatatctctgtgatacaggatagcctcttttgcctaaagaaaaccactctgaaattgcaggctttcaaatgaagctttgtagtacatgctatagcaattcaaaacggtggagggaggggaagaagtctgaacaattgcttagctcattaaaaacagcatttggttcacatttcaacatctgaaaaaaaaagacaaaatggaattttacaatgtggtcacctgagctaagaaagattagtgaagcaagatcaagatggaaaacaaacaaacaaacaaacaaacaaacagaaaaacaaaaaaaaaaaacaaaacccaaacaaaaccctcagataactggttgcattactgtgaatacttggtacggctacttccagtggctctttatttcccctgtaaatttgaagatactggcatgaaagccaaaacaggagatggggagataagaaaaaaggtattcaggtagtatcaggtggtctaaccactgagcttcacccccttggtgctgtaggtgagagcttagcctgcagtgtctctctggattcttttgatcattcattgcttgaaatgtgggtttccataacttcacaattcacctccaagatgtagactgcatggattcccaaggaaaaggacatctgaaagttccagaggccaggcttggtgttgggcgtttatcaatgtacaagtccctccctgccttactcctgaaaggggcacactagtggttactatgactagctggagcctgcttggcctctgtaacaactgaagctgctggccaccctgccattcctgaagggtttgtgtctctctttcctccttgtcactgtttgcttttgctttctctcctgccactccatctgctttttgttaggtttctttgtggacttctacccaccctttaaatgttggtggtccctgagggtccatagagattttcttaattttgtctacattccttattctctttcacctatccggcaattttgaaaagaaatttctatgtgccagacaccgtcctgggcatttggggatatgaacatgaatgatgggcccttgcctttaatcagcgtgtggtttattaaaggagaaactatgtaaaacaaatacaacaaagtgtgatatgtattgtgcaaggtgtcatggaagtgcagaggagagtgggggtaattccgcttgggacttcaggatcagctttcagcaggaggtggcaatacattgagactccctaattcatttctgtggccatgaccacccctgtcttctgagctccacacttgagtttcagatgacttgccagacatctctactagcatatgctgcggatacatcagactcacaattttcaaaatgaaacctcaacctccttacattgacattgccagccacccagtcacccaatctggaaacctgagcttgattctggtcccccctctccctccctcacctaaccacaccctgatctctatgatcaggtgtatctctatgaaagttctgacctgcctctttctacatgaccacgaggtctgctcaagttcaggccctcgttatctctaacctggagtattacaagtattgcaacccctttccaactctttggtcccaaaccccattgtgcttagcaagaacctgcggagctcctcacacactcacatcctgcagtccctccccttgagattctggttcaggaggaacagcctcacgtggccctgagaggagtggtttgtggaccacactgaggatagacagtgtctctctgcttttagtgtgctctgttctaattagtgctggctgcttccagggtatattctgaagcatagacatgcttctgccatcttggcttaaaaacctccagtggttctgaacatcttcacaaggcattgaagacctttcctaaaatgactggaatcgcctcagctgtgtagctaacttgttttccttccccatcaaatgagcaagttggcctcatagcatagagcttggctcttggcttagtcccaggccagcaggcctcatacctctactctgccctgacaagttgtaaccctcagtaaataacacaatcagtgtatacttacaaaggctgttgtatgaggattaaataaaatactggggatagagctctttgctcattatctagcgtagcgtaagtcctccatactgaaagctagtaccgtcgtcccatgctcttccccattatgtcctctacactccagttatcccagaccatttaccattctctgattaagtcatgcaacctcatcgccactacctgggactgtctttccttaattagaaaactcctattcatccatcaaaggcctgctcacatgttccctctctgcaaagcagtgctctctgtggtcgtggctgtgctcacagaaaaggcactgtatatccctctttcgtggtattaggaacctggtataactgagagcgcatctcccttgagttccttgagactagaaacggttttatttattttggaatctcaaacctagcaaagtgcctgtcacagagtaagcactcagcgccgtgaatgaaggaatggggtgagggaacgactgtgtgcagagagtcatgtgagaacccctgttcccctccctctgcttggcagagctgtcctttgtagaagtgattctcagtggcccttgccccttagcaacctcaggtcaactggaagactcccctccagacaggcgttgcggtctttccctatcccacagggtctagatgcggccttcccaggtgactttctgctctactctttctcagtctccatctgacccgtgcctagcatcgtggcccctgtaaagggctcttccattaataattgcctccctagtgactgatttatctgctccttgaatctgaggaggttcaccttttaaggtgaaaatggccagtcactgaaaagctgaattgtttttatgttattcccgttccagtgacttcagaggtggcccagggcccatcatttgggggcaagaagctgcctggatgctttctggccttctgggtgtgcagacaatctcactgtttcaccagccacttccttttactcccttgcccaggcttcagcggcagaagacagtgtaagccccaggaaactgtgacagcaataaaagaactaaatgttttctaggtcaccgcctgatcaagtccccacttaaacaataatcttgccattgcatctgcaaaaccccagactcaggccccaaaaggttatttcatcaataattcttgagcttgcctacggcgagaattattcccagcaggcgtttcaggccatctctaaacaggctctgtggaggcgaggcctggctccgttcaagtgcttaggcagggaccattaatattgttgaagggcaagggcggggcaggaagggagggaatcgtgtgctgtggcaggaaagaagaggcctctgcgggaagggggcaggggcaggaaggccaaggctgattcggccttggtctggcaagggaagctgcgtttcgtggtaacaaatgaggattaaaccaggccacgtgtgccatccatcgctgtgataaaagcctctctgcccaccgaaactgtgcatgggatccttttgtaatctgtaggcttcagtctatccagtgcctagctactgtgttgttgaaacgagcttctttgatttactcagtgtatttaccaagcaatttgcaagaccaagtaattccttctcagttcattgcctcgtaggtgggagagccgcttaggtcctcttatgtgacctccatccagccttcctgggccttcttagactcctgttcctatcagcttttcatctcctctccctgcagtctccaggtggcagggggttgcgaccaccttccctggagagtctgggcctctgcccagtcactcctctgagccatgaactttttgctattgtgctttccatctcccgctccaagttgacggctatggcaccttgtcctccctgctttggagtcagtgatgaattccctccgttcatttcgactgttttcgtggaggtatttatagaccgtgattgtgttcccgctgagccggatcctttctcaactatataaatttgactctctcgctttctcccgatacgacttatctgctaatccctagaacatttgttggtatttatgtcttgcttggattttctacaccttttctaaattgctccgacttgcgtggttcaagttaccccattcctcggtgctcaatcaaaagagcctcatctccccatcctcgccggtttgctcctggggacatcatctgctgagaaccagaaagatcgtgcaaggggagaggaggttaacagatggctcataattatattacaagagcatctctaaaggaaataggatcatttttcaagtgacttctttaccaaagtcttctgtttcaattcgttctccccaccccagcaaaaagtccctcttaaaaaaaaaaagtcagccattcatcttccgagaagaaaatacaaaagtccacccagtctttacaggggaaaggagacaaatattaaggggtggaggtgaggaaggtgaaagtgactgctgtgatcattttcataaccggaccctcaacatgttcaggctgcctgctgaagctaggaagtccagaatgagatttatcaactctcaaggccacggaagaccctagagattgttgtctaacctcattttctacgtgtggagaccgaatcagggctgtgtagagaaaccagtgcgcgttttgatgccactcattctgggttttcaggtctgctcatctgtttactagaaatgagtggttctggatgaagtttcctgactttactgaacttcagtttagtttcctcatctgtaaaatgcaggctgtgctacttaaatgggggctttttgtggatattgaaaataatggatggaataaataagtgccttgcacatagtaggcacagaatacacaatcattgctactgagtcacagagcagtgaagccacctgcccaaagccactttgtcaaacctggggccagaacttggggcctttatttctcagttcgggacttctactatggtacttccttctccgtagccaccccattgaacacatttctgttccttgaaggtggcatgaggatgttctcaactatggcactctggttgtaaatatgtttgatgctcctacgtgtgggtgctcgaagcccacagtgaagcttcaagtgaggttagccagagaggaacactcttaccctctttagaaacagaagggactggagaggtttggctgagagacttaagaatgtagtatgaacttatcagtgaatgtagcagctaggcttttcttagggcaactgggctgggccagggtcactagcctgagctgtggctagtggtaaagcttctacagaactgtttagtgggaaagaatcaacctgtgttgccaatcattctgctgtgtgatttacaaatgccatctaatttagtggttccccagcttctggttccctgacaccaggaagtaggtataatgtttattattttataggtaaggaagctgagacctagctatatcacatggattgtccaagctaacaaatggtagtgcaaacgttggaactcaggtcctcagtgactgatgctcatatattctttccattttcatgagtactaataaaacacatgatagttatcactttagggatggctttgatttgcagggcacctctccctaaggtgctaaacacatttatagatttttataaatccaattaagtttattatcttaatatgatcttgtctaatttatccatatggatgtgtacacatgtgatttggacaggaaaatcaatttaaatgatttggaccaaatgtattttatcttatgtcaatgctgtggaatttaccagagaattgatgaaacttcatgtcaacagtatagacacactgtcggaatgcatcctgtagcgccacaggactcaggctggatgaacttccccctcagctcattcaatccactcctctaggtctaaaaggaagcaagctgtcttattctgaaaggtcttcaaggacaaccttcctggatgcaccatctccttgtctcacaattcttcacagccagaaagttcttatgcctaagcagaatgtctattgctttgagcgaaccacttttccttctgttccattcttgctggctaaggagaacagctgggaaggtttcaatatctctgttatgaacttgaaagctgttttaaaaacactgctcaagtttctcttctgctagcccaatacacttgattcttttagcattcgtcacagggagagatgattttctacacatccagccatttgttaagagagttacgatgattttggaatgtgagatcttaggggggcaagagtgaccactggttaaaaggctgcacaagtaatcatcgcaatatctgctacaagtggatcctcactaaatattctttttgaggaaaaaaaaaaagaaaatagtgagaactattgctagatcctggtgtctatctgaatatgggaagggaaaaccatagaggagaaaaagagtcaaatgaaagaggctaaatagggaaaaaagatagtccataccccaaaatttgtatttctctgttagccaaggtagtagaatattatcataaaagtgtggagtttatttcttgtttatttttatatttttagagatggggttttgctatgttgaccaggctgatctcaaactcctggcctcaagcgatcctcccatcttgacctcccaaagtgctgggattacaggcatgagccaccatgccaagcttagaatgtagagtttagagtaagaaagaactggcttcaaattccagctctgccttggtgtgtgacttcaactgagttgcttcatctccttgtgtgtcagctttttctttgcaaaataggaacaatgatgatacctgtccctgagttatgaagacggggtaagctaatgtattgaaaggatttcccaggctcagcgtgggttggttgggggggtttcttgaagcattgtagctcccattattctcttaaaccaatagttgtctatgggtcttgggttttgaaactatcattaggaacttcctcacttttggattttgcagattcctttcctgagagttgaaatgatggctttaaaaaatgtcaggattagttgggcatttatgagttcaagggatcctagatgctaactggatgatgagttaattatgtagctatggaattaacattatcattacagtgctaataataataattgcataatagcattattcttacagcggaataagaccactgagtgttgttcttgaaaactgatgcagaattagagaatacttaactctctcaagtttgggtacaatttctaagaatctatagtttagtgactcattggcactctaatgactactattccccccccacccactgcctcccaagattcacatgtgaaagaatgcaaattcaattcctcctgacaaagaaatctaaattcatggattttcccagctgtacccttgagcgagaactttcccaaagtgaagagcatggaaaaaaacaattggttttgcatgtttccttgggaatttcaggaggaaatggagctggaaaggtggtgttggaggcacggaaatgttgatggagaaaagccctcttctttgtataaaacatgtgccctttgttgaaggaagtggtagcaggctgccatgaacccagttttctgagctcttccagaatctcttgtgataatattgctttgttttagctgagaaaccttggggttttatgtgacccatgggtacaaagatcatgatggagacataagccctccacaaatattctaccttcctcaagtcaccatttagggatatggggtgaatgaactcgaggaccagcactcgtccaataaatcctgctctaggaaagacaggagaaacaaataggctaaaagttccccagggcatgaaatcttggtagatgtttgtttgcccgctccttacaccagaggaggcctcaccactcaaagcaacctggctcagagcagacagagcatctggagctgcctcagaggggctccatggcttcctctccaatccacagccagccaggccttccagaaccagacaggagggtgcttcagttactccaaggagccactttgttccatcctgcactactgggatgtagacggcccccttccttagattacttaggaaaaaacaacaagcaaatatcacaattgaaaaagaggcttttggattgcatggtgattttttaaaataaaatgaaataaaagacaattgtgggggacaagagtcttctctccagctctccagatggaatgtctgtgttgattcattgactcaataacaactcaagtgttctattttcttggacagtggagatctagttcagattatattaagatctagggaagggtgacaaatggagtatcaccctataaagcagaggactgagaacctgagcattggatctgagctcctgcctcccatccccagttctccgtatgatgctgggtaaatctcatcaccacctgtctccttacctagaaaatgggaatcatcacatctgttccctcatgaggctccatgcatcttcattacatgcttagagatgattagatagaagggtccacagatcgtattagtcttaactataatggtcttaataaatatgtatgctgcccaagaagggagtgtatggtgttggaatggtttatgtgtcttccttttcagactgggactgggaaatgaggggaatagcctactttgtcactatttatcattcttagttaacaatgtaagatacatgatggctgctaaacaatttggtggcagaacctcataaatgaagtctgttttccctggaaactgcataaccatttgaattaatttaatttgaaatatcaaattaaattaaactgtagaataatccccaagggagagcatatttcatttgcaatgtcttttgatagagtagtccctgccaaaagttttgctttgcatctggctacagatctaaatttattgcattagctttgagaagacttttaatagaaagtgagattaaaagaaaacttgatggaaaataaagatgttcactgctgaaacagcattcctcagaacgtacctctctaactttacactctctatatgtctgtctctggtcttcaattcagaccgtgtaactaggctggatgcctggttgaagggctttcttttgataatgctaattaacatgcacagaaaatatcagaacaaaatgggcagagtctacttggtttaaggcctacaaactgcatgtctttgctagataccgctgaaggggatcgtctgcgaagaaagaatagagatacgagataaattaaagggatcatttttaaagtcaccagggagttcgtgcgcactcagtggtgtcaggtggctgtgttgtcttctttctgagttgtcttctctcttctccttcttaataatctcccgtctaagtgcaggtcttgattaaggctttgggtctacaggttggaaggatagaagctgatggtgaatccaacagtttcctaaaatataggtcaccacaaatcaccacttaggaaatgactggtctctttctccatggccagacattgatgaaaattgtactgagcagctgcctgaaagttgatgcagtgggaataatttatttcttcttcctggtgagcaaatacacagcaagagaggcggatgtgaagaaaagctgtttgcttgacacaaacagggctggccctttaagaaaggtttgtatgagtttaaattgggcccaaggaacccagataagagtatcttaatcaaataaaaaaagcattaggctttaatctccagcactttagtaacctcctagtttgttttaaatcttgattggaagaattatcctgacaagaaaattagtagtaagtcaataagtctgtggcccaaaggtagggcattaagtaaccagagggaaaaaaatgtattcccatccgaggcccttgcctgccctcctgtagccacaaacatagccctgcagacagttccctcttgatcccttgcaccaggctgggtggagaagttcattataattttagccatgaagtcctgaagtgcaggtaatcgtgtttaaaaagatagggaacatgacaggaaaagaacccagcttcatgaagaaattctaattttcagcagtcatgggtggaaaatcaatactactctgatgcgaaatgagaaccggactggataaagccacctcttcccattgctctctttaaaaaagacacacaccagaaagtaaaaaaacaaaacaacaacaacaaaagaaaaaacagaaaaaaacaataggcctacaataggaaaggtctgcgtgctgacactctcaacttccctgagtgcctgtacacccccgcccccaattcttgttgccagagagccctcccctggcagcaatctaattccagctctccttgtcagaatgtgtcttcctgccagcttcaagcaactctttccatgccccttctttgcactttttccaccccctcaccactaccctgaatgcgtgctcgccatctgccattcaggcagagagagagagagagagagagagagagagagggagagagggagagagaaaaaacagagagagagagagagagagaagactgagctgagcacccagcacctaattttggaaactcactcgtaatttcaatcacatctaggtgttatcttgatataagaacaggtatcattaattgactagcaatggaatgggagctcttttatactttatgatccattgagagtggcagctttagacatattggaagatttctgttttaatcaccgattatgtatttggccaataaagctcatattgttaacattaatatatacatatttataactcgatgaagccagacataattaagtagaaatgttcgaattaacaatgatgataatcattcaaaataagattcccatgatgtcttccagcagacgactccacccccaacactgccgtgagaattgtatgtgctgagatgttgttcttctcacccttcaaaatgggctgtcaaatttaacaaatggtaaatagaataataatgaatgtcttcattgtgttgtattgaatgtcatctgtattctaaaacctctggtgttggaggaattcttgcagagaaaggggcttccaggagggcttcagtacaaggcccatgccagtatggcaggtcccttagaaggcatgtcttctggatgatcaggccaacagttgaccaggaccaggacagatgtattgttggtctaggcccctggaatgccagtggcgctatctcacatccctggaagagagtggagccatctgctcatcttggcttcagtagttacatgcaacaggttccccaaggaggaggcatgcagctctgaagtcagcagggagacaggggagaagtaaagcctttcttttgggtcaagcagacatctgctctccattccacctccactcccaatgtgccagcacagctttctccttcctttgctttgagcagtgtatactctgaattacgtttgcagtatatccctgcgtccctgccaaattcactggtggggaaaattggtggtattgtgggtaagctgacttgggacagaagtccatttctcgaaggcaccacctgcactcaagacactggtttctttgagtgcctggccagacatatccaccaagactcaggggtctgtcttccaacaaatgcggctccaattctcacatttttatatgccatgttacacacatcatttctgaacctctcagaagcccatgcatttctgagcattggcaatcaagcataaagttctggggcaagctgtgaaatctctgaaatgaaaatcaattccatctccatttcatggagactaatgtggcatttacaacataaacaatcacttctgttagggaggaaaattaaaagctgtgctacataaaggcacaatgtttaaagttctggtggaaatgagcacttggctttgagatgattacaaagggaattggaaaaagaaaataaaaaaaaaaagaaaagagaagaaaagaaaaagccagccccaacaattcagaagtgcagaggtttcataatacaaatttgctatggctgacaccactggcctcagctcagacctctgggagaaaaagaaaatctttgggcatttcctaagcaatgtgggaaaggtatttcaagggcccaggaaagtcacatctatttccttttttgatagtgttaggagacacagacaatttcctatgggaaagggcttgagacctacaggataggcagggggcccagcagttttagggtcccctcaaagtataggtcttttgaatccttgatctggtgacatttttcattatatcaaccttcatttctgtgttgttataatagggctcatgagtgtctatgtgcagaataccaagatttacagattgaaataaaaattaaaggcaagaaaaaaaaagagtctactgttcttttaaaagcctggaaattagctcatattcaccactagctaactaaggaaatctagtcaaggatctccacctctgaagactcagtttccccatctgtacattgagatactagaccatgtgatactagccccaaagggagctgtctctaaaattttgtcattctcttattctgtatgggatggcaaccaaccattcaattggtatcatttgcaagggtggtggggaaaagcataagttgttgccaatcgggaggtgctcatttgcataatgactgattccctaattagccagaaagacttccagtgtcgccatgtaggagcacaccagagttcctgctgtgacgttacttagttgagctctccgatttggctattaagactctcaaagtactagccagccactaaatgacttttcgataaagctgcccaggcaattaagagcattagcataaaggaatctttctcaattagctatttttagagtgggctggaaatgctatcttgcagctttttagaaatttttataacagtattatgtttgttgtattaccagtgtcacatgtgtatttttcattctatttttgttctgcatcaagtaatttgtagtagtactattttgaggggtagttatttgccaaccatttgaagagaagtcaaatgaatttctgataaaggcagccctcgttaattccaatctgagcatgggacagcccagggtatggcttgtatacctatgtcagccagtcatctcatcagacatcttgatttgccttgatcaaagaagcaatttgtgagacattccctcccctctccccaccaaagtgctaatcaccttttcaaggtagaagatagatgggaaacaccgcacaaattgcttgccattgccccaaaatgctaatcacttacgaacatctaaattatgactggagaccttgcatgataaggtaaggaaacagtgtcagtgcatacagaactattatttaccagtgtcaaaaataactatcgcatttgcatagctgtggcgctagatgacaatttctccctcaaaactgcttccgtagcagaaaaagctttgaccgatatgaagtgtggcatactgttatttttttaacccttacaaaatggaatgagacctcttggaattagatgttagagcactgatttgggaaacaggagctacccaagaaaaacaatttaaaatgctttctttgattatatttcctttgggtgcattggttgctgtcttgtgtaagccaacggtctccagagtgggtcatgtacaccccagggagtcatttgacccttctgcatacaggaagaaactattttatttcttaatgctataatgtctactttgtgggtatttttgttgtatcgtttgagacgaagtcttgctctgtcacccaggctggagtgcagcggctcatggtgcgatctcggcttgctgcaacctccacctcctaggttcaaatgattctcctgcctcagcctccggagtagctgggattacaggcacccgccaccatgcctggctaatctttgtatttttagttgagatagggtttcaccatattggccaggttggtctcgaactcctgaccttgtgatctgcctgccttagcctcccaaagtgctgggattacaggcataagccactgtacccggccatgggtatgttttttaatgcatgtcatatattagaaccagagcacgtgtatagaatttacagagaaatgcatatattctggaggtatgctcatagtttttactgatggatgttagtgataaaggaaaaatctgtggagatcattagacaacacgtagcatcgtgctggccaggaagatggcctgcttctaaggagaagtttctagagggacaagctcattagctgtagctacaattatattgttagagaaggtatttccatgacataaagaagcctgcttatgagcactagacataagtatatctaacatcttgcacccatttctattcagacaataatgaaatttactttcctacagttataaatatagtctctcaaagtgaagaatcacagattgaattctttttggggtaggaaaatgcatctagaataagagacacgtcagagaggaagggccaagatgaagaagtcgcaggaaataaaactagtttaacaagcctgagtacctaggcttcctatattaacacagacatcccatgccaaccccagcgcaaccccaggactccctacacagacagaaagacctctgagattgcccaggcaactggttttgatctagcacagttttcttcttatccccactggccctgtcctcttgtctctcattcattcaatcacaaatatttattgggtgtttaggatgtgccagacatagttctggcaatcttgagatttttctttccttcctcctgtctgtctgggggtcacccataggtctccacgcaggaatttcgagaggctgcaaactcatgattcctatttattgttcattgctgccctactgagatacctagatcatcaaatatgtttcaaacagagctctagcagtgggagtagagatgagaactcatagagagaggagccttctatgctcagcctaactgctctctcacttcagaatgtttcacctagttggtcttttcagttcgcatttctgggaacatcaacaaataccccattcatttctgagaagctgcttcatggtcaatcttgagcttattgctggagagatccaaagaaacaccgaagaagagtcagtccctgttctcattgagcttgcacaagagttggaggaattaaatacacacctaagactatacagaagcaccatcacagagcaggacatgggtaagtgggagagctctgttcaggatctattcaggatctgcaggagttgagaggctgttgtgatatactggaagcagtctagaccttgaagtcagaccattatgattccagtctcagctccatcatttatcagctatgtggccttgggcaaaccacttctctctctgagtctcagtttgcttatcaacagaatgggaataataatacctattgataggattgttttaaggattctgtgaaacagccgatgtggaaaaacactttataggctggaaagttgcaatgcacattttaggaattaccattaatggagggtaatctctctggtctggagtggttagagaaggctttattctgttatccactgacaccctccaggacagataccgttaaacataaatgaaagagggaagatgaagcccagttgctctatgcattctttactgctggaccatggaggatatatggaatgggtgtggaggtggctcacttcctcctgcctgcttcttctgaagaatctactagggcttggaatacctgtcttgatcattctgagaagaatggaaacactgggaagatatggtgttggcagggactcgggaccctgcaagacccagtgggaaaggaaaggtggtcaggttgtcaggcccctgcactctgcccaggcaaaggtattcacaaacctccctgggggctcaccagaggggactgtgatgagttggcttctcaggagtttcctactcgctggggcctgtgaggcacagcaacttgcctgcttgtccccagcaaagggcagtgtccagagtccattcttcctgcctcatcactgaggaggagcaagacaaccccagtcccagccctgctcctttctctttcaaggcatggttaacagttgacagtgcaatgtaaatgctgggaagtgtcaagattagtaaacaggaagaggatttggaagctaaatgcatgcctaactcaaaggacagattatatggttacactgttattactttgagacatagttactctttcttctaaggaatcttgtagaaatgtgattatggtgtagtttgtgtatatcaccagatcttatgaagtagaccagtgggccccactcagcccctgggggctagagaagagttatgagctgcactagtttgtcttggttttatcttcattcctatgaactctcttgggaagaagtctccctaggaagctgctccccgctttcaatctcattttctgatatctagttgtgaatttcctataattaaatatagtttgggctgggtgaggtggctcaagcctgtaatcccaacactttgggaggccgaggggggcagatcacctgaggtcaggagttgaagactagcctggccaacatggtgaaaccctatctctactaaaaatacaaaagttagctggggatggtggtgtgcaactggctaccaccagttgcatgttgaggcatgagaatcacggaaccctggaggcagaggttgcagtgagctgaggtcacaacattgcactccagcttgggtgacagagtgagactgtcataaataaataaataaataaataaacaaacaaacaaataaataaagtctggtctcctggttgttcaccttggcttactcatctttccttttgcagatgccctggtgagtgctgttctgaggcaagaccaattgactacaaaaccaggtcaggttaggtacccaaggcagatgtgcaacatttattagaactagtgccaactgagacaaaaattcctagctgttctttaaaatgcattcttctactcttctttagctactgttaaatattagtagaaaataagactgctcagaaaaggcacttcattccccagcctcccttgccgctatgtgatcaagtcttgggcaatgggaggtgagcagaagggctgtgtaaaacttccagatgaagcctttcccatctgtttctcacctccccgttgaccagaatctggtcacagcagtgggagctggagcaacccttgtggactcagaaatggaaatcaggctcttctgtgtacctcctgatgctagtgacagagcaataaggtcttttctggtttcaatgttgttaagttgagcctttgtcacatggccctcaatggagacctttgctctggagatcttcagtggaatacctgagagcgtagactcatgtcacagtctctttcgtcaacctgcttggcaggctatctgtggcttaatgccaagtggggtctcgagcaaaactctattgaatttgggaccatcttttgcaatagcgtctgcaactcacgattgaccccaaatttctcctttgtttcatttccctttggttgtggctgacagctgtggggctgcactctcagaggccacccatcctcagggatcctgggattcaactttgagagcataactaggtaggtagagaggggctatgcccaggagtattgccccaacttccaaacacattcctatcctcgtctggcattgagagaagagtgcaggactgggtttgagagcagattctggctctgttgtcagcaagctgtgtgatcttgaacaactcctcttctccctgagcaaaatgagggggctagatgagacgatttctggaacatctcccaatgtcggcgttctgtgatgtgacaattccatgaccagcctcatggctgaggtgccactttcgatacataaaacaagagtccacatctgtgccaagggctgggcagggcagtgctcctcacttcctccatctgctcagcacccaacagtgctctgatgcagggggagaagagcagggagagggcatgaggatgcagtgggtgggaggtgttaaaaaggggactgatggtggggtccttcttttgagaattctagtctctctggggccacatgacacccgaacacacagaatctgtgggaacaagttacccaagaaatgtgcccaggctgagggaccaaggcccagcgagagtaggtggtaggtaggcaatggccagtggggccagcgcgggtttgaaatctatcttccccatacttgctgcatgaccttcaatgagttcccacgcttttgagcctttgttttctcacttgtgaaatggggacaatagaaacacccctctcaaacgtagggaaagcttgtccacaaagcacttgacacacagtaggcactgagtaaattctagcttccctggtgtcccctctcctttcctactttgaaaacagcagtctgtctcattaagtatcctacttagttttcagttgacattcccactctcttaccttctgccccctgaatttttcctctcttttcctgtatcttttttcccccacaactctgcattcccctccccatccacagcatagttctcccatcattccttctttgtagagggcaaggaaaggtgggttatacagatgcccagtgatatttcagaagctctaattaagtggaagattatgcatgccatttgagttttaaaagacattcagatcagaatgaatgaaatgctaacttttcccctgtctaacccactcacccacataccctggggcaaaatgaaacataactcagtttttcctggaaaggcatcagacagcaggtcgctctggtcaatgggcccacggcagcacccactgtcttggcaaatgtccattctgtcaggcgccctgcctcttgccacctctttcttagctagatacagatggaaaaaaaaaatgacagcattgggctgacacctgcatcgaatggaagctacacatttctgtcctagagataggtggcagtgtggattcagggctgtgtggttcaagatcaacttcgcagagaaacaccgtttccagaagcagtgaggatctttcatcatatgcgcctctgatgctcaacaaccttctttgctgcacccgccgctgcctcatgaggttcctggcagctcttactgcgccagtaacaactggatctcaatccccaaaacaattccctgctcattctatgagttacagtttagttaatctttggttagcacatgcacacgtgggcacgtgcaaactctctcagtgtaggctctgaatgctgcttttatgttattgcacacatgagtggaacatactatccagcttcttagggcctgtgctgtaagcctccggggccatataaacgcggctattttcacagtccaacttcagaactcagaggggcagctctcctttggactaggcctttggcaggagtcctctactctcggcctggatcctcttcaatgaaccacctatgtgtcacttatgtcaatatctcagctctggtttttcaagtgcaagggttatttgctatattttggaaacttttgagggtacaaatagtatacaggtcaaaaagtaaaaggtatcagcttagagaatacaaagcaggcaatcatgacattcctagagatggacaggagaccatttactggagatcagagagtaacaaagagtttctggaatcttcaagccatctatggttgcagaatggtaactgagaagcccctgatggtcaccaaataccctggcccaactataccccgtggctctgccagttctttccattgactaaatatcagtttcctcatctgtaaaatacagaccatgacaatgagcaaccttcttaggtggaaataagatgaatcttgtcaaaattgtcttcaagcttatctacacatgagagtcaaaccctcaccccaacaccacaaagctaagcctctgaggtgtgtgtgcggggagaaatctaaaacgaaaccagcaacccactgccatgcctgctcaaccaaccctcccagagcatacggcttttactcttccttattacaggtgttcataatgctttatctcaacgggtctgtgtctcctgcatttagctgtggaataaacaatgttctgataattgctgggtcaccattatttactactacagttatttttatttaagaaagcccctttccttcgggctccagtaagaaggcaatactataattttcttcactgtctccctttaatgaggtcgaaggccaggcaaagggagtcaggcagttttcggggaagcaaccccgcaacaaagctgacctcagccaggagagtccaacataactcactcctcaggcggattaattgttcctggctcctgcagcctagctgaaaagtgaagaaatgatgacaccaggcactctaactaggttcaagctcaccatttctttttctagttaaatccttccccccaactcccaatttgctacctgggcaaggaagcccctcccttccccccataatcaagtgctctacaatttccactgtaactttatgttacagaatccatcatcagctacctgagcttgggcatgctgggagaatgatcttagctgagcaaattcacctccttgctttgccgtttacttccaaattcccataactcactgcttttgccagccctcctgggatggtatctagtatcgtttcatcgctaatgttgtgagtgagctagaacaatcatctcttaggatgcccacactaactggagtctctacctctctcctcctcccctctcttctccttgtcttcctggccctcagttggctgagaacagtaggagcccataacagacagcatgtcatccattcctgacagccttggtgctataatatggtcctgccaaacccattacagtaatgacagtgttgcagaattagaacactcactcctacgcggagaagaaaaaacttggggagagaggggtagagttagaatcttctgctattttgctttttctctcttttctcctccctaggtatggcattgtcccttttctttctcttttattctattaaaaaggtaagtgagcacacaaccgcgtgttgctaactcggcaaacaggtttccagggcaggtggtggtatcttctgggtcttggggaaccatccaaaagagattattgtgcctcatggtggcgccagtagtatcattccattaccatttcctcaaatggggagtgtacacacggaagttcttttctggggctttgataatctcaataggcacttacagaattgacttttctgccttggcctgggggaggcgggtgttgtaaaacttaatgatcatctttctgactggggatcataaagtgctgttgataattgtgatagttaaagtgatttgcttacagtaattagttcctagggctcccttgtggaggtaagagaaagagattgctctgtcttgcataggggcaaagtgaggcacagagggctggggtctattacaaagagctagtcatgtttgaccacaagagcctggtctaggcacatagattagagactctgcattgaggagggggtacttggtggctctttgtgggtaagagggcattcaacatgagaggtacagggctgatttaatgtgacaaagagatatgcctggcccagagggccccagagctccttctgagtgtgaaagcatatcagtgcaaagactgggagacaaaaggaccagtagtttacactaatacacaagaagagagcaagcctgggaatcagcctccaacccagtgcttttcctacctgacatcccgcccaagggtcagaggagctcttggaaaggcggagggtgttttctaccaaatctgacaggagggagctggtagcatgcttgggacaagaggcagaactcatgtcagtggtgatcaagctatagaaacctgagggagacccccaccctgagctcttgcctcagttgtggctgagtcagcttctgggacagacactcccagggactcctaaagctgggaatgtagacaactaattccagggcagcagggaacagcggaaagagccctgagtgttagttttgaaccctggccctgttgcttgttggctgtgtataatgatatacactgtgtataacgacatacactgtatagaccactgtagggaccaaatatgtgaagcaccttgcccagggttcaggtcattgtagtgctgatacatgttagtttccttccttttactcttttaaggaatcccctcagacattaaatcagtcagcggatatctattgagaatgtacgtatgttcagcctgatgctagagacggctgaaaggggaaacttgccataagaacccagcaaaataatggacattgaaacactgcatagaattcgctgcaagaatttgttaatgctatgtggctgacaatttgattggtgagataaggttcaggcataagaaattgtcagaagccagtgcaaggcaagagataatcaaatgctaaattgtctggtaggaatgacaatttctctaatgtccccatcagctaccatagggtgaagtccaaataatcttcatgacatccaaagccctgtgttctgcttctgaaatgtctctccatcctcaaaattttatgattcctcttatcagccatttctggcaactgtcattcattatttcatccatctgtccatccatctgtctatccatctatccatccatccatccatccatccatccatccatccaatccatccatccatccatccatccatccatccatccatccatccatccatccattcaatctgtccatctgtccatccatacatgcatccacccatccatccatccattcatccatccatccatccatccatccaatctgtccatctgtccatccatactgcatccatccatccacttatcccacaaatactgagtgctcattgtatgcaggcactgcatgtcccaggtctggaaatgcctatgaatcagtcaggcaggccaaggatcttatgaacttggtttatgagatccttggtttagtgtgtgttgaagagacagacaataaaaagactagacatacacaagacagattccaacagtcagaagtgcaaggaagaaagaaaaacaggggcatgagctagacagggactggaggtgggttggaggactactttggatggggtagtcaggatggactcttggaggatgtgacctttgggctaagacctgcacaggagagcccatccctcaaaatgagaaagagagttccaagcagctggaagagcaagtgcaaaggtcctaaggtgagaatgacccaggtgccttcaggaatagaaggaaggtcactgtggctaagcttgatggtcctggggaaaggaggtatggcaggatgtctgagcagtcggcggagaccagacatagagctccatggagcacgagagccatggcaagaaggcgatgttgcttcccacatgcgtgggagccggtgaagtgttgtaagcagagaagtaacatgatctgctttgtgtctcaacatctttttacatgatcacgacttgcagtttcccaaatacacatttccgcagcacatttccatgcctctgcataggctgtcccctggggtctcctttccgcatcttgtttacctgtcagactcctcggggcctttgagctctaagtcaggtatctcttcctctgtgaggcttcccctcttcccacaggtcccatctctgccagtcactgctttcccttcctcctacgctttcaacacatctctaatatggcacacggtgtaatacattgccattacctgcttatgtgtcctccctagcgagtagcctgcaacatggtaggggcttaatagatttgataagggccggtagtcagggtaggctctgtggaagcaaatcttgaaggatggatagaattttggtgataaagagaggccagagtctcacaaatcctgcaatatctgtccaagtcaacatgagacattattggatagatattgccatcaagaagaggggcccactccccgtgaaaaccgtgcactcctgtcttctctctaacagttaatgagaacgataggtattgatttgcatatgatattcatgcattttgcatattttcatttaccactgaatgcatggacagagttctcaatcctgtctttcaagccttctttccttcatttagcaacttttaattaaatgatttctgaatatcctgcacaatgctaggccctgtgaaggacaagcaagcagacatttgtccttggtgagctcacatcttatagcttccaggggcaaggtggagggtgcagtggtttccagctggggttctggaatcagacgacgcagatatgggtctgaatattggccctgatgaggtgtagaatcttgtgcaacctgctcaatctctctgagtcttgatttcctcatttataagataaaggtaataacacatacccaggggggttggcttggcggagtgttgggcacatagctagagctctgtggatattagctgttgattatagttgtttttcccagatccctgtatgggcggatgtgcagatcccattaaaatatcctggttgggctctgggtaggtgtgtgaagcctcttttctcccgcaattccaagccttctgagtccagctaaactgcagttcaacttagaacaggtactgagcagtccagtgggaagcctgagttgggggggaatttgggggagcctccctgcttcctgcttgtcaagggcccacctccccttgcttcttcagttacaagcagaatctacccgttcacatcctttctcttgtcttgccttaaacatgcctgagagagatcataaattgattttcaccctgacctatagacacccgcaaaagtcttctggttggtccccaagacttctgccccatccctgcccgtcagtcactgttcctgtcactacagtcgcagcgacactgggggtcagtgagtgggttgagagagctcagacaggatgtatggtgtgattcatttgcaccaggggattctgaatagataataattgtctgcaaatggcaattaacagaatctttttaaaaatgccttgatggttgtaaaacggaaggcgaagcacatcgtgcctcttgttgcaagtaattacggaggcggcctgttatgcacaggttttgagtgacctgatatttccactcagacactctgcacagagacactccctcaactccagtctgtgaccctcagacctcatcctcaaagatggcatttgaagaagactcactttgacttcttcctgaagccctttccttggcttcatacggagccccagagcagggaagggaactgaaaatcagcactcattgaagatggaaggggcagaaagaggaaggagcatttacttatttattttcttttgagacagaatctcactctgtcacccaggctggagtggagtggtgcgatctcggctcactgcaaactccacctcccaggttcaagtgattttcctgcctcagcctcccgagtagctgggattacaggtgcttgccaccaggcctggctaatttttgcatttttagtagagatggagttttgccatgttgaccgggctgggattgaactcctgacctcagggtgatccgcttgccttggcatcccaaagtcctgggattacaggcatgagccacttcctctggccagaacgatcatttattaaagagtgttgtataccaagtcttgtgttagctgcttttacaaccattgtctcagtgcgtccctaaatagcctggcaaggaagggaattttattcccttactgtttttttttttaaacagatgaggaaaccgaggcttagagtggttaaatgacctgcttgagtccagttaacagacatgaggtttgaactttgaaatacctgcttacagagcccatattcctttccactctacaatgctccctgcactgtgccctgcctggaatctccttcatggtatttaaagctgttattaattatccatttatctgataatttctttgcatcttttttggctttgctgtacagattggtgcaaaaataatcacaatttttgccattaaaagtaacagcaaaacctgcaattacttttgcaccaaccgaaatagttttaccagggcagggagacactgtctttcacattcagtgctgtattaccagtgctcctcctgatctctatccatgggcagttaataaatatttgctgaatgaatgactggcttctactggtgataatgaatcattggaagtgaccaatacaagattatctaatgatcaaccaacatctttattaaaaaaacgttttcatgtgaagccacagatttggcactggctaatccaggtaggcatgaatggtatcttgcagacatctaccctgaaatagagacctgaagttcatctctgcaattcctttgttgacaggctgagcatgcagcaatagaagacgacgtcctcttgccttggctagatcctaatgccctcgaatgcagtccagctttcctaaatgcctcctctcctcctgctttctgtctgaggtagaggagaggaggcactgtcgggaaaccatgacctttccacctgtcagagctctaaagcactaagaggtgccagctcattctcagggcagaagaaccagtgtagtctctcactaatgtcttagctctggtctgttctagattcctcaacctgagcaggttcatatggttttgctgaattctccaagtgttagttgggagggaggatgcactacaaatcagaaagaacagtgctaagatttggataggggaattgaggaagaatgtcaatattttttgggtcaatgtttgtaagaccagactcttaaattcaaggcagctaagaccggttcagggacagagaacagcaagtgacaggcatgcaggtggaatgccaggctcagcggcaccacgtggtgcggggatggcttataatttgagggagacgtttgggaggaggatgcttcagccgcttggcttctaacagcttttgacaactctgctattctgatgacctgaaatggcatgtgtgtgacatgtgtgtttcacctccggagtcagtcaatgtggctcacagagtgggaagggcagatgagcagaatcaacgtgggcaggaaagagcaaaggcaagtgacaagttgctaactcatgtttgtcaaaaagcatccctctcctggtactcatgcccaccccctaactgcctcagccttgaaagctctggagaggccacaggccagcagggaagtcactgcagcctctgggggtgccatcgtggtgccttctgcttcctcctgccctgaggagtttcttcctctgattccttggttttgagcctttgcccctaatgccagcaccatacctactgcatctggatcttcataatttggccagaaacctgcttggccaacaatctccccagtgattcttacggacatcaggactgaggtcctggggttctgtcatgtggactaaggtaggggtgagcaagctatggaaacatttagtgacatcagtgatcttgtgaaagccactaaaggtatcatggttctccaaagagttcctaaaggaaaagactgttgttgaccaaagccattagctcctaaaatactgggaatgagggaatcttcaaaatcactgcacattaatccattgattttgtaggtctgtgatgattgattttttgtgtcaactttgctgggacatggtgcccagatgttttgtcaaacattctggatgtttctgtgaaggtgtttcaggatgaggttaacactcttgaatcaggggactgagtgaagtcaatacagtgtgggtcggctttgtcccatcagttcagggccagagtagaacaaaaggctggcctcacccgagcaagaaggaactctccagcagacgacctcttgacttgaattgcaatgtggactccttcctgggtctcaggtctgacagccaaccctgcagattttggacttaccagtctccatcgttgtgtgagccagtcccttaaaataaatctgtctttctctatatatcgcttcctgttggttctgtttctctggagaatcctgactaattcaaagccaaagagtgctagagctgggtctagatcctagatcacagagatgtgggaataatgatctccttacagggagcacactagcttctgccataggaagaacatcaagctgtatgtatgtgtgtgtgtgtgtgtttgtgtgtgtgttttcctgtgagctccttggaggctggggcccacatatattatttatctctattattgcagccccaaatactgaatctggcagatagtgtttagtgagtgatgcatagatgaaaagtaaaaacagaatgtgattccaaattatttgaatacttctgggacttttaaaagtgcaaacagcagaacacaccccagggaggtgaggaggttgtgcacttgtccactcttaactcttttttactattgaatatcttatcaaataggaacaaagccagggacagggtaagagtctccggctggagaaaaaagtgatggggtccctggggtaaagtgagtgaacgccaagggctgaaggaaaggagggaggagaaatacctctttgtggctgccactctgttggatacttgcatgtaggagcttgtatttaatcttcatgtcaacataaataagtagagagtaaagctttttttttttttttttttaaataaatgaattgggataggaagtagagaagagggttaaggaaaagggctctaaaacctaactctaaccctgcaggaaaataggccctaggaagaaacccctcattgccgaagaagggggaaagaactccgagtccactgtggaggccacctctgtaccctctagtaggtgcctagagcttgcacactggttcccccgtggcaggagagtggggcctccttggcctttgactttgttctcagataaacaaacaaagagctatgggtgagatctggtttgactttaatggaattttgctttggtcatccacgctctgggctacctggacccaggacagtgtgcatgccttcacccaggcctggagcagcttgagcgtgcagtatgcaaacggtggggctgagcgtgggtttggcctgcacgctctgcacccaaacgctgcatttacatgagctgtgccttccccagggcagaggagaaaaggggctctcatcaagttctctcaggtccagctgaaaaaaactctcctttggacaactaagcccatgggctgggttggtttctccagggcagggctctcttggagacagagacgctgacccatcttctgaaccaattggatctgcatcctaaatggcaaccaagctgacagcctggatcctgctgagcccagcttcatattccctcaagcttctatttttaaagttgctgctcctgctcctgtctgctctgtaacaagtcttggacattgcctataagctgctccaccccacagcactccaggatgaacccctgctgtacctgagagctcctagatgcagtctgtcttaagaaaataataacagacttccctaatatgcaactggtaaccagttgtctgctaggctttagttttcccgagcagctggggcaaatacccaacaaataccgaactccccaggtcccagaacagtttccccttcttagacttcattgcctttcacctcccagtttatctgtaaaagaatatgccagccatgggaggcaacatgaggagctgtgtgccagatatgctcacttaaggagttgatcgatttaaaaaattcaggtagaggcattggaagctggttcctgacagcaaaaagaaattctccccagtcccactgagttaaacaccaggctgcatatttttcctgccaggatggacacttccaataaagcaaattttgcggaggagatgcaggctggtaactccttgaagggggtgcccatcttgactccctgtgagataaatataagtcccaggacagtgttactctcctttcatccccgtgacgacaggcttggccttatttgtgaccctcctttccagctcccccagttcatctttctaaatgagtctgaacagcccagttcagggcctgcctgactcactcgctgctgggtctttagggcctattagcattcccggtgcatagtaggtgctcaagaaatactccctaagaaaagaatgcctttgatgtaccacatactgggaattatcttatgtatgtgctctttcaatttttattttttagcctgacacagatcttggaggtggaagtgctgttatgtgcattttatagacgagggaattgagctggggtgtggagctggggtttgaattcttatcttctcaatccaagcatgggctcttccacacatcacactggcaatgtccgtgctctttttgcctgaaaaactctgggaaagaggctgccttgagacctctgacccctatggcttgggggaggtacaatggctgaggctgatggacgacagtactttctgcaagctggggctcctggattgggggccacactcctgagacagcagagtgggagcctggggaagctcccccagagggaagtcaggcctggcctggggattgtggggtgaccttcgctgcaggggatccctgagtttctgccagctctgccgggagccctgacctctagaagctggtccaggctggttggcaggtggcttccctcctgtggctgctttcaggggcagccctactctctcttaggctccattcatgctctttgaacagggaggagctggaggacttggaagggaatgtgtgcttccggtggagtttgctgaagtgccatggagggaacactagcctgagagtcaaaacacctgggcttcaggtctgtcttacgcaagtcatgaaacctcactgaaccagtttcccattggtaaatgtgctgatgcctccttctcagggtggctgtgagaatcaaatgaaatgatttgcagcaccatagcagagatatggtgctgcaggacactggctgcagacaggtctctactaggtgtcagagccgtcggtagggttaatgcaggtcccttaagagagattgagtccttctctagcaataagacctagcatgactcaaaagcttgcagaaacactttagttgaacaagtctctgggacaaaccaaggattgtggggtcacagaagtcaactgttaaaaccttgtggtaatccaaagagaacagagggaatgcttatggaacaccaacaccacttcttctttcaccaagtcctctccctgctgctctttcccatgggaagggagcattttcagaggagccctgagagatgggggctcatacccagccagcagtgtcccagctttcctggccctgcctggggtagtccaaatggagtgcaggagaccggtgcccatgggaagcctccaaaagtcttgaaagtttggatttgcaatcacagatgccccatgtggcttcttgagagatgtcaggactgccatttgtgagctgtgttaaacctcagatgtcaggagagaaactctctcctttccacagggtcctggaacagcataaccagtaggactgtagtataggaacgtccagggccaccaaactggacccatcttgcacagtggagtgtattgcttgctaattgctggattgcaatgcctggggatttttttgattatcatgaccgagggatgctattgaatgcagcaaggaaaggccagggaggctgcagacatcctacaatgcacagcatggtcccccacaatcaggaattatctggccccaaatgtcaatacggctgaggtgaagaaaccaacatgtgcaaagcactgggcctggcaggtctagggaacagtgataattcaggtatgaagcaggagcacagagttaatgaaggcaatggcaagagatgaggctgaaaatgtaggttggagccaggcagagaaggatcttggacaccaaatgacaaggttttactcaaaaaaaaccccaaagcattccggggttagttaaaaggccagagcagagctgactcccagcacagggctctttccatcctatcatttggcctctttccccaccatgtgttagacaagacaagaatgattcatggagaacagaactagcagcccaaagcaagtcactttttaccacctacaggataaaatcagacccctttgtgaacacataaaaccacgtagatatttctatcactggtttaccatctgcatctttgaagaggggctaaatcagtgtgaacatctttccatgtccataaatatacttcctcaccatgctgtaactatttatctctagatcagccttcttgttagattgtgggctccttgaagacaggaaccatgttgaatcatcgttgtatacctggtaccttccatggtgatagaaatactgagtccattgagcaggatggctggaaaaatgaagcaataggaaggagcagactagcctgctgcatggttgcaaggactggggacggcttccccctactctcttttcctggtatatgagaaatacatgctcattgtagaaaaaaaaaaaaaaagaaaaactatagacaatccaaaagagcaaaatgaaaattatgccagccccctgacctccccacccagagataaatacatttaacatttcagtggatatcctacaccctttctagggttgtatattcatgagattcacatgcacatattttttctttttaattaaaatgggatcatattatacaccttgttctgtatcttgcttcttcacttaaaaatattttggaaactagtgcaagaggaggccaggggatttgtcttgaagttgtgtttgcgtagcaatcacccatttttatggagactgcatctttgaagaggggctaaatcagtgggaacatctttctatgtccataaatacacttccacaccatagcatttaatgtctacaagctatgcaactgtgaggttgtgctataatgtattaagccaatcctcaattgttggaatttgtattacttttatgtttttgctataacaacaatgctgcggtaaatacccttttactgaaatctttgcacacatcccagatttttccttcgtttgaatttctagaatagaaactgctagaagaacacaaaaatgcatatggtacagcttttgaatggtgtgatcacatggctctccagaaaggtggtaccaacatacattcccgctagtaatgttcagagagtgctatgttagctctttgtgaacaaaagctatcatgcagggcccatgtaaacaccaagataagctatttccattccattcaaggacccatttatataagtccagcatggaaaaactgtcgttcttgttattttatagtctaccaggtaaatgtacgcagttttggtaagatgagctatgcagttgttcacctgtttctgaacacacacacaaggtaatacatgtaagagcacctagcgcggaacttggaacacagcagaaactcaacaaatgccttccatgcccagaattgctgctgtgcttagagccctatcatcccttatctggatggctaaatccagtctcctgtcttggaaactgataagccaatctacatacctgccagagtgaatgatcaaaaatgtaagatggagcatgttgctcccttgcttacacatcttcaggtgctcctcattgtccatacatggaagtctggactccttggtaaggtttggaaggctccatgacattccctgagatcccacagctttatccccgacagatctcacctctcccagctcacccaggtcccagccatgctctcccagtgggccacccagtaagattcagcccttcattcctctgtgacccagcacagggcattctctctccctgaaacctgttgtctcccttcctcccttgtttgtttgcagaattgcctcctgggaaacaattccatatgttgacagccttttctacttgtcccacccaagcaacacaatccttttcttctatattcccagaaaatcttgcccaatcattataacacatctctcattgcactgtaataattgtttttatgtgtatatctccagctaggctgtttagaatcaggacattttaaaatttatgtccatagtctcaacacctggcgtcaatcttaggacacagtaggtgcttaataaatgcttgtcacataaatgaacaaaattataatgtccttcctctcttccttccatttgtctagccattgcagggctctgtccaccgtagttactattggttactaccaagccatcattatgatgccttctcctttttcaagtggtgttccagtttccatgaactgatatacataatacttctgtcttaggatcaagcagaatcagctgaaccaagtgctttgctaccattgggcctttaggaagagacagagctggcagggaaggagagagggtaggtgcatcacgagaggcagagcccacgggagcatctagtggggaaagctcggctgagtctggctctgtggcttcaacagggagccccacgctgtatctggaagggaggactgaacttcagagggaaaagcaggaggcacagtacaggaagacacagaaagggagtaggataggggagatggacatggaagcacaggggagagacaagcggggagaaattcaggttcaatgaaaggaaaacaggaaaagactgcagaaggaagaagataaggaagcaacagaaaccccagctagcgtgggtgtgtggactgcagatgtgtaagagcagcctatcttcttccgagtccactagagaagtgtggcacaggagagagccttagctttttactgaatgtaattaatgacattgtggctttaaataaaaaccagctattcgtggggaagcctgacagggtttcttttaacttaatgtttgctgaaccatcccttctatctcacttacctgatgtggaacatatgctgggatcagaatgacagagaataaatcaccagatttgcttggcttctttgaaaaatgaatttgggggctgagatttctcatcagtatatatcttccccgagcagcctcttgacagaacatcaagcttgggggatgtcccatgcaaaggtaaacgagtacccagaggtgcccagatgcccacatctggcaacagatccatctccttgagacacaagccaggccacctgtgctaggctggcaggtgtatccagggcaggatgtgaaagcctcctgcagtctcaggaataggatacaattgtggtctttacatgaaatcaacaaacatatatggagctttaaatatgcatcaaaaacaccacacagcagggaggcttctcagctttgccactggcaaccatgagcatgccctagtgtcttcatctataaaatgggatgaagctgccttatggcttagtttgttatgagtttcaatctatcatagatgctaaataaaagtttgtattttctccctggatacagctagcagctgcaagagctcccaggcctctgggctgaaacagaggcagggaccaggaagcaattttaactctggaaactttagatgagggtgaaaagggtgggtgtggacgtgcatgtggtgtgagtgtgagtgggggtcacgttttctgggttcttagtctatgtctgcaagactttctaacttggctcctgacctttcactttaatatctgtgtgatgttggacacataatttaatctctctgggtatcagtttcctcatctctacaagggggagatgagttggattgactaccttaaaatttttttcttaacattccttttcaggttacaaaagtcacacatactcgttacagaaagcttagaaaacacatacaaagatataaacaagataatttaaaacacccattattctaccacccaggggaaaccagtgttttggtgtattctgctttctctatgcatggtgtattagagagtgaaatcatactgtgtatacaattttgtttcatgctccctccctttaatgttaaattatcataagcattttatctgtgtcattagaaaattatctggacctcatttttaaggttcctcctcacactaaaattctatgaagaatggggctcatctcctttgctattaaaaacatttattctcttacagcagcagaaatcacattgtggaaggtgcccttgaatggtgcttctaaactcccttcggcccatgcatcacgcaaggacaccaaagggctctgtgggccacccggctcacccactttgatttaccatcttagctctcaagaataaaaggaatgatgttgcttttaaaaaaattgaatatcatcaaaaatgaccttattcattggtagaaataggggccacttatacgatagattttcaaaggtggggttgctgaaaatttccctaaaccttcttttccctgttcccttgactatgaatgcttaaaattccttttaaaacaagaccttttgttacaaagttaagattttaaataaaaaagatttggggaaagttaacacattgactaaaattcacactaggattaaagcagagacaatgcgatgtgctcagcatataatttcctcctcctgggttcacaggaagacaggcattgctcagccttcctaggaattaggttcaggcctgagacttaaaagagtcctgtgtgatctttcagcccctcttccctcccgtccctactctagaggccacgagttcaaaatgataaagctaaaagttgaagagggctgcccgtgcgccttggaatctgataggaataaggaataatgctttgttgtgctaagctgagattttttgatgtttatttgttcctgcagctttgcctggcttattcagactaatacaaagatataactaactgatagcagttccctttgtgagactaggtttgggtattagagaagacgagggagaaagtacaggctcttgaactcagctgggaggaaattcagtttggagaggaggcaggggtgccactagctgatttagcgacttttgtattaattcagaaaagaaattcgtaggtttacaattctatatgctgtacatgtgcactgaaactgaacagttaagtaaatggatggcagatggtgggagccaggcgtttcactgttggagtgggaggttacagataagcaaaaggagggggctagaatgatccagatccacgtggtaatgaattagtgttggagacatcagtatgaacttatatttagcttaatatagatatagatgttatgtatggaaatatttatagctatgtatatgtgagggctaatatacacacagatatttcccagctatatctcctgagaaagcctactagcaacaacattacagtagcaacaagcacacctaacaatccagagtttggtttctgataccactctgtaataaaaggaaccagggctccttgaagaaatggccaattctagcacaggatcaggaaatacacaagatgaactggagcatcttgtagtgccagaaaataaggaagtgctctgtgctagtttcctagagatgtcataacaaataactacaactgggtggctaagagcaacagaaatttattctctcacagttccggagaatgcacgtttaaaaattaaggtgtctgcagagccatgcttcccctgaaacctggaggagagaatccttccttgcattgtcctgttttctggtgatttttggtattccttggcattccttggcttgtagatgtgtccctacaatctctgcctctgtggtgacatggccctcttctctctgtgtgtccctcttctcttcttatgaggacactcactggtcacattggattaagggcttaccttactccagtatgacttcatcctaactagtgacacctgcaatatccctgcttcaaaataaggtcatattctgtggtattgggtgttaggacttcaacatattatatttgaggaggaggacacaatccaacacataacatattctcttccaaaaaagccacactaatgagggtctgtcaaagggacacagaagccaactgaaagagctcccattgaccaaagatggcatgctttagcaacaaaatagtgttggaggataatccaaagcaagtccatactgatgtaaatagatgactgaaggaataaatacagaaataaataaatggaggagaatagatagactccagtgcagaattccaaataattcacgtagatgccttgccctcaaagaagtagagtatagcttcccgctccttaagcgtgggctgcacatagtgacttccttctaaagaatacagtgtgaaagtgagagaaaaagaggagctttgcagtggaggaaactgaccaatactatttcagccaggtgagcaaggttggcagcaacagtgatgtgccatgttgatagcacacacccttgataggatacgatggaaacagcacttgtctttgtggtcttccccctcgacctcagtgtaatcttgaaaagagcatcaaacaaatccccatcgagggacactctgcaagacacctggccagtactccccaaaattgtgaaggtcataaaaaacaaacagaatctgagaagccgtcacagccacgtggaggttaaggagacaagactgctaaatgcaatgtggtatcctggatgagcccctggggcagaaaaaggatattatgtaaaaactaaggaaatgtaaacgaagtatggactttagttcataataatgtatccatactggttcattaattataacaaatgtaccatactaatgcaagatgttaacaataaagaaaactgggtgtggggtatatgggaaccctctgtactattttgcaacttttatgtatgtcaaatctaaaactactctcaagtaaaaaggttagcttttaaaagggcactgctagaataataataataataagtgaacatagcctcatgttagggtacatgacttggttagaggctagtagcctgggtgtcagtctccacttacgtcctcagtcaggtgcccttgtgcagtgaacaacctgtacaaccttggtagtcctacagtcagacttaccctctatcaccattttacttagcgcttatcctgcacctgaacatagtactaattggtgctaggaatgaacatagcctcatgttagggtatctgacttggttagaggctagtagcctgggtgtcagtctccgcttatgtcctcggtcgggtgcccttgtgcagtgaacaacctgtacaaccttggtagtcctacggtcagacttaccctctatcaccattttacttagcgcttgtcctgcatctgaacatagtactaattggtgctagaaataaaagcatagtcaattacatcatagattacagaggatcacctatgactgtcaaggagaaaccccatgaacatccatgatcagtgaattcattgtcaagaagcacttccttccaagcccggagagttacagctctggttccctacctgtgtggaggtagaaaagcccagtgtgttaagggggatagtgttcttatggagaaagtgtcctcaaatcacattttgcctgtgaagatgaagtaggggagaatcttatactaaactctactgaatcctcgtgggggcaagggaatgtggctggtgcgggccgggagagtgatggaaaggagagggattcctccagagttttgtcctcagagagttgttttttgtcatttacacgtggcgtggtgacagcaagccaggtgtctccttatggaaatatcttaatacagcagaaacaagcattttgagttatgcatgccaagtctgacattaattttctccttttcagccttacaaagaaatgcaccagtatgtttcttcccaagactggccccacctcctgcatggtcagagcctcacttgtcccttccttgtccatcacatgccctgtgatatgaagcgttccaggggagtgggaggggcttctcaagaagccttctttctaaggggcaggagagcccaggtgttaccgtctgatgcaatgtaagggtcctattgtgtccctccaaaatataaaacaacactgctgattaaaaagcctatagaaggccaggtgcagtggctcatgcctgtaatcccagcacttcgggaggctgaggtgggcggatcatgaagtcaggagatcaagaccatcatccaacatggtgaaactctgtctctactgaaatacaaaaatttagcagggcatggtggtgcgcacctgtagtcccagctacttaggaggctgaggcaggggaatcgcttgaacccaggaggtggagattgcaatgagccgagattgtgccactgcactccagcctggtgacacagcgagactccgtctcaaaaaaaaaaaaaaaaaaaaaaaaaaaaaagcctacagaatacagttaagctaaaatgtggattagaaagcaatttggcaatgtgtaccagcagtcaaaaaaatgtacatgccctctggtgcagtaagtgatgtcacttttgtcaacctgttccaagaaaataatcctaagcactaaaaaaatctgtgagggtaatagcaaaaacagcctaaacattcaacagttgagaaatggttaaataaatcatggttcatagacttgatggaatattatggaatcattagaatgatcatttatgagaattacataatatgaaaattgcatatgataactatgctaaatgaaaaaaggggaagataaaaatatgagtaaagataattactaccatgttaaaatatgcataagaaaaagactcaaaggaaattcaccgaaatgctaatagtgtttgtattagacaggtgggatttgagttgattcttttttcttttctttggtttccaaattttctagagtgtggtaatattacattataataaaacttttttttaaatgtgttaattcctgtttcctaaagcaattaatagtagaccagcatttcattttatttgtagaaacacataataatggtcatcaataataaaataaccttcataaaaattaatagcattaaaataaacatggcctggaaaaaatagtgtaatggtttcctaacagagacacactgacttcctccaggatcacgtctgggaaactttttcttatcaaaatgactgaagttttgtcatttaggctagttgaggaaaacaggccaactctaggcctgcatgctgctcacagcctggcagcccagtagcaaatgtgctgccaccgggctccttgggctgaaaccatgaagcatgagctggcctggtctgggcatctctgttggtctgcttggagggcactctggatgaagccctcatttgatttcctaacagggctgaagctactggccaggccgttggttgagatggagagtctgcaggaagggaggacagggcatagagctggtctttcctaatgagcagaaggagctgctattcctgcaagcaggggttggaagggagaggcagtggctctcttcacactcccttatctgcagttagaggaaatcttagcagatagagcaatgggttctggcttttgcctgcattaatggcaaggaaagggccagcacaaggggccagttatgtgatcggtaggagtgtgggctgaacataatgttagttcagccagagggccactcacaagagagaacacctgacagaatgatgaaatgatggagccaatcaacccccacacagatgtattttctcttcccctatggcacaaattttcaggactctgatttgcaagacatggaccagaaaaagacagcctgctttatgtgtggggagtttgcacaattaataatataatattgcaagggccagcaatttgatggtatttattattcacataatttaaatcattgccaaatgctaaaaacaatatagtccaccccacccaaatcaatataaacatatcccaaatacacagcagaactttctccatattgtttttcttgacaaagctgaagaagggagacccaacttttcatgcaaacttctggcatcttcttttcatgtttttcactagaggaaaaaagtctggttcttttttcctggaaagataaatttttaatgaatgtaaatgttctttcaattccttggttagatggaagggatggtacagcttggacagccagcctccggaatataattgacttgcttcttgttatttcttttccctttcactacccagtgaagcacaaatgctctcagcttgtgcctttgtttctgagcttgtcataccctcagccagcagatacaggttgccttagaagggaacactcctgatgaattggcctcactgcattgtcttctaacaatggaagcaggtctactctgacatatctgctcttcaccctgcttcttcttggcattcattaagtttgtatttatcaaatatctattatgtgccaggcactcttctattgaatcctcacaactctatgatgtagcttctattatcatcatcacccccattttacaggcagggaagctgaagcacagagaggtcaagtcaattgccccagctgatccatgaccaacttggtagcccggctctggagcccatactcttagccacgacaatattccgcctcccatagcatctaaaatctgctagacattgtgtgcaaaaagagtgggtgatggagttgggcttgggacaaatgcacaatctggaaggaaatcgtttctaaccatctctttttcattcctatggacgttgcctcccagggctgctctccaagccccaattcttttgcatacatttgggcttccacttccacttgctgagatatggtttttcccactgtgctactcagacagggtatgcaagttgcatttgacatttctgcagggtctgtggcccttggttttgagactgagacagggctgtgcttcttcccttgcctcctctgtccatgttctaacaggagctctgcagagtggcaaacactcctgtcaaagaagtccaagggaacagtgcagccacttctcagggtatccacctggagagaagcctgcagcattaagctcacctctgagggctgctttaagaatggaagaaggacctatgttctgccaggctgtgctgcagttgctatgtcttgggttaaaagtctgtttagcctcaccagacccatcatcaccagtcctccacattatagaccacaaaggccctacaattgctatcaaaggaactgattgttttgatctggaagccgtcagagttcaatctggagtcatccaggcagctgcatgttgtattatccgcatcatagggcaaggagagagaaataatagactcttcggtagatttcagttcccaaatcatgacctccatgtgtagaaaatcagcattgtaaataatcattattatcaaagagtgtcatgtattaagcatctactggagtgtgaggctgggcacctagtcaaacaaatccctgtcaagatttctttgacccaacggtgggctgggttgtgcccttccttcctgctcccataaatgtcctctgaatagctctgtcactgcatgcgatgatgctgtaacacaggtgtctgtcttccccatatgaccatgagctctttaggggcatggactactcttcatcacctttgcttccccagtgcctagcagccctggcatacagttggcacgtaatgcaggtgtgctaaatgttcatcttttcttctttctttctcctaaatttagtatttctcatgaccaaagccaacccttgccacgtgcagtgccccatctccttcgccttctcaaggactccctccctcactcagtccctctccttcttgcatctgaagctctttcttccttccctggaccattcccacaaagcagaaagtgagcaaacccatattcaattatccttcactcctgaaatctcccctggacctcacactctgttctggctgccattccacttctctgtatcccctcctagaaaaattggaaaaagttgtctgtacacattgcttccacttcaccttctctcattcactcttgagcctactctttctggtttttactctctggttccaaaaaattgttttgcccttgttaagacccttgccagtctctcaaactgccaaatcttgaggtccctctgtctccatctccccggagttgtaggaagcattccaccacagtggcctagtccaaacttctccagattcatttctcttcaatatggagacagggtaccatgcactctgtggttttctgcccacacttttcttccagccccttcccagtcttcctgttagcttcttcctcttttccactccctaaatatggaatcccgtccttgaactttctctttctgggctgtactctctttcataatctcaattctgaaaaaatatagctgacaattcccatatttataccttcagcccaaacctttacactatatccgactgctaactggcatgtctcataggacctcaaaacgacacagtcctgaacctcttgatgtctcattattctccccacaccacatcctcttctagtcttctctgtcttagtaactaaaacctctgtctacttagttgctcaagcaggaaacctgagtgtcatccctaactccccttacccactctattggagtggtcctcccatgacctacagatttgttcacttgtttcttgtcctcttgcctctctttccgcaatctgaggtcaccgaacattgcactgggctttaagcattcattgactgattagacggactcggtccacatgctctgttggatgaatggatggataaagactggttgaagaacaggaaaggcccagagccttggattcccagacaaaagcatagcctcccagtcttcatgtcaagaggctctcccctggttagcttgatgacattggtcatcgaagttaaccttcctaacactcagtttcttgatctataaaatgggaccagtaacacttaactcatgaggttattgtaaggattcaatagcataatacctagaatatagttagtgctctattcatgtttaattaaaaaaaatacttgttaggcaaccacccaaccatgtgatccattattttttttcctattgttttggcctgtgtcgcaccaagcttgaggtgaacgtaaacaacataaccaggaatgagttcacgagcagagtcattgccagtgagtcagaggaaagagtgatttccaaccctaatcgcagacgtgggaagagccttgctgtgctgggagtgactggagctcggctctgtggagcagccacatctgcttgggtgggggcgctcttcccccatctctgtcctgcatctaccacaagctgggctttgccactgtctcctgttcctgatcccagggggcaaatgacggatggaaccgtcataaacaagaacaatgcctattgtgctctgcttagaaatggcctgtgttcttttaaaaaatatgaataaaataatatactgagcaaactgggtggtgtggaggatttgtcgatgagaatgcaaatgagcatgatgtcacttcttagctttgggaggaaaaaatgagtgatccttgaaatggtctttttctaccgttaggacaggaaggaaaaaccatctttggtaacaaaagatcagaaattgcctcctgagcgctgcctggctgcttcagaagaaaagtctgtgtttaggaaacctcttattgaggaaagagtacattttggggggcctgtacagggaatttagtggtatttgttgacctgatgagatgagaaatagttgaggtattaaatcgtaaagggagggcaggtgttatcataataggacattccaattcatcgtccctggcctgggctgcatgcagccagctacccgcttcccaggcttctgctcacgggagcttcagcttggcctcagcttatgcggagtgaaagcccagccactcctgatggtgacggcatttgcagaaaattgtacatattgtgcagatccatctccttttcttgcccttctttccaaagaaatgaattcactgggcacttatgaaaataaatgactgatgggagaaggctggagccaagccttttgtaggcaaagggatctgagtgcagtttcgaagcccatagccaggggtcagccatccaggccacagggtccaggggcccagattcccatggccaggccaggtgtgaatgagtctgagcccagtgaaagagggagagggaacagagagggatggccagaccttgccttctttgatttctagaagacttcctttgcttgtagacaccttttagcaggtggagggacagttgtggggctgtaggggcggtttctcagagtgtgaggtatgggaatgtggatgtagcattgattcacacttgctgtctgctgtgaaaacagtttagagggaaggcggggctgctttcaaagaaaaacaggtgaaattcattggtggtgtggttctcctcttctctgtatgccacttttccccatttcctggtgcctctgccgaccttcccaaccccagcctcccttttgggggagacttgctcttagctggctagtaaggaatcgagccagcagaatgttaacgatgggaggcagcgagatgtaaataaacccggctctgaggataggtgggccaggaatcagatccctgttctgtcactcattagctagcagaccactgtgagtcatttaacctcagtgctttccaatctgtagaatggacatcatcatggccacctcacagtgttgttgtaaacacaagatgaaatcatgagtggtgttggcaacgttgtagtcatttaacccttcaaacaactttatgagataggtcctattattaccgttatttttcagttgagaaaatggtgatgcagagaagttaagtaatttgccccaagtcacacaacttgcaagcaatagagcctaggctgaaaccaagcagtttagtgccaaaactcgtgtacgtaaccactggactccactggactcttaagttgaatctttacctgtctaatggcccagcaattcttcaggtataaatcctattgcctccgtcagaaaacatatacaaggcagctcacagcagcattgtttataacagagcccagattggatacaactcaattacccattaataggagaatagatatataaattatgttatatgcacacaatgcgattaacaatggttacaagtaacaacatggataaatcttagaccatgatacgaagtggaaaaagcaaattggaaaatgctatataaagtcttaatccagttttataaagctcaagagcaagcagaactaaactatactgtttagggatatacacgtgtgataaagctaccaataacaacagcaaaaaactaataagaagatgaaaaacagtggttacttgtggggatggagaaggatgacacaggagtggggtgggcaggctcaggttcttctattggggggttcacagatggccatttccttattaagcttacatctctgctgtgtgtattcctttggacctttcaaatattacacaataaaattaaagtgttcactatctcacatgtgttaacttttacctttttagctccccacccccacccacctccaataatgtcttgtaaggtttattgcaaaacagcagaggacaagataatgacctttttagtgagacaacaggccagggcatgtaaaagtcactggaaattcctttagactctggaagaaagccacagtgcacggggctttcttgttgtattcactggggaccatgggtcttattttagttttgctaatgcaataaggttgtagtgctgaacagtgcaggcaatctgggtggagtgagcagtcaggctaggaagggttacttttgttccttcaaaccgctcttagttcctttggatgtgcatgctcagctagaggtccaaggagttagccagagagtgaaggagaaagagagtaggagagacagatgataacaggtgcaccagcccagatgtcacttgcagggagttcctgcagaaggtgcatggccacggcagatgctgggtggacaactcaggtcactggcagtgactcacacagaggaaccaaggcaaggagagcacaggtccttcctaagagggagcagttgaaggaagaggttggaatttgagagactaaactatttcacccaaaatgactgagaattaactaaggaaaatgcgtaaatgattgcactggaccaagattactggagtggaccggaagcgtgctcatgctcatgagacactcagataaggaacaggcagaggtgaagaactcgcgttcctctgcatgactgagctccactgtgaataaatttgcaatccaaatacacatgttgcttctcttcattctcccccactacctagattttaataggcacctattgaaaatctgaaaagttatataacggcctgaaagggtgcatttctaatggttgaatttccaatgctggtgatagactgagagataatttgactagggagagagcagggctggattaaagaatttaaaggctaaaacactgaaaatattatagtatgctttcttacgttatttaaaaatacatgtgattctaagacataaaataatggtaaggaagtccaacagaattcagatatttctcatgatggctgggattaatttttaaaataaaatattaagtgtcaaatttcattcaaaagatgtttaggtgtctttagcagttaccttgtctatctcctggataatttagtactcatagatcatgccagcctgggccatggttccctgcacagtattttctgctttctctctgtgaaggcttgttcagtggggtagactcaagaggacatgggctttttaggcagaagaccagatgccagcccctgctctgagcgcttcgtataaccttgggtttttcatataatcattctgagcctcagtctccttatctataaaataaggataataaaagctccctcacagggtggtaacacagatcacatgagagaatatagggaacatgtccaataatattgatttgtattacaaaaatattttaacctgggtgttttcagaaagttaattacaaccaaatgctggtgagaaacaacaggaacatccctggaatgaatgcaaagtggtacggccacgtggaagacactttggtaccttcttacaaaacgaaacagagtcttaccatgggatctgacaatcgtgctgctaggtatttatccaaaggagtttaaaacttacgtccacctaaaaacttccatatgaatgtctataacagctttattaataattgccaaaaatgaaagcaacctagatgtccctcactgggtgaatggataaactgtggtacctccacacagtgaaattttattcagtgataaaaagaaatgaggtatcaagccacaaaaatacatggacaacttaaatgcacattgctaagcagaagaagtcagtctgaaaaggctaaatactgtgtgatgtcaactatataatattctggaaaggcagacaaaagaaagttcagtgtttgccaggggttgggcaggaggaggaggagagagatgaattgtggagcacaggtgtttgttagggcactgaaactattctgtatgatcatgtaatggtggatacatgtcatcacacatttggccaagcccatagagtgtacagcatacagaatgaactctaatgtaaactagggacttcaattcataacaatgtatctatattggcttaccaatggtaacagatatactacactaatgcaagatgctaataatgggggaaactcagggcagaggttgggagggagaggacgtacatataaattttattttattttactttattttttgagacagagtctcagtctgtgacccagcctggagtgcagtggcgtgatctctgctcactgcaacctccgcttcccggattcaagcgattctcctgcctcagcctcctgagcagctaggactacaggcgtgtgccaccacacctggctaatttttttaaaatatatttttagtagagacggggtttctactaaaaccctgttggccaggctggtcttgaactcctgacctcaggtgatccaccctcctcggcctccccaagtgccaggattacaggagtgagccactgtgcctggccagaaatatgtagaaattatttgcactttctgttcaatatttctgtaaacctaaaaatcctcaaaaaaatgaagttttttaattaaaaagaattacagagccacttcaaccaccagttcttcttccccctgtgcaccccaagagcgtacatcagctctttggaggggcatgtagataccccatgccaggccagcctccgtactgccaggctcgtcctcaccctgggtaaaggctcatgcaggcattgggaaaagcatgaatcagaaatgagagtacatttttcacgttgagctagtaccttgtctgcttatgttgccattcatacagccagtaataagccactccactgtcatgtcttcatttaaattgttatttagactaacctttcaatgggacacgtttttatccatggggtccatggatcttattttagttttgctaatgcaataaagttggaatcctgaacattcttttcagtctctagaggtcatgaagggaagaaggggttaaaaaaaaaaaaggcaagacacaacataaaatcagactgattctatgttaaaatggtgaacaaaaaaaccaaggacttgaccagatgaaaagagaggggctcgatccatgtgagttccctggcttgctgatcccagactgggctgacccagggcatcagggctggggattgtcttggatggaaggatctcattctgcccgtcctgtcccgcagcattgggtgtggaggaaggctgaaggaggggacgcgcagttgtgggtaactggccttcaccttaaatatagcaagttacttgaatggtgcgatttgaaaagcctccagtatctgctgctgacatctgaaattcccctccttcctcatgtgaagtgcctagctggtacccactgggtgattgggcactagaaatgttggcacaagtgccctcttatgttaagcattgcccccaaccctgctttttatttatttttattcttttatttttatttttattttattttatttttgcaacaaggtcttgctctgttgcccaggctggagtgcagtggcatgatcttggctcactgcagcctcaacttcccaggctgaagctatcctcctacctcagcctggctgattttttcccacccctgctttttaaaaatgttggtgctccaattagagctgtaccttaggtagagtacatgaaaatctgattgttggcagagccctcggacttagaaaaagatctgcctgattggggttgtgagctagcacagagcaggaagtggggaagggaccagggagaatgtttctggggtggaggtcatatcagggctggggacagaaaggctgatcctgtgaagattctctgcacactattggaggagctgtctgttgcgggagggaagaagaagcctcattcagatcccccagagcccacattcggggccacctggagttagcaaatcagaggcttggggatgtggcactgaatttggggctgtgttactgtgcagggaatatgagcctaggctctgaatatgggaccaatttgaatttagatcccacctctgccacttattgacctctctgagactcaatttctcatctatgaaatagactaataacaacattgtttcaaagagctgtgttgagcatcaaatgcatctgattctcagcgtaatatctggcacagagaagcactggatgctgatagttttggtggcgcggctgttattggttggaagaatctgctggtcagtgtcgggggcccttcaacttctgcttgcagaagcccgattcatctgttacctgggaagctaaactgtccacacccttctcccatggtgatccccagaagaagctctgagggggcactagagttttattagtggcttaccatggcacttagtcccaatctactccacagcctgtgacagctggggctgtgtgatggggcttctgatggggccctggcagcgggagtctcagcatccaagcacaatcagcactgggtcgatgtatatgaggaaagcacagaatcacatggttgaaaagaactgtaattgtaatggaaattcaaatcactccactgaacctgttttctgattcgtattttgtccttgtaaatcagaagcaccgggagcaatttatttctaaacatcaacactccagaatgcaaagaaaaatgaaataattgcattctgacttgctcaaaatgattcatctgcatgtacatgctgatcctgagggcctatggacactgcaaagtaacacatgggctgtttgtgcttttgctaactcctgtgtgctcctggagaggtggaggaaggctcatatcttggggccaggtggatttctgctccccactgtgagaatctgatgactgtggaagtgatggctcattgcacccaccacagccaggtggagaggaaagatgttcctgtgcctgggggctccaggcagcatctgtgcaacccccttctgcttccctgattcatgagcccccaagggtggcctggagaggccaccaggtggccttccctctctgagatcccgggtgcacagctccttcctctctcagaacacactgattcttccttttctttcccagatttctcccttgccaggaccctcccttattgcttgctggggttcctaacctgctggctgatgttcagggtgcctcctgtgattcttgtccagggcattgagtatccagtggatggcagaaatgaattctctggaccccagaaaagcagaggtaaccaaagaattaggtaaacacattttggaaataattttccatttgatgtttcactgaaataattatcattaggaaaagcaaaacattggagggtttccttgtgctggctttatggattagtattatttgtaagtacatttagcctggagctcagtggggagtgtgggggaacccataatatttttaacatgtagagcctctaaatttcccactgtggcctgcccttccaggttcttccaggtccttttgatttctaaggttctaatggatgggtggccacttatttggggttagcataggggatatccttagagaaaccatacggagcagcattagcctgggaaacattttttgactgaggaggcaaaatgctataaaaagaaagaacatgggtttggggtctaaagctgggttcagttttgtagtggctctgtgattttaatcatgctgtgtctcagtttctgcatctgcaaaacgaagagtacagtgggcccgccacagaggagcacatgcagggacacacacgaaaggacttatgaactaccaagtgtgagtgtgtgtatcatctgtgtgtgcctgtgtgtatctgtgcgtgtgcatgtgtgcatctctgtgtatctgtgtgcgtgtgcacgtattcgtgtgtgtgcatgcatgtatctgtgcgtggatgtgtgtatctgtgtgtgcgtgtgcatgtacctgtgtgtgcatgtgcgtatctgtatgtgtgtgtatgtgtgtacctatgggtatctgtgtgtgtgcatgtgtgtatctgtgtgtgtatctgtgtatctgtgtgtggatgtgtgtatctgtgtgcgtgtgcatgtacctgtgtgtgcatgtgtgtatctgtacgtgtgtgcatgtgtgtacctatgtgtatctgtgtgtgtgcatgtgtgtatctctgtgtgtatctgtgtatctgtgtgtgcatgcgtgtatctgtgtgtgcatctatctgtgtgtgcgtctctgtgtgcatgtgtgtatctgtgtgcatgcatctctgtgtgcatgtgtgtatctgtgtgtgtgcatgtgtgtcagctatcccccaaatttctcctgagttatgaattttgttggaaaaataagatgataagagcttggggaaagaaggtgagactcctaggaacttgagcccgtgtggaactcatcattctgcagaaaactagggaagaatctggtttcactccttagagcagggagccaggaggaaggaatggggtggagcaggaggagccgggagaaccagagagatggcagaaccttttcttcctccctggaaacccctctgcccccagtttttattaacttccagtagaataatggaaggcttgccctgagtgatttcttatggagacactaaaaggagctaagtctgctttccagggattggggaagtaactgagcaaatacacctaaaagcgcaggagcctggctgggatggtgagatgctgggactcagggaaggcatcagtaagtggtctcaactccagctgctgtagaatcatctcaggagttaaatgacactccctagttcaatcaatcaggatctctgtgggtggggctctgagcattggcattattttgtgaaccaaagttgaggaccattcctgacactgttgcaggccacctctaaccagatctccaggggctgggccccgctgcatctaggacacatcagttatgactcaggtctggcatcaccaagaatgtactggtgatctcagggaagtaatctagaccagctgaagactaattaacttgggccatttagaatctgactccgtgagacaaagagccttggacttggtatcccagggccttggagcagccctgtgtcctcatctgagcactcagccacttgcttgagctcctgctctgccttctagtctggggaaagataggttctcacaataaagctggagcttgcattgtgatcacccgggtcagaggagcttgaagactggaggctacagaaacggtctcattagggcattagcataagtggtacagaaggcaggtagggaggtctccagggaaggatttctcccttaattaagattcaactgcagtgaaatatcagcaaccttatacctcttgtatgtaccataaaaaagtgctaggattctcaaatatccttctctcctcccttttctgcctgcaaacagcatttgatagtgcaaccttcaggattacctcaggaataatgagctccaggcaccctttcagctgcattagtgagggaaatgcaacactctattcctggcacacaaacaggccacccctacagccaggtgtgaactccaggctttctggctgcacagaaccattcaacccctggacaatgagtgagcaaactagaagcccaggtatcacttttcagcggatttagctgtgatgggggataatgggatggtggagcagagtggctgcattctgagccacagctgtgggaagctctggttaataggatgtctgcttgctgttggaggttggtgagggacagggacatttaggagtgaggacacggggaacactgctttagcagctgatatttgtggtgcatgcgtgcccacatacctgacatttgcaaaaatccaatcccattgggctttctgatttttagaaaaaccttgattaacttgagtgcttgaaaaagatgtagatttatggttacctaaatatattctgcataattgggaattaatgagaaactccaccccttttacatttcaatttttatgaaaaatatttcttaaatacactagctctcttttctatcctaaggattacagttaattgacaatttttgggtctttggggacatcagcctgatacatcatttttcatcaattcatttactcaaatgttttgagtttccactttaagtcaaacaccatgtgagctgctggagtaatgttgccataggtacagtcaccgatggggatgaggtagcccctgaatacaaatctcaagacaaattccataactcagagtatttctgtgtggggtaaccatccccaaatctctcatatgtggaagtcagatgagaaaacaattctaccccaatatgagccatattagcaccaggatgcagtgcaaagagcgcatggtttgcacgagaggccctgggttcaaatccttgctctgccactcaccagctgtgggaccttggccaggcactttctctcctggcccatttcttcgtctgtgagatggaactgttacacctaccctagaaagtgggaaaggaataagtggcagacacaccagtggacagcatagctcctggcctgtaataaattcttagttaatatttgtttgaaatacaaagtcatgctgggagtagtggtgcatctgtagtcctaactacttggaggatgaggcaggaggatcgcgtgatcccaggagttcaaggctgcggtgaactctaactgcaccatggtactccaaccgggctacagagtgagacgctgtctcttaaaaaaaaattgaatcagtatcctaaaatctaagaaaagcaaaagtaagatttcacctcactgtctccaaacacccccaaatcagttggttgaaacctgattaattgctattccataggcaaatgatgctgccaaacagtcatttgtggctgtgaggaagaatggccaggacagtagacattcagaaattcagttttaatgtcacaggttatgactgtcgtttaccaggtgccttaaccatctgcttgcagtttttcttcctttctttgccttggccctacctcacctggagaagttaaccaaagaggagtaagagatcctccaggtggagtgggccatggtcaaggcaggtgggggcagaaacaaaggaaaagcagcccagggagatggcgttagtgccaggcggcccgtggagaaaagctttcgctatactgaaggtctgtgaataatggtgatcattcaatgccattaattaaaacattgatgagaaaaatatatcactttccagctgggtccatagtctgtgtggcgtcgttcttctcatgtctgcgtggattttctctgtgtcctccagcttcctcccacatcccaaagctgtcacatgaggtgacctggcatgtctacatggcctcagtgtgagtgagtgtgggcatgtgtgtgtgtgagtgaccctgcgatgggagggtgtcctgtcgggggctggctcccgcctggcaccctgagctgctgggacaggctctgggcactgcaaccctgaattggaataactggataagtaattatcctactctttaaatcaatctttcttaaatgtatgtatagatctttttcaaaatgcttaacattacgagtattttggtctttgtttagttcagtgatatttctgtgaccagaaatatgccataggaacttaactcttgtttatatcaattagcctgtgggaaaattggctttgttatatggtgttttgctcaaggttgtagtttccaagaacctatcaatgacattaagtgaggacttactgtgtaagggagctgtattccctggaagcttcctacatgggtattacagagttagctaattgattcctccattcacgtgaaaattaagtgccagcccagataagattccaggtgctttgaggaactgagaagagactgagggggcacacctggctctctgcagtgcccagtctgaggggtccagccctaactgattaaacgcaacatatgctccagcagtggcaggctcatggctcaggggacttcataagaaagtgtgagacgtccatgctgtttagaggaaggtggaaaggccacacagggatgaacacaactgagctgggccctgaaaatgaggaacagagatcaccaggcacagaattggagaagtggcattggaagtagaggaaaccgtgtgtacaaaagcagcaaggtatgagaggtgcattggagaggtgcctagtcgcatgaggactgggtgtcaacaaaggattggtgttaggaaactcttaccttccaaagaaaaaaatatatattctctcaatcatatatatgtattatacataaaaataaatatttattattgtacatgtataaataaatcccactgttagtagtgttaataaaatacacaaattatagtatttggctactgtagaatcagattgagattagctggaggaaatggcctcttaatgaaaagagggctcccaccccagaatgattgatctaactttccccacactcttccctcaggcaattgctggctgtcacctgtgctgtccccacaccgccacccccaactcagtacatggggtttttacctcttttctaacctgcttgttttatgttcaatttgttttagctatcaactagatacactcaagggtaagagctccatagggacctgggatgctactgccacacatacaacatctatatctgttgccaaggcaatgggtaataacatcaaattggaagcgggccctttgtggtcagacatagctgagtggtaccttgaagagttatccaaaccaaagagggaagacaagtggcctttgtggttatgcatgtgtctatgtgtgcatatatgtgtcatctatgtttgtaagtatgtaggcatgcatgtttgcttgggaatacatgtgtgtgtgtttcagacactctggctgtatttcaataagggcatgtgaggtacagtttatatcccagtcaatggccagcaacacgctaggaaataaacctgatgaaaccaaaaacctgtgaccattgaggtcttaatctgtgaaggaaattacagtttaggagtgtgtgatttctcaacttgctgtcaagaatctctgagttctgtggagtgcaaagtctgaagatgaccttttcctggcagaggcgagagtggagaagcctattacagagcataagccaatttactttgtacaaataagtggcaattttcttcctaaaatacataagggtggaagggaaatgtgtataaactgaaagattctctcctatggtaaatctcctcttgtttgtggaaagtaaaaagacagcaacccacttagactcttgtgggaagatgtcagcagaagtgagtctgagtcctccgctgaacttcaccttgacaaatatttctgaaactggtttttggttggggaggaggaggaagtaagtatatgagtaaatatctcttggcaaaagcattttagtggaaagagaaaggagctatgaaatatacctccctgctttaatttgtcacttctttttgtttaaaaaattcatgagtgttcgtaggctgaaagtaactgaaaatcatagatcacaaccttttttccaagcagtggctcacaacctgagaatgttcagatccctaacagtggataaactatgttgggtgcaggcttcaggatttccttaggttttcaaaggcaccactgatacaaaaaaggtcaagactcacactcttgtgacttgttccacaatttttggctaggggttaagatcagagggtggatgaggtcggctccacaatcattttggttgtgggaaagggttatgaggagattaagattcagaaaagttggcttatcatttaaggagcacagttcatagggtctgaggagttttagcaggtgtgtggtaacctgcaatgttttcgtaggtgtgtggtaacctgcaatgaaggagttatatgtgtgtgcatgtatgtattcatacattaatgtattaaggtaacatctttgtattcagattaatcccttcataaattaatacatgaaacaatgcagtgatgacaagtgttctaaaaactatagaggacttgtttatgaaattagggctcatactgaaggtcaggagaagggctgccattcatcagtcagcattgatatggagagggaaaggagattaccctattacaagtcatactgggtggaggagatttaattactcagatgctcttatgctcctcaaaggtcctagtgcacctctttagacagtttcccacacaagcctcagcccatctcatctggttttgttctgaaccccaaggttcagtcaggtgcgctgtcccatcacaggaaaagaaaccttgagctgattgcagactgtctctaggttgtcatccattaattaatgaataaattaaacaaggcttttccactctatcatcttgtcacctgaagaacatttattttcagggtgattgctaaactccacagtacaaagtatgtaatagatattacgtttttatttactactatgtatgtaaatgaaagaaagaaaagggaaggacagggagagggaggaagagaagcaaggaagaaaaaccaagggaggagggaattcttgatagtctctgtctttcacggttttcctgctcagcttattcatccaagttcccactcagcccccagcagaccagagagtcaaacccaacccagtgggcctgggcaggtgccgtgccatcccctccaccttctccgtgcggcctctcccttggctgtcctctgaatgtgcctgtgcccccaaatcctcccttcaatgacatcaacaaatttaaaaaatccacaccaaatctgtcacctgtcaaattaaatgcctgaatagtcaccagcctggcagttgtacaaacatccagaccttgaatcccaatttgagtttaaactgcaaaaagacacaaagagaggctggggactgaataagatgaaaggccagctcagatcttcagggaaagctattgtcttgatttttcagccttgatgagcctcatggaggtaataaaaccatgaataacattctccctcatgtgctcacaacaacaatatgactactaatagtgaggctaataaaaaggacatattgccttcaaatgccatcctttgcctctcattgtccctaatagccttggggccctgggctagcagtcatcttctcctacagatctctatctgtaaactaggtgggttggcaggagaattagtcctcttcagtcctaagattctataattccatgacagggagctcaaaaagtttgagtaattatagaagtccttcctgcagctagatatggcagtttcatgtagtagttactgtcacaggtttttcagtgatactccctgagttgaactcctagttggaccatgtgttggctgtgtctccaactcctaacctatcagttagggataatacgagcattactaggtaaggattggatattaaccatgttgtatatttatttatttattatactttaagttctgggatacatgtgtagaacgtgcagatttgttacataggtatacatgtgccatggtggtttgctgcacccatcaacccatcatctaggttttaagccccacatgcattaggtatttgtcctaatgctctcctccccttgccccccacccccaacaggctccagtgtgtgatgtttacctctctgtgtccatgtattctcattgttcaattcccacttatgagtgagaacatgtggtgtttggctttctgttcctgtgttagtttgctgagaatgatggtttccagtttcatccatgtccctgcaaaggacatgaattcactcttttttatgactgcatagaattccatggcacatatgtgccacatgaccacgctgtactcttcaaaggggatgaaactgagaccctgcaaggataactatctttttccaagttcccaagcaggtttgggagtaggacgtggtctgggaagggaggtaggctgactgccccaggccccacctcctgctaacattttattttctctgactcccactgataaaatcctatacttctaacaaagaaatgtcatctgaaattttacaatggagcacaggaaattgccaggtcactaaggtgaattatgggcacatttccatgtggtgggaaagatgacaggagaaaggacaaacctggggaatgaaactctgccatgtacacatgttctaacctgtattttggcttctagtggttgagacctcattagctatgtgtttaaccattcatgtctaactattcaaatttaaaaatctgtttcaatataaaaatataaaaagtcaccccaaatctcccagtgatatgtgcaccacggtagggaacacaggtttcgtgcattcatagacacacggaacctcatgcaggtacccaattatgctgtgcccttccccatctccatgcctttaaacttgtcacagttcctgcctggagtgcttttccccttaccattcacctggattttgaaaaatcgtcctttaacccatttctaggaggcttctgagattcttctacatgtctactctgatgtggttggagagtcctttaatgggtgctgctgatggctatcgctgatgtagtgtttacccactaccaggcactctgttaggcactttacatatattgtctcaaataatagtcctcataggaaggtgacgaaaggaagctcaagttgtgtgactaatatgcccaaggccatgggctgcaacctttttatctgtatccctcagtgcctggcatggtgttatttttcccaaatgcacatttgtgtgaggctcagcactggataaatggggaaagaatgaatgtctgaactagtgtggattaggaggaaggtgagcaaagatgttgcactgcaagtggtagatgctctccaggccagctgcaggactgcagatactgacctggggttgaggagcaattgtatgtagtttggagaatagggccctcatcttgaggctgggagcataaaggaaagagggatccatggagtaagaggtcccttcaggggagtcattagcaaaagagaatacttatttgaaaattaaatgtcttcacttcttttccaggaggctccatgacctgtttttggcaagctacaatgggggtgcagctttcaaggagtcatttcagcaatttagtccttgctccagggctaactccccctcccctgcccaatgtggtgggagggctctgctaagatgtagagcagttattaaggccttaagataaaggcagtttttcatggggtctgtttttttcccagtgacctcctgaggcagcagactccacaggcttactgcagggctatacaaaaaggtattttatgtccttagccttataaatcaattttaattgtaacaacagaaacatcagcagcaaaatggagccaaatgggcgggggcctttttctgcgctttttaaccatctcagattaaatgctgaattgtattttggggtctgagttttgtcatgcaaacgaagaaaaacaacttgctttccaatttccacatgcatatatagaatgaattgttgagacggagaatatattttgccatctcagtgcttctagaaaagataaggggctcttgtaaaaagttctacaatttgtcagctggcagcttattaaatacccaaaacaaatgtttatatagcatgagaaggccactgtcaaggtcgggaggttccagaatggactgattctgctttattcataactgtttgaaaaatctcttgttcttttctttcccccaaaaaacaaatgcaactattctgttttctttgccttaggaaaaaaaacaggcaaggagccagcccttgtgtacaggcctctaataataaacccgcaagcatggctagttgttcagcagtcatgagcaaccctacaataacagagtctcacaacatggaggctttggcttcagcaaaaccttcattaaggggtggcagagcagaggagggtcacccagtcatgaaaacaagctctgactcacatgccctaggagcaaatgaaattgggcaggagtctgaagagaagatggaatctcctccgtgctctaggaggtgcgttataaagccataggtcttgttaataagagggaccccaattcaatccaatgaccatttatttaggtgcatactaagtacaatgtatgttgggtgacacagaagacagacaaggaactgaccgtgccccccaaggatattagaatctgaaagggagatagggtagacaggtacttaagtaactgcagtgccatgtagaataataagggttataagtaatagcaaatgcaaagaagggagaggcaacaagaacaaattaaatattctcattcctttgtctttagaccagtaactttatttgagagctttgtttaactaattaattaattcaatcgctgtatgctaactggagaggttagaggactcacagaagtcactagctgcttagaggttaggggcacagtgcctaaggccccgccctgtacagggctttgctatcatccctgcctctagagaagagatttgccctctccaagatctacatggccagttaaggtgggattacagacaaaaccctcctgatactgtctcctgtctccttgcatctccctccttcccttccccactcaatctccagaatcttttctcacatccagttaacttgagatggtctgaattttggcaaacgaggttgtcctggggctctgggggtctaggtgtgaaaaagttatctctctgtgatgacatgtcattcgcctcagcttgtttcatggctcgaaatagatgtctctcattcttaatgatggcccaatttggtttgggaaaggcagcgtgttgagtcactgaccactcagggcactggagcagcaaagtgaaggatgatggggagggggagtgctgtcatccccttgctcacactggactaagagcatatagttcacatcttctgtaagcttggaaagttatcatttgaaagttgttgctctagagtgccttgacaatctaacaatacaaaataaatcttctattcacacctctccagcaagccaggatcccaggaatatgcagcaacagcggaaatcagtgataagctccctgttatgttgtcaaaacttacagcagcttcacactgccctgattaccatatattagctttctgcagacacacaaggacttgctgggaggcctttcttctggtcagcactttaaaaatattttatgtaaacccccaagtccctttggatccttccagaatctcggatttccacatgtttccaagctctaacatgctcctctcgttaggttaagtagcttgcaaacaccccgtaaatgggagtatggaaccgcaaggaaagacaataaggccagagatcatctctgtgctcaggccctacacctgagcatccctagcattttagaggctgcttgcagccagaggtctttacattgaagagggaaattgcttcccaaggaaaggcgcagaaatggcttataaaatgggcatctgtttggaggagtaatgggaagagatgaagacctcatggactactgagtctgaaacaccaaatcgatcagggaggccgagcaacagagagcagtttccagctgtggttgcagttctgactgaaaccctgagaatatgatggctgttctggaggttgtcttaagcccctcaagcccgggctctctccctgacagctgtgggtgtgtgtgtgcacactggagtgtgtgcagggaggaggtggtacgttaatgagccttgcagccggtctgacaaaccccatctgcttcgttctcttggccacccaagctgtctgccttccctggctacacccatgggcacctggtggccctgctgagggccaaataggagtgttgacatccccttctaagctcccgcagcagccaggctcttaagcagccagctagcaactccatgtgttgttaccccacctgacagttcacaattctgtctttcctcctgctgagaattcttctgttttccaggaggtgtccctagtacccttcccacccgctttcatcctctttcttcagagagaactttgacccagaaccgagtgactgttatggagctacgaggtccttgtctgaattctccgtgtggttgctggcctgtaagctccaagagggtagggggctgtgtctgaattttggttaattgctgcatccctagaaccctgaaaagtgtctagcacatagagtattctcatagctgttgacaaactggacagatacatgagtaatgaataggaacctgtgcattggacggggacggtgccagctacagctgacccttccctcacagcatgcaacgttagcaatgaacttcttttttttctttttcttttttgagatggagttttgctcttgtcacccaggctggtgtggaatggcatgatctcagctcattgcaacctctgcctcctaggttcaagagattactctgcttcagcctcccaagtagcggggattaccggcgcctgctaccatgcccagctaatttttgtacctttagtagagatggggttgcactatattggccaggctagtctcaaactcctgaactcgggtgatccacccgccttggcctcataaagtgctgggattacaggtgtgagccactgtgcctggccagcaatgaacttctaagagaaatcagatcaagccctcaaacattaatttacagtcaagagacaatctctgaattcagccctccccgtcccccagcactggtattgacatactgcagaccttctattgttggtggcaaatatgagcaggttaaggcacttttcgggattagagaatcttcaaactcaatatgcataagaacaatttatcctgatgaccagatataatagattctgttcattaaggaaactgcttgccatttgctactatttaacccattctttctattgtgatcataagaagaagaaggccaaaggatcattaatttccttactttggaactttggggtccttaggatagcgctgtgtatatggcaggcactcattactattgttttgtagatgtggctggtgataataatgagaaggactgggggaaaacgaagtatgctctccaggctaaccgttggtggtttaggcagacggaactcctctcaggatttattcagattcagtgacagcacttcttgaactctgacaccactccacaattaatattgtccactgaacagaatggtgaaccctgagcatctttcccatgaaaggcaagacagatgcacacgagtcagttctgccactccagtactccgcacggtgtctggcacacagtaggcacttcacaaatgctaacaacaatttgacaactagattgcaagctgtagatttcagatgcaaggcaatggttagtaactagattttcttagtccgccctgactttgggcctttgtccatacagcaccacactgggcgtcagggtccttttgttgggatgagtggctctgtcactctttcactgagaccaaggctcaggcaatcaagcaatgcatttcaatcaacttctacaatgatccaatttctgggtctggctctgtttctctatttcccagttacttgcccaagaacatggctccatctaaaggaagtggcctacgggaatctgcgcacctctgctgtgaccgggaagctgggctctcattggaggttgttgggctgcagttcacggcccaggtgagaccacactgcagaacataatgtgcagatcaaggcaatgatgcctgtttctccatttcattagccacagctcactatgtgtcaagtcttgttttctccagtttagactcagaaactgacttccatcattgaaatagggctcgtgtctccttgtagtaactgcaaggctttagggaggtagaaaaaatttagtgaaaataattcagcaactcgtttgagctgaaaataacttgattcaaggactgtgccttcagatacttgggaggcatgaagatgaaggcatttgcagtcttgttttcctttgtgactggggcattaataaggctttgggattcacttcaaaatcattaaaaacatgttcactagtccaaagcacctctcccacctgtgtatgaaacaaatgaattggtgggaccttggatcctcgtagtttgctgctcctggggtagtccctcactaagctccttatcacacatttgcactgccaagatgatatttttggttaaaaagttataaatattctggaccaaaatattaccttgagattttgtccacctgacatccacttcattgagtgggaattctgcccaaagaattactgaagaatgaattcccctgtttatttagagcttgatatcttcataaccattttgactaacattaaccatttagtcattaggacccaggagcacagataattggtattgaggttcacatatgtggtgaatttcaagcaaagaggtctcaaatatgaataagtgaatagtgcccttaaagcttcttattcagaatctacaaagtgatgaaacaaaggcaaaaaaaaaaaaggtgggatccccgaaactagaaaaaccctagaagaaaatctaggcaataccattcagaacataggcacatgcaagggtttcatgatgaaaacgccaaaagcaattgcaacaaaagcaaaaattgacaaatggggtctaattaaactcaagagcttctgtacagcgaaagaaactatcatcagagtaaacagacaacctgcagaatgggagaaaatttttgcagtctattcaactgacaaaggtctaatatccagagtctacaaggaacttaaatttacaagaaaaaaaaacccggttaaaaagttggcaaaggacatgaacagacacttctcaaaagaagacatacatgtggccaacaaatatatgaaaaaaagcttaacatcactgatcattagataaatgcaaataaaaaccacaatgacataccatctcatgccaggcagaatggctttttttttaaaattaaaaagtcaaaaagcaacagatgctggcgaggttatggagaaaaaggaatgcttttacactgttggtgggagtgtaaattagttcaaccattgtgtaaattagttcaaccattgtggtctcaaagacctacagtcagaaacaccatttgacccagcaatcccattactggatatatacccaaaggaatataaatcattgtattataaagatacatgcactacatatgttcattgcagcattattcacaatagcaaagacatggaatctacctaaatgcccatcaatgatagactggataaagaaaatgtgatacatatacaccatggaatactatgcagccataaaaaggaatgagatcatgtcctttgcagggacatggatggagctggaagccattatcctcagtaaactaacacaggaacagaaaaccaaacactgcatgttctcacttctaagtaggagctgaacagtgagaacacgtggacacagggaggggaacaacacacactgggacctgatgggggtgtgggttgggggagggagagcactaggaagaatagctaatggatgctgggcttaatacctgggtgatggtggtgggttcatcggtgcagcgaaccaccatggcacacgtatctatgtaacaaacctgcacatcctgcccatgtaccccagaacttaaaagttgagagaaaagaagaaagtaaaagaaataaaaaggtggattcctttaggtcaccttcttgcagttgtaccctaaatttagaggattcatcattgacatgcagaacacctaaacctgttgatccattcttttgggtgtaaagctttaaaaaaaagaaagtctcttacggtgttggcttatttaaaaacagatgacaaaagacacctggcttgcagttttgtctttattctccaggaccatgaggagcaattagcttttacaagttcatttccataacaacctttagcacacgatatttctggattgagttaaggatgggggcatcaagagatgacttggctctactcaagattccacgtggaaggaaggggcaagcctagtgaatgagtcacaccctgattctgttcttagctctcacttctcccactgtgtgacctgaggcacacaactgacttctctaaaccctcatcttatttctctgtaacacggggaaggatagccgctattttgtgaggttgtggaggggatgaatgggacaaattttgaaagcacacagtatctggcatgtagtagcatttcataaatgtgagctattataattttatttatttatttttttgaggcggagtctccctctgtcgcccaggctggagtgcagtggcgcgatctcggctcactgcaagctccgcctcccacgttcacgccattctcctgcctcagcctcccgagtagctgggactacaggcagccgccaccacgcccggctaattttttgtatgtttttagtagagacggggtttcactgtgttagtcaggacggtctcgatctcctgacctcgtgatctgcccacctcggcctcccaaagtgctgggattacaggcatgagctgctgtgcccggccgagctattatttttatcatgaggtatattccttgttctcttttccctttgaggcagctcttgttgactcttaataagcaaaaaccacacgacgacagttttaactggcttacgtaaagttcttacagatccagagctgagttcatccactacagatgaagaggaattagtgtgtcttttgaatattaatgaataaataacctctttccttgttatttatttgtattcaaaatgccattgctagttctagtgataattattgaattttcaacatttatagaaaaacagcatatactgtataaagataattgccgtattggagtcttaagaaagagttagttttgtataaatatggaatgccagtaattatcactagtgctacatgttaaaattagaaagtaggtaaataacaaggacagtatgtattctttataattcaaatgcatgtcagctcaattatcctacaattgcatagacaataggtgaactgtttttctcctttaaggggaagacttctttccgagtttacgtttcctgaagttgagtgaagattccatggtttgacaagccaatagtatgataatgggcaatattatttaggagtgggctgatggcaggtttgatctctctgtgcttggattcactgcctcaattctgaattatgttacaactgcttagaattttaaagttagagacccgctgtggagaaataaagtcctggctatgtttccattttataatctctcaggctgaattttgaggccagacctgagtacaaatctgtaacccaggaatctcccacgtgctcacaaagttccaaggatactatttaatctcctccttttcaccaaccccatctgcaccccagcagggaggtcagtggctacatgaaagcaaaatctaaggctcttctttgcgccaaagcctggtctccatgttgttacagaccaaagccactctgaaagccgcaggaggctgaccacaatcaataatcgttcaggaaacaaacgcagggaagagaaataagtgacttattgaaaaggcacccggaaatggcattagcacagcactgcttctaatcatagactcagcacctcagaggaacagctgagcagagccttgttaaacaaatgtagatatcatgggtgtttaaaggaaacacgttactttagggaaggaagaacctgttgcattaaaaatagagctaaggtaaagagcatgtacttgtaggcttgcagggagaaaaataacaaatgaggaaagccaacactattaaaattaataggaaagatagaaaaattaagcagctggaccatggataaacagcaaaaaagccaagtgtataaaacagctcatctaagaccagaggaggcagaggggataaacagctcaccctgttgaggatgtttacttttgcatctgtcaactgaaaaggaaggaaatgaggatttgcctgagtcagaatgagtttccaaggaaagaggatgcagtgtaccacagaaaatggtggtgatgatgacagccagtcaacagaagctgatggtgacttagctggcatgctggccatgggatgcgagtgactgagggcttcagcttcctcattgtgggggacagaaggggatggtttagcaatatcctcaggcttctaccttcccatttctcccaccaatcaggcattagcatccccagtcctctggtgtcctatggttggaacccctgctcggtactccctgtcccatgcccagaaggggatgccttgctttctcatccttccagcctatgtggctgcaaaatgacacttgtaaaatgacatgcagaagagcaatgagaccaatgccagatcccagaggggtcagggagctccaccgagcttccctaacttgttcacatcctgtcacgctagctaatgatagcatttgtagggcagctggaataaacatgtgatggacccatatctagaggtgactctggcactctggctgtcccaaccccaccctgatctgaaggctgagggggtcattatgtggacccactacaacccacgggtgggaagctctagatcttggcaccccgtcctcttggctctggctgagccactcagctcttgaatcagaggcttcagcaggaggagaggctcaaatgagcccaagctgattaaggaagtggccatgctccacagaaggacagatcaatcttgattagagtattaggaacgtttcgaggatgcctcgacttagcagacaactggcatggtggctgtatcaggggggcaagagcatctgtcaaagatcaggttgtaaggtgagtctaagtgtctagggccatggacactgcacagccaggacagaagccagctgcgtgccagacgaagtgttttcacagctggggaaaggaaaggcacagattataggacagctgtttgcaattgcttctggcccatcaataaggcaaacagtgacttaggaatgggaagagtgaagaaagtaagtgattttagggaggcagtgtggcagaatagaagaggctcaataggctttcacataatgcagaaggaacttgaatcctgcctctgccatttactagttgtgtggctttaggcaccttccgtaacctctctgagcctatttcctcactacttatgataacatctcttttacggagttgttgcatatattaaataaaaacatgtctatacctagaatactatagagtttcaataaaatattaaccattcctctttactatgtatgctgtttaaagcagaaattgtgtagtagtagtagtagtagtagtgtgtgtgtgtgtgtgtgtgtgtgtgtgtgttgggaagagggaacattagacttatctgaaagtttagaaaatactacagaaagacacatccttattgattgacagatattctcctgcaaacactctgtcttctccccattgtgtagactctggaaagttattgtaattgttgatttcaggtcagcctctactctacctgcagcttggtctctggttttcaaattctgtagaaatttttacagctgtttgacttccttagacatgagacatgtactagatggcaatagcaggggacgtatcccctacactcctgtcctggtccaatgcctaacccatggggaacactcaatacatttatttgaactgaaatgaacctggttggtgggcgaggccgctaggggtagaggcagttggggaggaaggtggcagccatgtgcatgttggagatatgtgagtagctttaggtatctggaccccaaccagcccagtgaagagggtagagatgcaagacttgtagatatgacatcagagggtggcaaataatctgggtccctagcatgctgggcagcctgaggcgacggtccggtcagccaggctcagccaagcccctgagagcatctcgcaggaggtaccgttctgtccccagctgagaggcactaaggctttcccagcagaggttcagccctaccagagccgctcaggggaatgtgcagaaggaggacaagggaagcaactacctgacatcactctgccctgcttgtcaagacaaaacaacatgaatattaatttctcaggcataataaggtgtggaggagcaggagtgggcagggccattgtgtgggaggctgctccttcctgccatttgtcaccggcaggagtgatagatggttcttccaggcagcttcccaattagatggatacagccaccccaattaagagcacgttggccatctgcttcgcaggtacgatggcattaggtgctttgggcggggctcaggccagactttgcaagacactagaggaggcaggaacgctcacatacacatcggtgagcagaggccacaggcatcactgaggccaatgcctaggcctgtcaagaggattgtacctgcagataatctgccaatgtacttatagccttttgccagactcactaccaataactaacaattatctgtaagacagtggctcttgattggtgagcatcagaattatccagggagagtgtttaagaataccactctcccgacgcaccccaaacattcagagttggactttccacacttgatcagggtccaggacacctgggttccacttgattacggctaattaggttatttatttaatgaacagctcattaagatagtcatctgaaatttgaagtgctttcaacaactttcattcattctctcattcattcatgtaagatttttagagcacctaacagatgctaggcactattctaagtcctgggggtacaccaatgaacagagcagaaaaatccccctgccccattcattttgttcatgtgaatactttcttggtgagagtgatttcagctagcacatagtttagagagaatgctgcagagggaggcagatagctgagtttcagggttaacccggagttgcagagttgcgaggcctgctcctgaactttctgaatgaagctttgtagcaagcctttaaaaaaaaagtaaccaagaaggtctgaagataaagcaagccaaccttttcctgcaggaaaagatacacgcatagaagatctgtgcagctagagctaatggcagcttccatgatgatcccaagtggaataactatataaggtgtggattctgacccagaggagtttataatctatcctggggaaatgaataagacccaagaacagagaagaatacaaacacacgataagaggtaaaaaattttgttgaaggagggagcagaaaaacttaaagcagctggggcagacttcatagcaggcaagttgtagggtgttgattcaggcctggaaggatggatgggagggtctggacaggtgggagatgtggtgggagataggacaaggcacaagcagagtctcagcgggcacagcagcaggctggaggcaggacacagaggccagagctggagttgaggccaaacagccctgggtttgaatcctccttttgtcactcactggccgttatagctgtggagaggatacttatcccccttttccaggtgtggaaactatgggtaagagacattgacagctaccttgagttttcgtgaggactaaaggttttatatctcaaggacctggcgtgcccccaaggtgctggatgggtgtgtttcgagcttactaggtctgagataccacgggcacacaaaatgtttttaaagaactccaaaacattccctctttatctctcttgggactgcaaaaggttgatgcactggaatgatttgtggcttcactatgaatggagtccccttatcgcagagttcattatcagaaggctttagtggatatgagaaatgttgtttcttcaattctcagggacagataagcaagcaatctcagaggggttttcctagacaaggcttctctcccttttgttagggctgaagaagctggcagggggacaccccccagcagtgcttctcaccactgtaaagctgatagaatattagattttcatgggtcaacggataaacacagtatatatatatatatatatatatgtaacttccaaccaacatcccttcctttggaaagggcttacctggccatttttggatattcttgctttttaacctgggaccttgtagttttcaggagaagtggcatttgatatgtgtgacctgggcaaaaattatttaactattagggtccccagctccctcatttataaaaggggagacatcattattcccatcttacagggtgaggtaggcagaataatgtaccccctcctaagacatccatgaatgtgtgaatgtgaatgtgttatgttacatggcaaatgggaattaagttgcagatgaaattgaggttgctaatcagctgaaattgagatgaggagagtatcctgggccatctcggtggcccaatgtaatcacaggagtccttataagtggaggagagggacagcagagttcaggtcagaatgacgcagggtgcaaaagatcccaccagccctagttggtttggaagatggagttaggggacatatgccaaggaatccaggcagcctctggaaggtggaaaaggcatggaagcaaattctccctagagtttccagaaggaacacagccctgcagacacattgatttaattccagtgaaatgcattttggacttccgacctccagaactgtgaagatagttaattagtgttgttgtgagtcaccccatttgtggtgagttgttacagcaacaatgggaagcaaatgcagagttaatgagagaatgacatattacaatgctttcttgatctgtaaccttgggcaagccccttgatgtctctgtccctcagctttcataagtataatatgggaatgataagaatggctatcttatggaattgcctagtacacatgaagtgttggaatgctgagacatagtaagggccctggaagtgttggctaacggtattactattatataattactattatataaagcacatagactggccatgtagtatgttctcaaacataactatgcttattatttgttgtatgggaaggagaaggagccttggtgagtgctctagaacttctaatttcagtagctctgcttacaatgtaggcacatatcacaaatttcaaggggccctgcccttttaggctttgcccagttcctgttttaataggaatttatgtttccttaagaaaggtgatctgaccctggggactttttgcaactcatatagtattgaggttttcctttcactgttgtacaacaaactaccccaaaacttagtggctttaaataaccactattatagctcataattcatgggttagaaattcaggcagggcttggttgagtggctcttctgctccatgtggcatccactaaagtcattcagagttactcagctggtctgagcaggagggaggatgaggaagctgatgtctgggttgggctggccggaagagccagggtctggccagtgttgttctctctccacggcctctccaagtggcttgcttggacttcttcagaacggggcttctagtaagtttccagagactcacacctgcaccaggaaactcacacagtgttatatccactgtatactataggtcaaagcagtcaggtataccatatggattcaatgggatccaatgaccccacctcttaaagggaggaatgtcgaggaatttgtgagtatctccaatccaccactcatctttaatactcgctggagtatttaatactcactggagagaactcagggagtgagaaacagatgagatgtgagagactaaacggtccatctgaggcaactcagcaaatccagagtccatgggcctgcctcacactaaccattctggattctactaacattgattatctaccatttagaaggactggtgctaggtactttcatatacttgatgtcttttgctgctttgaaatgaaagcattatacttcagctaagggataaaccaaagcctggaggacaagtgggggtgcaattgaaagttgctcatctaacctccagggcctttgcttttcattacaggctcatataacctggtctttatgcctccattttttctgactctaggcaggcagaatggcctcagcaggaatgcagctatgttagacatctgtgtcctgggagaccctggggcactttgaatcctggtcagaatggaccctaaatgagctcatgtttctaaagtgctctgagctcctcagagagcagaatccatttaactccagagcctggatggtctcattggtgggtccctgcagtgggggacatggtttgtcactgctagcaccaggctgggaccttggataaatagggagaaatcagtctccaggcttctctatctgccatcttttcagccacaataaattaatcttcagaaagatagaaaacaacaaaagaagggagaggggaaaagaaacaacgacctatctgacaagtctgaaaggaaaacaagctttctgctgctacagtgccccaggtgaagtagggggctcaagctggcaggtgggtctgaaggagcagacgaggcaccctggtgctaagcacactccgggaggccggggcaggtgggcagggaccaggtgaagagccagggggtatcttgctggagctacctgtagattgttctggatttgttagcatctctcaaaataagatcaacttgatgctgattaaagctgaaacaccccacaagcctagcatgctgagtgtctgactctagggcccctgaacaaattgttttcccttttcatgatgatctttgtgaactctttggttcagcgtggctcgcccatggggacagggctggaaatggaagcacaggtttcctcttggcacctagctgtcagaactgtccccaggcatcccagcaggagggagacaaacaagcattctcatccggcaagctgatgtctgcatatgcaaatggactgaaggaccctcagccttgaatcctattcagaaacagtctacagagtgcctacctgtgccaggtgcattcacagaaatgatttcatttcatacaacagctctgtgaagcagctaggtattatttacctaagatttgttataaggacgctcaagttcagggagggtaaacaactcacccaacgtcacacatctagctgtggctgagacaggtctcaatcgatccagaaagtttatttaaggatgcatgcccaggaagtaggtctgtgcctttttccaaagatgattttgagggcttcaatatttaatggggaaagggacgatgttaggaaaagaggaagaaatttttaaaaggtgtgggtaaatcagagacaaatggttgcattattttgagtctttgatcagcctttcactgaatacacaattatatgtgagagagggtagaagaataaccatttatgccttggtctggctcagtaaatctgcatttttacctgagaggaagcaatcagatatgcatttgtctcaggtgagcagaaggatgacttagagttctgtcttttgtcccgcacctgtgaagacaagctattgatttacactgtcggaggtaaaattcaacagaaccattttagggtaaagatcttgaggcccacaaggaatttcctctcctagtggacaaattgtgagggacgtatgtagcctttttaatctttgtagttatcttatttaggaataaaatgggagacaatttgactgatgcagttcccagtttgaattttccctttggcttagtgatttgggggtcctgagatttattttcctttcatagtgatttccaatgataaatatgggctcctgacccagtctagggtactttccaccaaccagtagctacaggtaatgtggctgtatgtagaccaatcaaaacgaagcgcttgggcataaaatgcctcttgaaattatgcttcatgtctgtgcacttgacctaggacaggaattttaaactttgacagcctggtgacgctatgacccccttctcagaataatgttttaaaatatgaatataaaacaaaatacctaggattacaaaagccagttattacattgaaatacaattataaaaatattaaaaaacaaatttgtggtatggtaatgtgccttcttctttattaatacagtgaataatgagatctagcaaaggtttaataatgactgtaatttcaagtagtgatgagcataaataacattttgagatttctgcaaaaacattaacatgatctgaatatacctgagattttaaatggtgataaaaatcacaggctactgctgttaccactgggtttgttgtctatacttacaaggaaagggaatactacattcctgttagaagttactgaaaataaaatgcgatctttttccaccatccaggttcattggtccctttgattcccttgggtcaagcactttatgtatttttacacatttaatccccacagcaacccagtgaggtaggtacttccactatcctcgtttcacagataaaaaaactggggcacagagggattaagtaacttgcccaaggtcacacaaggccgccgagttgatacgttaatcaggttgtccttttctctccaaggggggattctgcaaccctcttgaggaataatcatatcaaggagaatcttccttttggatttttcccagttgggttcagccttttctagtcactccccttcctgcagaatttgtcgagtgccggtccttcctctcagcctggttagctcctagtcactcatcagatgccccctttccaaagaaggcttgaatagttccccaccccattacgcttgcccccagctcttggatgtcttccccatggtatttgtgaaacctctgtctgtgtggtcattaagttaacacctgcttttcttgctagatagtgcacacatgggacagaattctgccttgttttgatgatctctatatccctaacacctaactgtctgtccggaaaaatttagatgctcggtaactgcttgcagattgaatgaatggagaataaatgaattactagtcacagatgtaaaactgatttcctcatcatgattactgacttccttgatttcccatatgaccatgcagccaatcatcagctattttttttattgctgtttattaagtgggtccctttgtctctctggccttcagagcatcattctttctctcctgtgaaccttctccaattttttaaaacattatttctgctttcgacttcctctcggcctgctttgatcttccacgttctgcgtggaagttatttctgctttgaactttcacggctaagaagttttgggaaatacgtgttggaggtgttgggaggtatgactccacacagaagctggctctccttcaaagttctgtgttctggtctgcagcaaggtagaagcctatggggtttcaacctgacagcaccatttctactcacctctaagaatgtagctgtgagacaggattcaaatgtttagactggcaacaaatgagtatctatcacgatgcttaaagtgctctcccccaaaacaaatgttgtcattaggacatttaatttctgactctagagtctctcctgcagagggaagactttcttcctcagcttctttgctgcagtgttgaaaatgaggcagagtagcagaggtcatccccctcccttttcaggctgctgggattatggtgggcagagggctttccttgttctgcttttggggtgctccccacccaagctgcctttaattttgtctgtattttcctgttttactgcttggtatttggataagctatagagaggaacaaaatgacattcacccctcagagcccccaaatgttaagaatcaatatggaagtcttcccagattcagattttttttttttcttgagatggagtctcgctctgttgcccaggctggagtgcagtggcacgatcttggttcactgcaatctctgcctcccatgttcaagtgagtcttctgcttcagcctcccgagtagctggggctacaggtgcatgccaccacacccaactaatttttgcatttttagtagagatggggtttcaccatattggccaggctggtctggaactcctgacctcgtgattcatccacctcagcctcccaaagaactgggattacaagcatgagccactgcacctggctgattcagagattttattacatttttggggggcattttagattaccttagagaatgataatattgcctcttctaggggtgagaaaaacagtaatgcactttcgaggatattcatttgaaccagttttgaaaataagtctaaaggatttctaaaaccatataatgtatggctgcaccattacataggtgggcatatcccaaagtgactgccttaaagtcgataacaatcatttgggtatgtaagtttaggtgtgtcatttactttgacttgcacctgagtaagtgaaaggggttccaggtatgggaaggagatcttcaaatgacaggcagcagagaggggcaattttcttcctgtttttatctgaactactctgaaagaggagagggcactgccttgtcatctgattgccactggataatgttccgataaatgacacaatggtaagagcattgggttttggaattagaatgacttggatccaatcttagtggatttgtgaccttgggagcaatgtgacttatcttttctgacacagtttctcatctgtaaaatggggataatatgacttacctcaaagattattatgaccattaagtaaaataaagtatgtgaagcatttagtaaagtgcatgacatatggtaaatatttgctaaatgccagtacttttaaaaagaggtaattcatccgattcttcatcacccatgctgtttattactcagtttactgagtgctttaacaagcagggtcccagttaatcccaacgcccaccccctagagggcacattcttttccctattctgagctgagaagccatgctggcaaggtgatgcgacctgcttgaggtggcccaggtagtggcagggaggagaggtctgaaaggcaggtctcctggcctcatctggggtgactttccctacatcaagccttagtctctcctacaaagtcatcttggaagtcactgaataaggggatctggactttttagaatgtggcagtataaaataatatggaattctaaaaatgagtgtggttgtctaatgtgattggtaaacagcaggaccaggggagtggggggcaagacaggtgtcaacgcagcagacatgaagggtgcactctgctgggtacagatctgccctcactggacccgagaatggtgcttccttaggtctgcatccctgtcctagtcttgcacgtaggctctgcagtcacgcttaagaatgcctgatcaatggcagcttctggaaagactgcacaacctttaaaagtgccagctttgaaatgcatccccatctaggtgtcttagttctaagagtttttatttatttaatttttatgtttttaagatcagagcttagccagactgagcagttgggttcccctgaaagtggtggtggtagattgggaggtgatcccaggaagcagatctgaaggagaggggacagtgagatgggaaaccaggagaagccagcaggagagacagtattgaggccactgctgtgattcctctggacctctgaagaggtctacagaatgcctcccaaatttgtccctgaaggacaggaggctggagagcttgtctgcctgcaagtgttccctgagcagtaacttctggatacctggggaatatttgcatgaaggctgaggggacatccatggtgctggcgaaggctccaaggtgggaaggagcaagatggaaacaggaggaggagagcctgagctcctgcggagtgtccatcccagttcaggctaaaaatcagtggtggatcaacaggatctgtcacgggtgctaatggcaaagccaagagggtttttctgcatctcataaaaggtaaagggtaaaagttacaagacaaggaaatagatgtgaaaaagaatcaatttgcgggtacaccattcatgaatcaataacttttgctaatcaatcctagttggttaaaaagatctttttgaccaagattcacccactagattccataggcattaagaatccagctcagaggtagagtaagctgcctgtgtgatttcaaggacctcgtgtggtcttgtgccccaaactaccttcttacctgccctggagttacttaaaatccttgtcttacagatggaccctttgcattgggaaacctacttcccaatgctcatgtgttcatttacattgtcattcatcaagaaatagttagtgagaacctactgggtgccagggaccaagcatagggactatagtgtggtcaaaataggaagaggagaggtaagaatgggtatgtttgaagagcttacagtatacataggaaacaaggaaatacacatgtgaaaacctttatcattaaaaggcaaactctgattaaatgctaagagagtgtaacagagtcagacaagtgcgacgggaatgtagagggaggttttcagaagactggatttgccaagaaaggctgttgggagggagtgagttttgtcctgagcctggaaagatgtgcatagtctttccacagttatttctctaaccacacaagcaatctgcctcttttgtttttcttccagactaaacctttcaaggtacaaaaataaatccaagagtatggcattaatagccatgttatgatcttaaacctttggttgccttgcaaaagaaaaaaaacccatccccttactgctggaaatcacatcgctggcttacctggaagttgttcatgaatgaacaacccttgctaatcactctggtcaatatttatcataggtacattttacaagatgaattctgtcaccagtgttggcagcttctcaccaagtcccaccagcagctgcaaatattcattaataatattttgtttgggttcccacttgccactttccatcctcctgcttcataagtatgaacagcatcattaccaagtggcgcccacagaatggaacacaaaggcaacttggaaattttaatgaaaacagatgttgagaaatgccattatcccatgcacgctacaataaatagcattaacatttctaagtgacaggcctctgaattggactgcaaggagctcacatttacaattaaatgagggacttatccttttgcatccctggattctacaggtggctcggtgacagtcatctcttagtgtttcgattttagagcggctgttaagagccagctaagcagggattggacaggcaggcacttaggaaggtgttcgtgccagacgcattcattgtctaactgcctggatgcaaaactaacttagcatagcagctgaatgtgaaagctcttgaaatgatttcttctcaaatagtgcactccctgtgccaaggaggggtatcattgtttatgtcactaatgactacatcctgggcctccatgcattttgtaacccctgttcctttattagagcaatcagaaaaaagatcacataattaccaagatgttgctttatgggcaaggggtacggccacatatgccttcattgatgtgaataataccaccctgggcattactatcacccagatttcacagatgctaaacccccagcatagcagttaggagcatggactgtggatcataggagattggggttgaagcctggcactgctacttattagctcttggttctcaagcaaattgtttattttgtatgggcctcactgtctgcacctataaaacagggacagtgatatttactttcaggatgttgggtaagtatcaaatacccggcatgatgctcactgatagctgttggcttaggctcaattttgaggtcactattatcccacctattcactggtgtgagatcaccttcaccaaggtaatgttccatgaggacggtgatggccagagaaatgttggactgaatcagggcacagctttcttggaggctatgctcaatatttattgtcaatctctctgcctctctctgtctctctttctctctcttaagtcagtctctctgtctctctctatctctctctctttctctctctctctctctttacccaaccacttttcttttgaatagccatcccagacatcaggtaaaccttgccctgactgaaagcattctttgaaccactttcttcaagcaaataggtacatttaattctaagaggaccaagacaccttagaagcaatacatggaaacctccttaattgactcagcaattgcagaatgagtccctgagtgacttttaccccaaatttagaagttggaaaggggtcacttacaacagaaaatatgtattttctagtttttttttgaagtatacttggcctatagtatttcctgaggggatcctaatgcctttctattaaagcatgaacccgaagttgtaaatttagagaaacaatttgaggtgagggtttgacataacagatggccaagggactaatgacaagatcatactcttggctgagcatttggaatgtctcattatttgtaaaacattgtttagaaattgccttcctggcatagaactggttgacacacagatattaatgcatctaaccctctaaactgtacagataatgtgcttcttaagtctttatatttaattggctttatactacttaaatattggaaactgaaaaattcaatgttatttccttatcaagtatttctgcctttacacttttaagatgaggaaaatgagccacatgtcccagattccacaacaagagggagtccaaatgggacaatagggtcaagttattctcacagttgacagcacataaggatgatcctaggtgcacacactgtgtgaacagacattcctccctttggctcagtgctgggttaaacgtgcacactgagcgtctactagtgtaaggccaaggggtcaatgcatgtttgctttgaaagtgaatcgctcacaatgattacacgccagggagataaatgtgatggaggaaataaacaaacatgtgaaagttataatagctttaaaataaacctgttcctagaaggagacccctggaaatgcttgtacataaaggcaacctcctccctttcccagagctgagactatcgtgaggaaagcttgaagcgggactgtatttgaagacagcaggttccttgcatgttcaaaaccactcagagctagtgctctgtatctcattatggcagagccagatcgcgagataagcttgtgctgccacaatattactgttgcaaatgtgtggtcctgaagggtcttctttggaagggctctgctctcagaaatggccttggacttgcacgctgggaatgttttcatgagcggacatagattttgaaagggtcagtgtggctcaggaggcagcaactggagaaatagaaaacctactcctttttggtctggacgcctttcttgtgcttcgattcttcaaggatctaacagtgtttgtttcgtgtttctgtttggtgtgcagacggcatattccctttaacatggatttgttcgagtagacttcactatggtgcacagatcaagctatgttaaaataacgttaaaggtctgcactgaagcaatctgaagcagagaattccgcgtttcaggctgccacaccacctttaaatcaacggaatgtgtccgtgtgcggctgtccatagactcttctcactgctgttatcctcataataggatcattcaggttctcttatctggtctcctagatgcttgtctccaactatttcaaacagaagtgatttgttacccagcaccaccctacttcctgcaagaggcacaaggatgaagcaagcttgctctaatggggacccagttttccctgtcctcagttaagtattttatttacagagctaatgagcccttagaagcatgaaataggcacacccacacattacaaaaaggcacacacaagtgcaagttaaaataatttatagtagactggattcactggtggctctgagaccagtttgcccactgcaggtctgcgcagccagatgcaaccctgttgacagagatgaatttgatcacctccacctgcacaccttttgctgtattagccaagtgtgtgtttctttatccactcatctgtggctcccacttaactggcaccctttgaatatcagcagccctccctttggagagccagggaatgggagtcacaaaagtgtttcctcatgctgaaacatgaaaattggaatttctttatgaagacagttggtgatgtgctaatatgtacaatgaatgtatggcctcacacctttagcccccgagtgctgcatgtctccaggtaggcagacaggctgcagacacacacagctccctgctgctgttcaacaaatgctgatttcaaatcacacattgcccatcttcctgagggtcacatttctctttgctcattgtttttgcaggtctgattaagtcctatattcctgaaaatgaggttcagcctatatctgactccagatttatgagggagaattaacaccctgctgcttcctaaagctttattcccttgcaagtctacgttttgtttcagcctttggagttgaccaccttttcttgcaacttctgttgctctcagcgtccctgtctccaaatgcattgacccaaatgtaccagtgcttgggagaaagtttgtcttctattcatttaagattctttttctactttataattatgtaccaggaatagcctaaatatcaccaaaatgtaacctactgcaatacataaagaaatttaagttgcagtttgaggttcgcctctagttcctggaggcactttttagtgctttctgatcccagcacattatctctgttttgcaagctgggaggtgaggttgtcataggtcatttggcccagaatttgggtgggcctttgatttctttccagggcttactttccacacaactgcagccaccagaatgagtcagagctaggctgaaactattaatcggtatcgtggttaacatcttatccaatttgggcctaagagaaaagcctgactcacagataaaatgtggaagttatttgccttttcagaagccccaagaatcctttctatcagactggctcccggcaggaaagagaaaaaactgatgacattggcgatcatctcatctgctcactattgaggaaaaattagaaatcagatcactcaagagcactgtgaatgccgtgacaaaaaattattttgagatgcgattggtttgaaattctgacgtctaagagtcttgccctatctgatttgtaaagaagagaattctcagaacaggagtctcagcaacatccttgaaggccttcctcaccggcgcacctcatgctggactgcatagaatggcactgccaaagcactctcatctgtgcagctggccctgcggccctggcctgtgccaccattccagacacacaaggaatgcaccacagctggcacataattagaagctcacagcaaacaaatcattgcttttttgtcagtgttcctcctactgaccatgctcagagcgtggcagctccacccacgtgccaacaaacacaggacaacaaacagatatagggggaaacaacccaggtgcctccagttgtgtgttttgcagtggtttccctgccacttccctactttccagaacataattttgtttgaaattttctgtttctaccatcgtggagtttcccagtgaaaggcctgtgattaatcctcagtgagttgaattctcctgaagacttatatttaataatgacaccccatgcagaaaacaattcaaaacaaagaagagctgctttaggctctatacctcccagggcttgggaataattgtctcctataaacatcactgacatgcccaagaaggtatgtggcacttgctcaggtttaagaaggttctttgaccccttgtggatgctaaggtatagccaaggaataaataggctggtagaaactttaacaatgagtgatgtcctgaacttgaatgtaggaaaagaattacattaaaacaaaccataagtcagccagaaaagaaaagcagagcagccagaaagattgaagctccttgcaaatccaaagatggacttccctatcaaattttaaacaaacacaactaaaatttatgaaatgcccactacgtgtttgatcctatatgtgctgagtattggaggcagaatgagaattttgatgtggtccctagccccaaggaatttataatatcatcagtgtgaacagaggcatggacaaagtgctatgggggctcagagggggacacagattctacatgaaggagtgtacctaggagatgggtattgaagtgtggtgttgtaaagaatataatcccctaaagaggtctggcttttgccagtacctttgctagtgtctctagtgccttcctttgcctaggggatttggttcacacttggatagtctagtaatgcgatttagggtgggggctttggctctcgaggcaccagtgcactagagactgagatcaaccatatgggcaatcaatcaatcaagcttgcctctgtagtggggccccagtaacaactctgaacacggaggttcaggtaagctgccccgtctttgacgatacttggtatgaattgttacacattgataccaggaaagtaacatgtcctgactccaggggaagaagatggacaaagctctgcattctgtacttctccagatgctttcctgtgttcttcttcctgtagcttattttaatcatttccccacaataaaccttaacggtgcaaacaatagttttcagtcagttctgtgagtacttctcaaaaattatgaaacctgacagtggcttggggacccttttgcccttgcagttgatgtcagaagtaatgtggtctcttgagagacctattcattctgatggttcagttggcataactcacacaaagatgccacaggaaaactactcaatctgatacctttaaggttcctccctgatataaatcctgactccaatgaagccttgataaacagcctttgtgcccttaccaggattctaaagtatatgataagggtctgagccaagccaatatacggaagatgaacagagtgcctgaacttaaactaaacagttcaaaacatctttactgtattgacaatctggttaaaggtgcctacctgggactcctagaggataaagttctttttctttatcttatttaccaaatgaaacaatgtggtagcaagaaagccaactttctgttgtgcatatgacttgtggagagaagagaaaatgttgagaattttttccttaactcctcattgcagaatgagtcaataaaagagttatcatctcctagtgcacaaggtggacgttatccagggggatgaagcatgcaagtgttgcatggtgagatttgacatagggctgcatcctccaggaagctttccctgaacctggtggtcatggaagcctcacagatgttcgcatgacatcctgtgcctgactctgctgtagctcttcttacagaacaacaaacttatttgtgtgctgccttctaacagaacctgagacccctaatggttgggtcagtgtggtccttgctttggtattttcagtccctcagacatttatgggcctgacccatagaagatatttgttaagtatttttttggggggcggggggttgaatgaatgaactaacaaacagcttcagagtagcgtggtttagaggaaagaatagaacttttggattaaaaagccagttgggttcaaatccaagcttggtctttaacaagtgtgtggccttgggtaaatgataacttcatctaaaatccagtttattcaactgtgaaataggtttaataaaaccagccttagaaccctgagggagacaatacatgtaagaacacttgctctgtgtctgacagctagtaaatgttcaatacaaattaatctcctttctttttccttgagtacaaagaagaaaattatcaaatatagctgagataatatttcaaaactctgaattcaaaactatgaacttgttagataaggacatgtctagactcagagtggaagagaaacctggtgaattggtgggtaggagtctctatcatggaattacttccacaataattacgagggaatcggatcttgtctaggacacaggtccagatttaaaagaactcctcttcccacctcttccaatcctcgctacatccaggaacttactctgctgtgaaagtgtcacagcaacacagggaataatgactccatctcctctgaactgaagcataggtaggctaactaaaagtaattttacaaaagatgtcagtggtctggcaacggtacctcagtgacaaactattgtgattaaaggtgattttgtcaaagcataacactacctctcacaatggaagctttgtttatttcacatgggacagcaacttgctatccatttctagcagctcgcagtctatgtccaggcatacatcctatctctctacactcctaaagccccaaagaactgccatttacagaaataggtctaggatataatctgtagttaaatgcatagttgatttatcattatcttgggttatttggaattcacgttatttatattactaatcctgtccccagacctgtaagtcattgcccatcatccctctaacaaataataataacaaaaaatctccctcaacattatatttggacatcatctgtctgaaaggtaataagatacagcaactacaatgattgaaatgaagggaaaggattgttaatataatagaggtttctactgggcatgctttaaatcaatgtgcagaagcaatttgaacgacccatcctgtcatcatgtttaaaatacattgatttctctctttctttttcccccttgtggtttttatctcttaggttatttttccccttcctgtgaatttggatagcgagccaaaggaaaagaaacttcaacaagaagactggctcaaatcactctagggccagactgcaccttctataacatttctaataaatcatggggaaaaagaaatctctgccatagtggcacatttgacaaattgaaattaaattttgccaactctggagaaaccaagataacctgctttgatatttcttccctgttaatagttaatgggtaagaggggacatttgaggtttctgttttttaaagcgcctccctctgatcaagtgtgattctcaaaaccctgagtccatattcagcatggagtatgagttcaagggctaacaataaatatggatatttttgcatatagatgtatatgtatttttttcctttaattctgaaattattatctcagacagtggtaaatggaattttttgctagcagtgaattttcagtgttatcagctgtcaggttggaaaaatgtatggcagtaataaaggggggaaatatatgatccataaataaagaaaaacgggacttgtttggcatgataaagttttaatgcctctaggtagcaaagtctccaaacaaattcccttcctttaaatcttatgctcacttcagattgtgtctctcacattcctgctcccaggcctgtaaacagtgctgtggctggagagacctgcataccaaggaagaagaggtactgcatgggctgcctccaagggaggacttggcttttcttcttctgtacgggtcagggtgaagagtatgtcaagcctctagccagcgatgagccatgaaaaagtttttcacagaaacagcgtccatggagagcgcctttgtgcctgtatttctagaaatttccatatgctgctgaaaaacaatgatcaagatcatcaacatgtattgatcatgtacaacagaccatagtcaaggttgggtgcagcaatactggggtgaaggcacctgccttcagagagctcattgtcttttgggggaggaagataagacaccctatgaggctgctgaaatagcctagaatagtgtttacatgcaacacgtggatgaagattattagttgaataaatgaatataaatgtaaggttggcattaattaactgggaatggaaagggcattgaaaagttgtgttttgttttgttggggggctggaggaaaaggggttggatgtgtatcaatgcaggaaatgactcctgatcagggaggagaggaggaaatgccgcattggttccagaaagctgttcttcaacatcactttatattacatacattttgtttttaatgactggtttgccttgggtaaaaagacaatgatgagtcagcatattacaggcaaacaatcgaggccattgtgtgaaggtctttgctgtggtggaagtgtgttatctccctgaaacatccaggcgggttcctctgctgtcactgtacaatttgcatgcttcggtaatgttttatgtattacgctacttatacgctaaaatgtacatgcacgctcctgcaaatttaggtaaattatgaataaattaaatcttatctaaataaacaagtgtctttttgaaccaaaatgcaagctgtcatgaatatttaagtggacaaggatgaatcctcttcctgctgcacttcgtacagagtgcattctatactcttgattgcaggaaggaaagtgtacacagctagagaaacataatcgacttctcactagggacatgaacgttgagaaatctggcctggcagagcgatacattaaaaaataagattcattatggaaattaagttatatgggtgtctcctgaccctggtaatctctgccttttcacactatattggagatgcagagtttgagcacagagttattattttgatctttcttttagtggaaagaggcatctcatgcatatttcaactctagaacctaaggaaatccggactagttgcttgttggtttatatatgatttctgtaggaagctcatgagcataaggattggctcattgaaaatcaaagatttcaagaacattcagcgcccagggtcaagtttaaggatctcagttaatgttttcaggccacatctccttagtcttattttccattactcataggatctgagaatctgagttgaaagggcagttggggatggagttagaaaataatcaacagggaagttttataaacttcctccaaaaggccacgctttcccacctacacatattagtcccccttcatccaaggtttcacgctccgatttcagttctctcacaactgtggactgaaaatatatgtgggaaattctaggaacaaaaaattcctaagttttaaatcgcatgccattctgggtagcgtgataaaatcttgtgcagaacagctccatcctgctcagaccttgaatcatccctctgtgcaatttctccaggctgtctatgctatttgcctgtaagtcactcagtagccctctgggttttcaggttgaatttcacagtatcacagtgactgtgatcaagtaacttttattttacctaataatggctccaaagagcaagattagtgatgctggcaatttggagatgccaaaaagaagctgtaaagtgctttctataagtgaaaaagtgaaagttctcaaatgaggaaggaaaaaattatacactcaggttgctaacatctatagtaagaatgaatcttctatttgtgaaactgtcaacagcatattgttattgttctattatgtgattgttgttaatctcttactgtgcctcatttataaattaagttttatcgtaggtatgtatggataggaaagaacatagtgtatatagggtttgggactatctgtggtttcaggcatcccctgggggttgtgaaacatatcccctgcagataaaggggtctactgtcctcttgcatattctgttccttctgtctagagggccctcatcctgtttgtctggaacaactacagctttcttgcttcaagacttgggtcttctccttcatggagccttgtctgagctccctaggcagagcgaggcgtgttaacctagttggaagccccaggagggcaaggcttatgtctgcttcttctccacatatccccagcagccagcacaatgccaggcatgtagaaggcgttcaaaaataaatccctcctaaaaaaagactctcctgtggtgtctgagcttattgaataaatccctctatggcaccataagattgctgtaattcattattcgtttacaggttagtctggcccaatggatggctgtgccctcaaaggcagaggtccatcttattgatcttgtatccccaggaccaagttccataagtatttgacaaatgtttgtttattgaaagaaagttatatccattacattgcaattaattgcagcaacaaacctgagacttattagctcctgtgcaccctacagcgtcatcttcatcatagtcagtgtctaggcatccgctttcattgttgttggcagtggtcttctgaatctcaacaggccccgaaggtcttagtcatgctcacctacccaatagttggttttttcctacttaaatcctccaggaaaagacaaaggcttcatacatcgtcaaggtggaccacggggttgaaataaggaagcacaatagcagtcctagggggtaaccttgcttcccgtttttttctccagctctggatcagccctgggcaggccctgcaccaggtgaggatggggtagggtgaggagtggatgcgtgtccactgagctttgcagcagagaagaggcacggcagaggagagaagagagcgctttcagaggaggtggtgaggagggaaggggagccgctgagcctgcctgtgagtggttgctgttcggagggccagctctgtcaggagctctatctggactctgcactcaggacaacagacagagacagcacattgatatcaggtccagtctgtccctttccacatggatgcccctgctcaatcggccatgtatgaacttctaagcaatttctatgagctcattttagaatgtaactctctttgccatgaaaaaaacctcccttcatatcaagtctaaatctctcagggttctgtaatgtaaatcctcttctatctactctgttctcagtggagagggctgacacctggccccttccttctcaccataagcatatatccactgcaagaccatgaccatattggggttcatcctcttctttttcagactaagtcccccaatatccttcatccaccttcacttgggacctcatcctaggaacacagtgctcatgtgggacagatggtcttgtctttgcagagcttcagggtcagacctggcttggcctacacgtgttggtttataaaatgaaactgaagacctcattcccactgcaggtgatatggaggtgatggagcaacaattaggggctgtaatgggccagttaatgttattggtaatgaggacacatttactcacagaaagtggactgccacctgccaaatggccaatgtccctttgagccctgtcatagacagaacactgggccgaccatgagtttgactcaatatcatatcctttcagtcagactgagagctggcctctccatcggagagaatatgggtcaagttcagaaggaccaagcatcacagatttttttttttctttctgtaaatgcagggcctttacttggtgctgtgaggaacttgtgagttctgagttcatctgatccctggactccctgcctaactgaacacaatccaaagtcaaactgaggggctggctcacatttctatataacagtgtcctcgttctcacctgccctttaggacaatatcctgcattatcagagcagcaagtgatgacacagagcagctctctgggaggaagatacggtctctgagcaagacaaaaacaagaaaaaaacactaatggaaaacccactgatgcagttcaaactgtgtccccatcagtatgaaaggcaagtttgcagggctggagacaggctttgatcttgcctcgaagtcaaaggcaatctggaagatctccaagtgtaaaggtgcatgagaaatgcttccagtgagtgagatttcatgggaggttggagtgggtgagctcactcactctgccgtatatcctactggggagaaactccattcccaaagtcctgctttcaattgtgatctgcccagtctcgtcccacagagacttccagcctagtcagctatgcaatcaaaccaaagcatgcctaagcgataactggagtcccgacggctagtgagtgggaccgtcagaggtgtttgaaccagagcaactccatcctgaataggggctgggtaaaataaggctaacttatttagccttaaaataattttcccagtaagttaatcacagaatgagataggaggtcagcacaagatacaggtcatggagactttgctgataaaacagcttacagtaaaaaagctggctaaaacccaccaaaatcaagatggcaacaagaatgacctctggtcatcctcactgctacactcccacccgtgccatgacagtttacaaatgccatggcaacatcagaaagttaccctacctgggctcaaaaggggaggcatgaataatccccttgtttagcatattgtcaagaaataatcataaaaatgggcaaccagcagccctcagaactgctgtctatggagtagccattcttttgttcctttactttcttaataaacttgctttcactttatgctctggactcgccctgaattctttcttgtacgagatccaagaaccctcttttggagtctggatggggacccctttccagtaacatcttcctggtaacccaggtgggacaatagtgaggaaacccccaatccaaaggctaactttgggtaagtggtgggggtccggtaacatctttctggtgaccacagaagagacaatactgagaaaaccccgacccaaatgctaactttgggtaagtggtggggtccggtgacatctttctggtgaccacagaagggacaatactaaggaaaccccagacccaaaggctaaccttgggtaagcagtgtggtgtggtaacatctttctggcaaaccatggaagggacgatactgaggagacctccaacccaaaggaaatagactgcagcactgattggcagattttgggtaggtggtggggtacccagataaaggatgggattgggttaggggcccaacttagggcagttggagtctctcctaagacagaaaccattaaaggctcctctccataaaaggcaaggacacttgaccgaacttgagtttgaggcccaacttaggaaggttagagtccttcctaagatttagggaattagaggcctctcttggtaaagtctctctcagctaagaatgggtttggcactataggatgttaactgctattctctttggattattttacttggcactctttgctgaaggctatgggtgacagagttaagcatgtataggatcttgggacatggggagctttttcctccctaaaaaagggaaacttgagagccaacaggtctgctggaagagatccttttgctaccaacaagcagccacctgaaattgtcagtgttgttgcaatggtgggtcttactctggcctctctgagctctctgccttccccaccctgctgtgcacaatgcttttttctctttctctttttgatcttttctgttactcagggcaaccatcttggccagcgaccacaagttgaaactcctggtcagagggtggattaacgatgatggggcccaactgggggcaagtttgggccttacaagtttgatattgagtactaagcagagtgccagtgtctatgttttgtcacatgtattttgctctggaaaaatggaaaaagataactttctcttatgttgcagcttggcacccagggctatggtgcagtgagctgggtcactagggctgctcagggaaagggaacccagaagcctggcatgctggcaaaagggtaagaacttcttaccaatcagacttctgggctctctctctttgtgcaaactggttgaatgaatggtaaaaatcactgtttatctcctctgttcaaagtttttattaatgagaaaaagaattcgtgaggctaatcttaagctgcagggaatctggtatgctctgtgtgtcttttttgtactgttttgtcataaagaggggtaccttaggatagaatgagggcctaggaccccaaaaacctgctgttcaagatggcccggaaaactggtcagccatgtccttagaagcttgatcttgttaccatgtggccgtcctttctcttttcagaatggcagcctgggttcatggctcaattcccagcttagagaatgggttattcttggcttaatatctgtttgacctttaccatttgtttattctcttcccttctatgaattaccttaaattttcctttttctgagcaaagaaatgttggctgtttggcatggctaaagttggataaaaaaagatttaaaggactttttaaaagagtgctatagttaaaagtcatcttaattaaaagcagatattcaggctccaacggcctgtagttccttgggaaaaacagaggaggtaccacagaccttgtttggggggaaaaaacacacaaaaaaaacacaaaaaacctctgttttcctcatggaacctcaggaattaaaagtggatcaattcctctcaaaatctaaggttctcttctgttttgcattgtgttatctgatggttttaacttttggggatatcagaaattactttgcattatgagagagctttggtgtgtagtaactaggtaggaaacgtacttttgggaatgggctgattccctttttgggattcaggatctggtgtaaaaatgggtaccttaatttctggagatctgtattgccttccagttgtgcctgcttattaggccctagaaacttcatgctttaaagagaaacttaaaaactggcaaatgaaaaatcttacaactactggatcttcttccatctgtctgtgcatttatatgttatgtgtgtgatgtttatatatgaaagagctttaattaattcgtttaaaaataatagaagcttaaatcaaatattttaacagaaaaataaaaattatcatgccttttaggtcacatgacttcagtaatctttgggaaataaaaatcactttaaagattgttggtaaaataaagacatttggtcttctgtctggtgtcctaggctccacacctagtacataatgaaaatcccttacttaccacagttttcaccaaaagtaaaaattgctaagagttaacattgtgacacgtatttgagactactaaaaacaaaacaaaacaaaacagacaaacaaaaaaaaatttcacacgcaaggtgtataaagaaagtaaaatgcatttttggtaaaagattataagaagctgtgagaatatggatttcttacttaagtttggaggtttaaaggattgttttaagttagataagataaaactgaacagttgaacaaattgtgaaagatttgtaaaaaaattagtcttgtaaaaaaattgtgtatgtggacatattggctaaagttaagggggtattatacagtttttccataaattaaacatttgaataaaagcataatgagtttttcttagagtgaaaagaaaacctgcctataatctgctctttaacaaaattacaaagggttataaaaggtttatgaagatcttaccttatggtcaggcattacaattggatagatttatctataagcttttattaagaatagggtttaacagtaatagtataccaacggaagggtgaaatttggcttttttggtataaaaatcatacaggaagcattgtcaaaaatgaaatggtatttggctttctttgggctgtatttgtataaatatcttactggtatgtgttccaaaattatgtgtaactcctataattctgatagcacttggtgtagattatcagtaataataagaattgttacataaaatcattgtatgccacagaggtaaccacatttctttgttagtcatgtttttgactgtggctgccctaaacattttgtcatccacagacaattgttgtcttgttttaatcctcttcaaaaggtggcttataaaaaaagatggcttataatcaatataggaccttaacaggtgctcttaaatgcaagtttctgataactttggagattgtgacactagaatggaggaacaaactttcaggactcatggagagctgaaatgttcatgaacatcaagcagaataggagttaactgcatggactaaactaatagtaaactaatagaagtctgaagtaatcttttttaactttttgtttaaaacattgctaatcctttgctttgtttttcagagttaagaaaactcttctgttgagctatttacagcttgaagcaattgagtaaagtacactcctgtaaacagaatttggaacacatttgtttccctctacctgattgcttcagaatttggaagttactcgtgttcttaacttatggcaatatagttatttacataagtgtaataagaatctattttcttttgtaacaggacacaattggagaaactggttattttaccatgtctctgactgaaatggtgtgctttctttaaggaatcaaacttatagagccaataaaagccccttgggaaactggcctcataccttctctacacagtccctgtacagggttcctgacctgtggtaagtaaagaatgtcactttctgacatgtctaggagcccaggtcatcttgggacctcaacaggagagtaacttacccaactcataggtatttgagggtacaaacccaccgcagggcttggctttttaaaaagccttatctgagattacttatggaacagagtttcatcaaagccaattttaaaagcctatgtgaaataattattcttgctgcactttatacaaataatcaggccaagtaaaatcaagtaaatcagtctcaccatgatttgtctttagtgaaaatggaaaattggagagagaaaaattatgtttcaagaactatggtatacctgttattaaattccagtctcatcagttgtttgtttttttcctgcaatgtaggctgaccccgcttattcctgtaaaccaaccagtaatctcaggctgctactcagaagaaacaagaggtctgagtaatgtaaaaatctggattggatcaatattctaatcctggacatatattggaatcaactagcaactctatatcagcttggttcccaacagttgcccagttcatggaaagccttctaatttagtttacatgggataattttgcttattttgttatattgctgttggactctctgtgtaggaatgcagaataagcttactcaatgttttcttaaattgaatgcttatcactcttccagatatcaccttttgttggaactcaagagttataaatggcccttgacataccaaagctttctgactgagctcctctctaccctaaatacaagagaccttcatagtttggcaaaaatatcatcacctctattcagcatgaagaagttacagaagatggatcttcgttcctctacaacccttaggattaagagttctcttataaaagggagttgggaaatgtcagaggtgtttaaaacagagccactccatcttgaataggggctggataaaataaggctaagacctgtggggctgcattcccagtaagtgaaggcattcttaatcacagagtgagataggaggtcgacacaagaggcaggtcataaagaccttgttgataaaacagtttgtgttaaagaagccagccaaaacccactcaaaccaagatgtcgatgagagtgacctctggtcgtcctcactgctacactcccaccagtgccatgacagtttacgaatgccacggcaatgtcaggaagttaccctatacagtctcagaaggggaggcatgaataatccaccccttgtttagcacatcatcaagaaataaccataaaaatgggcaaccagcagcccttggggctgctctacctgtggaatagccattcttttatttctttactttcttagtaaacttgctttcactttactctatggacttgccctgaattctttcttatgtgagatccaagaaccctctctggattgaggcccctttccagtaacaggaccacacagtttgggaaaggaatggggtcccgatggccacctgctcaggtagaggctttctatttctcctgtccctgctgaccggaaatcagctgcagaaggagaaaggcttgggcaacgcagagatgtctagtcacagacatttgactaaagggcggtggggagaacgggcacttgatggtcatgatggggcactacagagaagggaaagagacagaaggtggagacggtgtgaaatgggcagcacccaggagtcacaggtgcggcttttccaatggatgcacctgttgaggatggaggtgcctggacgcacgttcaccatggcacaggcagcagtgaggtccatccattttcaggagactgacagaataccagcagcctgtctcagaactttacttaataaatcaaagctgacaactcccaaaatggtatgaaaacgctttttagtgtccatgaccggcatacattgtattcatttcactttctgaaataagagttgaaccataatcacaaacaatccattcttgtcaggtatcaacagtacatctttctttagccaccaaagcgggggtccctgtaatctggcactgcctgggcctggggtgaaggagtcagagtgaaacagcaaacatcgcggagacaacagctcccatctgcagagcactttggaatttccaaagatatttcacccacatgatctcttttgagcaccatgaccaccctatcagatggattttattaacttcccttttcacaagggcaaatgcaggtggagagggcatagctgacactctatgcacaccacagttgttgtggtgggcagccctgtgtagtgggagaggcttgccctcagacacctgccctcccagtgcttgcgagtgagctgctgggtgggctccctttgttggcagctctaggccttgagttggggtagaggcaaagctaacccagacctgtcctccaggcctgtcctcataggttctcccaactcctcctctatccaaactgctgcctcttttttaacactttgcttcagggtagggttccctgtgccttccacagggatcatgagctaatcataaaaaccactaagggtcaaggggcaagagtgagtggcagccatctttgctgccaacagaggaagactttaccaggaacttcaaaaggcagcgttccagccactgcttatccccaaaataaaaggaaggactcaactggttgaaatgtcagacttgggagcctcatctatgaggggcctcagctgtgcaggggacctgaggataatagattaggatcctggagtactctgcctgggagaaaccttcaactggttcactaggagatcccatatccacagccaggccaaagcagcaatcagaacaaaagactaacagttaccggacaggcccaagtcacacatacactgcaaaataaaccttaactccaatcaagtaagaggcagagcagcactagctgttgaaagttcagccaattaatatggtcagcccacctgggtctcactaggcactctctgaaggtgatagggccttgaactgtccctggtggggttgggtaggaaaagaattctgtataaagaaggctttgatctcagatcattctgccaatgtccaattacacttaggacccgactgccattgtgtgaatgtgtattgtgctttaaggtgacatagtgaatgaaagagccatattttggtagagtgtgtgggtcacttcacttagatgatgtgctggtggttcactggaaaatgtctgagaccagaggtcagagcatcacttgtacactactggtcctgaaaagcctattcagacatttggggtgcatatgtgactgagtccatgcagggaaggtacctctcttgattgctgctttctcagcgatatcaccttggtgctatatgtgcaaatatttacatgtaaatgaaaggatgtgatttattgttgaaattcctaaggggaatgccatgggaggcactctggagcaattatctactccccgactcttacgccacacagcgtgtttcagacagagagaacatctcgaatgtcctctctgcccggccctgggaaccacatcctgaacccccaccaagaccaaggtgtctttattcaggccaccttctctatcttccagtgtggttttctgtctttcctaaactgcaggatgcaaattgtggactcaggcttccagtgaaagcgattaagacatcctggcagggaggcaagctctttatttgcccttttttgatgggacagcataaagctggatcatttctctgagctccctggaggccatcaaagtctacatgggcagatggagcatataaacaagccgggcaactcactagctgctgtaaagcagaccgtggctcctctacctcgaggagagtagggcgggtggaagtcaggcacagaggcctttgcacctgcagcctccttgcctgaccctactggctttccatttgccactcttccatgagcacatgaattcagaaggttggggctataaccttttttttttttttttttttttgagacagagtctagcactgtctcccaggccggagtgcagtggtgcgatctcggctcactgcaacctctgcctcccgggttcaagcgattctcctgcctcagcctcccaagtagctgggaccacaggtgcgtgccaccacgcccagctaatgtttgtatttttagtagagatggggtttcacaatgttggccaggatggtctcgatctttcgacctcatgatccacccacctcagcctcccaaagcactgggattacaggcgtgagccaccagcgcccggccgatcatggctataatcttagctctactatttattacttatctagcctaggaccaatcatctaatctctcttaagcccatttgcataacaaaatgttattcataccagtttgcatggtaggaaaggaggaaactgactacttctgagtaccaactatgtgccatatatatagtatctggagaccgtaagtcctctgggaaggtcaaccagcattgtgactccaaagcttgagctatctctactttaatatgatgagagctgggagcatcatgatgaggtgagcaaagaaagctcttgagaagctccaaatccatatacaaatttaagacattacgtctgagctgaaaacatgtgttgtgcttttatcacagtaattttcaaaggagaaactgaggcatggggtcaaggcactgtactaaaggtcccccggcaaggcaatggcaggctcttaaccctgggatctttgctcttggcttcttgtccagctctggaaggcaggtggactccctgagcagaggctgcaccatcctcagctggatgggaaccaagacgccctcagggaatgtccagggagcagaagctctttctgtgtcatttgccgagttccttgggatgttatttctccggggaaacctgttattccttcctagagtcactaaaagctcacagcaggaacttcatgtaacttaagttttttgtgtcgtgcaagtttttttgtgttgttgctttttttttaaaatgggaaaaatacttcctttttccaaatgctatcaatttcaatcaaactgtgtatactgctgaaccaaaaaggctgtttaaatcgctgtgtgtgttttttcccttcagtgtctctcaatccttctactagcttctcgaagaattaagatttgatcttttcaaatgtaaattaagcaatttacaaaatatgtattttggcatataggaaacttggctttccaaacaaactggaattttatcgattctatgaactgccatggagttatcttgtggccataatttgaatctctaatatgagactgttttcatttataacaagaagtacattctgcttttatctaacttcaatctccatttctgcatttttaaatgggtaaaagaagtgatgtcagttttaatatgcttttcatgagtttagtttctcaaatgttatttttatcattttgtcaattttacttattactgaaacaatatttgatgccacaaaagaaattgaaataggaaaaacatccacccacagcttccccagcctaagacagctcttcatattcacccatgctctctccaagtttttgacaccctgcatatgcttttatggagttataacaattctgaaaaagtaattctcaaaataagtttcacataaacttaaaaaaaaaacaaaacaaaacttccttgacctcctttcaaggtctccggctcagttttgcataaaacttttctgcatgtttcattctaagtatatgacagggactttacatttcagagattaagaatacagttctcagtgtctagttaatgatattaatagtggggcagaacgtattaataaatacatggtgactgatcttcaaggttaattattcaaccctttgcatcaacaagtagtgcacatgaatcatctcatgggagtctcctcttacagcattcagggaaaagggttctccagtcttgattgtggatcttttttttttctttttagtaaaaacaaagctcctgttaacatatggcctaaactcttccagtaataagtttcttgtgtgtgtgtgtgtgtgtgtgtgtgtgtgtgtatgtggtgtgtggttttttgtttttctatttttctcttaatagttgatacttctttttaaaaattgtgttaaaatgcactaaaataaaatttatgatttaaactattttaatggtagagttcagtggcattaagtacattgtacattcatattattatgcagtatgaatatgccactaccacccatctccagaaagtctgtacccattaaatcctaactcctcatccccattacctccagcccctgacaaccaccttctactttgtctctatgaatttaactactccacggacatcatataagtagaaccatacaacatttgttcttctttgtctggcttatttaacttagcatgtattccaggttcatccatgttgtagcatgggccagaatttccttcctttttaaagctgaattatattctattgtaaatatagaccacattttgtttatccatttgtccattgatagatgatccggttgcttccaccattgactattgtgaataatgttgccatgaacacggatgtacgaacatctgtttcaatctctgttttcaattcctttgggtatatacctggaagtcgaatttctggttcatatggtaattctatgtttaattttttgaggaacctccatattgttttcaacagtggcagcaccattttcacattcttaccaacagtgcacaaagggtccaattcatcctctgcagtcatttcaatctctttctctctacttggaataactagccacagccctcgttatagtccttcacagatatagattcacccttgtctctaagtcgtggctgtggtacagatgtggagtccgaggcacagagctgttcagccccagcccgaaggcccagggcagggcagaggcaggagtcatcccagcggcagtctggctcaggagcctggaaacttcatcatcatcacggtgttagattggctgtcagagaaactgctcttagcccctcctgcaaccttattgatatggtttggatttgcatccccacccaaatctcacatcaaattgtaatcccctatgttgaaggagggccctagtgggaggtgattggatcatgtgggcagattcgcccttgcgttcttgcgatagtaagtgagttctcaggagatctggttgtttaaaagtggggaatgccggctcctgcgccttctctctcttcctccttctccagccatctaagacgtgcctactttccctttgccttctaccatgattttaactttcctgaggcctccccagccatgcttcctggacagcctgcagaattgtgagtcaacaaaacctcttttctttcataaattacccagtctcaggtggttctttatagcaatgtgagaatgaactaatacacttatttttcaaatttgctgttcttccactcagaactgcttcatgaaaagtagcattatcatatgtgtgagacattatcatgtgtgagactcagtgagaggtgaggctctggcagccagatggggcaggcttgcccatcagctccatcaccagcctttccagtcctgagagcttatcctcctttgcttccctggctgtgagtttgggtgaggtctaatgccagacttgacatgaccaacctatgactctaggagatggtctgtgcccttttccctcccaccaccatctctatgccctctgggctccttcatcagggtttctctggacctggtctaggctgtgggcaggcaggaggggacagggcctatggacccagcaggggctacatagggagatttggaggcaccaaaaggtgttcttgcccttgaatttcttgaaaaggacactggagagccccatcttccctctgcctgcagcctagtatttcccaaagttggttcctgggatgaaagtccctaaaatgcacctttcaaaaagggttccaatgctaagtaagtttggggaacactttgtggggtatgtgtctctgcagagccatatgcactttgatatggtaaaggctctggaaaattccacagtaatgaaacctgtggaattaagccacagtatccaccaagatcttcattaaaatacaaacacataaccaggatgggaactaatcaaagataacaatctgtctacctctcagctttgcttctgcattgaaatgttggaacggggaacaagtgaagacaagatggcctttaaattttttttctcacattatttaattaaactacttgatctttctaagtcttcatgttttaaagtatgatttaacgtaaatgtaacacttgctcatgatagaataatcagacaagtataaaattaaaatgaaaaataactcataatctcaacagccagaaataatcactattagcatattgagtattttctgataacatttttctaagtatatatatatatatatatatatatatatatatatatatatgtatatatacacacagacatatattttttttttctttgagaccgagtctcgctctgtcgcccagactggagtgcagtggcgccatctcggctcactgcaagctctgcctcctgggttcaggccattctcctgcctcagcctcctgagtagctgggactacaggcgcccgccaccatgcgcggctaattttttgtatttttagtagccaggatggtctcgatctcctgacctcatgatccactcacctcggcctcccaaagtgctgggattacaggagtgagccactgcgctgggcccatattttgtatttttatgaaatggtgagcatgccagggataacattttatattttgatttttttcttacctaacattatagcatgagcatccagtttaactgagtggaactgtctcctgaaggtttatgagaaagaaggcactcacatttacgtgcacctatgaggtgagagagcatctgcatttgaggccacattttattctcacatcaactttatggtagacatattgcctcctccatacactgaaggacatgaagcccagtggggtgagagggtggagagcacacgatcgatgctcctcccaaccctccaacatctcttctagagtcctgggtgcccagcccacccacctgtgtgccttgctccaatggaccccacctgtgactgtgtgctgtctgctgcccttgggccagcccaggtgcttcaccctcctgcctgccccaacttgcagagaacaggaattgcttggcagtttatttagccaatgattgctgtgggaggatgagtatttgcttagaaagtccaatacactctaagctatatgttacatcctagagcttcccagcaggatcaagctgagactgggactttacttaaaatcacacttctgtttggcatcatccctgtctctattctgcttccctttcttcttcctgtttctcttgggagcatctgcctaggaatccttgctcagggtctgcctctggggattgatctgagactggtatttccttcatggtcatatgtcttaaagcagaagcagcatttccaggacttgaacttaggtcttccagacctcagagtcaaccgtttttctatcacagacccttccttgcctgattccaaaggaatcagccaatgcgtgtgggagaaaagtcttcaggctgtgggggtggggtgggtgaggctgggccctctagctgcctgggatgtgaatggaaggaggactgcaggtggctgtgtgcagtgggaagctcatgaaggatgagaaacctaccgctatcctctgtatacacacaccttggggaaattcactgtgtcgtgcctcagccttgccccagacagccacagggctcagggcacaagctgcagatgaaagaagtaatgggcttaccactttaacatgctggcacccagccaggtccccacttaccgtgtgaactgcctcgccaaatgtgccaggagcctcctgtacgaaggccagagaaatgtgactgtgggctcatgctgggaagcaatttggtccatttcaaccatcatgtcatggcagcagaatacacaaatatagactagacttgtccaggggagcttttctctcattaaccttgaaggatgacgcacatcccgttgacggctgctctggagcctgtgactatgagaggccaggtttgatgaagcaataggacttaaacagcagacattagtgctgccaaatgcatttttcttcttaatacactaaagatccatcataaatactgagaagggtgtgtgtgggagggacagaaaggctgggatgatgtggcagggtgcatatgcttgccattgggtgctgtctgtcgtcagcaaaagagaataatctctcagttctcacctcctaagaagttagcaatctctctgtctctgtctctttttctcctctctctctctctctccacatgcacacacctccagtgtgagttctcctctgccattcacaaggcagactcatattttggctttgatctcataagaggtcagtagcagtgtctgtgatgtgtgtgtgtgtgtggttttctgtatgggttctgtgatcagaagaggggcagaaatgcttgtgatgaaagatgtgtaaacagttctgtgcagagacagctgataggcagtgtcttctgcaaatgatgctaagggaaagactgtcctcaaagccatctcagtcatagtgctatttatggctggagtggcagaacactcttcacctggatgtcaggttgctagaagggacagtggattttcctaggaaaaagattatttcaggaaagaagcatggtttaaacaaggctgaggttctgctcctggctgtggcatttaggagagaagtggcagccgctgagggatgaggactccagctatgtacagggttcctggtttcccacaaattgacttcatgtgctgctgaggcacaaacactctcttaaagaagttctgcaaagataactgttgacctttgctgagctaccttgcaggtagagccttataaaggagactttataatataccaaagagaaagaagccctgtccttggttccaaggatgggaagaggagaggaacacaggctatctgggggtgaaaagtggtaatgataatgaaagcaaatatggaatatattagcttctttaattctcacgatgggcccaagagggagcttctatcattattcccatttttactgaggaggaaactgacacatggcaacttattcaaggtcactgagcaacatttagcagagcttggattggaccaaggcaatctggttccaggggccacattttgaatcatggtgctatacaagccattttataaacaaagagcaactgaactggacaatggatagcagcctcaaaggacaggaggaagccaggccaataggaggaggaggaggggacccccaaactatatctgagctgcaaaagcttgttcataatctaatgagagaagccacacacataaacactcatggaaaaggcttataactctgacaaaaacatacataaattgaattgacattaaaggtaaaactacacctcaactggggaaggaacataggtgtggaaataagtttctccccaaggtttcttcctcttcttcttggaagagaaagtgacctccaaatgaaccaggtttgaggagaggaaggaggatgaaccgagagtccatgaggcagctagggttgcttgttatagcaccaaccttaacctgagtcttgctatttctgtttttggccatggcaacatatcactccttcctacctcaccctcctttctatctctacatatctcagttgaaaaccaatcttttcttttttggaattgtcttcatcatttacttcttttctgctctgatttacctttagagctgtattaactctgacgttctactattgtctgagaagcgtaatctgaaaggggacagacatttttgaccaatagattaagtagcaggaattcaggaagggagtaaggaggataaggagagaaagagggaggatgatattggaattaatttcaatacaacaaacaggtaacgagcatttgtgatgtgcccgttgctggtacttggtgctgggaatataaaagataagttctccaacaccacactgtgagctcccagagggtaggaactgacacttaaatgtgtaatgacatgacaatctgattaaatttaataaaggcgtgggcaatgggtctgggagcacagagaaggttgcctttatttatgtttcaggcagaaaagctgggaaagttatagaagtgatatttaagagcctcaggtgttgggaaggaatttgctgaatgaagaagggaggaagagcattccaggcagaaggaagagtttgagcaaaggaggagaagtgcatgaccttctcaagacgtagtgattgctctgggtgtggccaggcagcaggcggcgtggaggcagaggggccaggcagccaaaggccttggattagggctgaagagttgggacctaccctataaacaacgtatagttgttgaaggtttctagacagaagaatggcttggggggctgtgtgtttgagagacttcttcccaaccacagggtggagaatgggtggcaggccagtgaggaggctcctgccctggtccaaaggagagaggctgagactcttagaatgtccaaggagagggcagaggtacaaatgcaagatggcacccgtggacacattgaaagtttagtgatcctacacttgattcttctcgcagtttcagaaatactacctcctttgtaccactcttggtacgtgccacctcctatacaaagcctctcctggtgctaccagaggcaaacaaattctccctcctttgtgccctcctgctttatgtgtgtagcctttctctctgggttctctagatttattttaatttgtgtactcgttttgtttgttctcacatgggtagggaaaagggcaaagctctggatgtttgaaaacttgttttgtactaaggatattgttcttgattgctgcattgccctgggaaaattaatttacctctttgaaggcttggtgtcatcatttctgggaatgtaacatttaggctgcaggcaggaaaacagcacccatgcaggtgtctgcaagggagagtgaggcagcccagaggttagtaacagtaggcagccaatcccaggctagaggtacaaaggaaggaggtagtatttcctgaactcaggaatcaagaccacccagtgggaactgggaccacccagaagactcagctactctcttagaagtgatacggggcagagaaagagagatgcagtaccctacttctcccatcctctaccctctaaccccttgacagtgccttccgttggctgaacctacacggtagccagttggccaggaggtttgggaggtggagttcacagggaatagtggggaatggatctgagtgtgccaactggcaaatgaccaatataaaaaattcacaaaaagtctctggccctacttatttcacaggatatcagttagaatcaaatgaaatgatacatgtaaaagccctttgtaaattacagagagctatgcaaatgtacgctggtatattcacgttttatctggcagtcaaaaaaatctgcatttagctgttatgaattctctgctgacctggatctgaagtggagtgtggactgactgcttctcgagggatagtccttgaggtgtggacgtccaaaaggctgccagggatgtctgggggcacatggactgtaccgtgtgatacaaaaccttcctgcagaagataagcttctgggcacctgtctctaaacctttcccatcagaccagttgagtgcacatgagcatggctcgtaggcacctgggcatggaaaaggacctctccagctctgcccttcttggcagtgagcagttagcggccctgaggaatgaagccacagccgagtgaaggcgttccatgctgtccaggtgatggagggaggaaattgaaaagacattcaagagtttcctgagctgagctcttcccctagcatcatgctgttcatactacacatgttgttttgctcctgatgataaaggagatgctagggtaatagggctgacgcagttgaaccctgtagtctcttcagccccattaacccacatccacccaaatggattctcagccagtcccattaagacatcctgtcagaaccttcccacgtcatttgcagagtgaagtgaatatcaataaaattgtaacgagtaattatcccagcttcactgactcttactggaaatgaagccagccctctgctgtgggtattgacaaaaactccattcctcctgggagctgcttttcttccgctgggtaaatctgatccatctcagcagataccaggtgtgctagtttaacattcatgggcacatgggcagcaggtttggaaaggggactctagcccctgtcccttctgggcagtgagaagccctgatgaatgaagaggttcactgctctccacgctgcgtcaacagagcgagtgttgcaccaggaggcagggcacctggcttccccagtcactatcgactactcccaccgtccaccctaactccatcaggcctcattattccatctataccacaataggtcctttccagttctggcattctatgagctgagagacagaacagccacagagaaatcaatctgccagagagtgatgcatttgacagtgtagacactcgaggcccggtctacattgccaggcatttgagaagcagacagaatgggagctttgctggcagtttctcaccgtggctttctgaccacagagagcccaagcatcacacctgctctgtggtcatgacagccagcactgggataccagagctgtgagtgacaaggtgttaattcaaggcttagggagtgtgatggttagggactggcccaccctttcctgttctctgcctgctgtctgaaaggctgtcagcacctcctgctgatggctggctgctggtgacttgctgcctgcttcccccacatgaaagtgtggaacacagcacgaaggtgtttctgcagcacctgggctgctggcttggaacgtgctacctgtgggggaagactggaggactgctcagttgctgttctgtgctgggattccagcctcctcttcctggctgctcaggaaaagacagcacaggccaagctggggttccagaagtatgaatatgtggggaggtgggcatgggtgcatgtgagtgtgtgtttgagtgcgtgtgtgtgtttgagtgcgtgtgtgagtgcgtgagtgcgtgtgtgagcgcatgtgtgtgagtgcgtgtgtgagtgtgtgtgtttgagtgcgtgtgtgtgtgagtgcgtgtgtgagtgcgtgtgtgagtgtgagtgcgtgtgtgtttgagtgcgtgtgtgagtgcgtgtgagtgtgtgagtgcatgtgtgagtgtgtttgactgcgtgtgagtgtgtgtttgagtgcgtgtgtgtttgcgtgcgtgtgtgtgtgtttgagtgcgtgtgtgtgtgtttgagtgcgtgtgtgagtgtatgtgtgagtgagtgtgcgcctgtgtgtagcagtgtagtagcggaggaacaaagaggtacaaagaggaatggaatcagtgaagctcagatccttaaagtcactttaagttgggttttcaggggggattttacaggcttctggggaaccccaagtaggtggtattcctctgccctgcctccctcccgtgccaaagctcacacaacaaaggtaggctgcaggtcttgcctggctgccaaagctttcctagagccagggggccaggaacaagttctgtggggacccctgttacctggctacaccatgtgttaacccagtgctggccaggttggttcagatgacacaggtggtgaagtgggtactagtttcctccgctcctccccaaccgggcatcctccttaaagctgaacacttggctgaagagagggtctgaccagacaatttatattacaaagtatagagcaggatgcaacttataaaagcccttccttatctatttttcatgtgaagtggagaaggtggagttattattctcattttagggataaggaaactgaacccagcaatgaacttggagtgccaaagttcaaacccagtacctcactccatcccaggatctctgtctcttacatgaggggacagtggcttccaaaataattccaagggtgctgataaaggagcatctccgctcctttttcctccatgaaacttggagaaaggcaggtgtgggaccaggagggctgcacagcttgcagtatgcctgcctggccatggtgacatgtgacagccacatggtagaggtgagggtggcacagttctggaattcttattccctgggaaggtgcattgccccactcctgttagcagcaaatataagacttgggctatgtgtctgaactggtcttgggtagtctccatttcacagactccagtctgaattaagcatcaacctgcttgatctttttccataagaagtagtaaccaacattgaattgcactatgtgcttcacatgtattcatctctcactgtaaacccacacatttggtatagaattatccttgtttacagacgagaaaacaggaatagagggaaaataaattgccttgagtgcatgcctctaaagctgatggagctaggattcaaatccaggccacaagggctactttggatcctccctctccatcatgcatataccacaccatccttcccatgcagctcatccaccatcatctgctcacctgcctgttttcctactggccttaggtgtgaacagagtacatgtcctgttcatgattccatggccggatcaaagagctcctcctcactcctccctgcaagcacctgtgcatgaacccacccatacctggggcacttgttataaggctcagggaattatgtgacttgcctccaggaatcaaggcgcctccagcttggaccagtttcctggatcccaaggcctctttctcttctgcccctgggccacattgctaaatatatccctgtatgaacccatttaccatctgtagctaaaatgcctcttgactgttctgagccaagattagaagtctgtctaaacgtcaatgattatttcatcggctaaaagcaaattgaccaagctcaccctccctgcagactaagaaggctctcagtctatttgtagctcagtctgatgtgcaagaggcggctgctctgagttgaggctgcctgctgctttctgtaccaatagggtttgctgagcgggtcattgatgtgtttagtctgggattagtagatactttggtataagtcagcagactcgggttatcgaagcaacaatgccccggtgcttgcacaccctgcagggccaccacagcagaatcccatgggggtggggagctcaggtgggcaagtccctcatggaggtctgcacaccttgttcagcagtggacatcctgatgctcacaaggaagagtttgaactgaacatggtctttgagaaacgtgcagagatgtgaccaattgtacaggaccctgagggatcgacgaagtctctgtttctgtctattttgaatttaaggaatgagagcagggacttgggtggaagaaaaatgcacaaagaagtacagaagttttcctttccaaaaaacttcagcagaatttttttttaaaagtgagagctagagaaaaatacttatatatgtttcagaacatgttttttctttctttttttttaattttaactttgtttttccttgtgatcccaagcttctcacctccaccgagtttccggctgcctcctctgcgctgaataatacagtagccagcccagtagacacagcccattgctgggcaggaggctcccaatacacagggaagggattgttcatttcatacatcatttaaagcctgctgcagtgatttaccggtgtcagcctgtctttggagcacagaaggagaagaaagagaaatatgtatgcttccattgtgtatctggacctggatcttagagagtgatgggggagggaggccgactgggttttcttccttatctaaacactgcggagaagccaaagattaccccacagttaggaagaaagaggataggaaagtggttgatgtcttgcagggagatgctgcttccctttccacctggcctggccaggcagggagggctgccttcctacagcctgtgtatagtctcctcattcccaggtcctctcacttagatccatcctgcacccctgtaagaattatcttctcaaaaccatgctgataccatgctactaaggacgtaacaccttttccccaggcaaatggaatcgctccttgccagtgacagtgaaataggaggggggccgggaagtgcaggaagaaggatggggtccctggggggggctccaccctctggcctgtgcccacgggcctaagtgaggacaagccactcctgttttcacgcccaaaggttgcattttccgagaccactctggcctgccaccctcctcactgcccccccacacacactgaccagcctataaaaaccccgagaccctagcagggaggaatacaccagcagaaggacacagtggcagacgctggcaggccatcaacggcaggacgagaatgacgcagacgcgaggagaatttatttggtcagaggagagtctgaccactgcgtggcctgactccagggaagaccaccttcccattccattccccttgtggcctccgcatccaccttgccgagaactacctccactcaataaaaccttgcactcatcctccaagcccacatgggatctgatttttccagtacactaaggcaagaacccaggatacagaaagccctctgtccttgcgataaggcagagggtctaattgagctggttaacacaagctgccaacggacagctaaactgaaagagcacactgtaacacacgcccactggggcttcaggagctgtaaacactcaaccctacatgctgccttggggttggagcccaaaaaacgttccccacaatctgcctgtctgcctgctccccccaggggtttgagcagcggggcatctatgcagcgagccacactcctatcacacagcctgccatggggataaaggaaattctcccgtttcaatagcaggtcttcaggacctgtgctgggactctcctctcattacctgcactccaatgggtccaggtgcctcgaggttctacacacggcctgccttagccatcaggcttcccattcggctgttctccagcttggaatgctgtttctcctctctcccacttccaaaactctttcaaggaccaacctaacacccactccatctgttactctttctgtaactcagccagccctttctgataagtcacttccccaaacttccatagcacttcaagtcagcaatgactgggattagataacagataatactagtattagttaataacattaatacatttcaccgaatgattaccgagtgccatgccccatcaggatgtgctggtaatatttccaggtgaaagaaatgaaggcacagcctctcttggatacttatttaaagctacattcagctaggatgtaagttggccagaatctgaacccagactttctgccttttttatgagcctttaaccacaatttttactgccgctcagtccagtatgacttctaaggtaattgatttttaggtttgagtttagttctgcaataaaactgtggactccccacggatgccatgcatgtcttatatatctgtatcccctacagcacctaacctcagagctagacatgcaataggcattcaatataaacttgatcattcattgattggccagacagctccctgacttgagcacttctctctcttcccattatggaaatgtctgagtaatacagctctcaaggaagactgggggtggggggtgggtgtgaagcgggggtgggagagcatagccagtttgtctttaggagagtctcgtattggactacttcaaaattaaccagtcagatgtctattaagcatgtgctatggcataccacacacatggaggatgagagagaaggaaaaacattcctgttacgaaggtggcaatgctcagattggaagaagctgcaccagtgcggtccagcagggcagcccttgactgagggcttggctgtgtggggcagagtgtggataagggcgttagaggaccccgtagatcgatgtgggtcgtcagcaaggctggagagggctcaggagaaagtgtggctggtggggctttgagggagggccacgtcgccctaggtggagagcaaaggagggctgggagaaggaaattgcccctgattcacagccttccctctttggtgactgtaatggtggggctgggattcatttagccttttctcccactcctgatgactactaagctctgatgcttgctcagtctttcttacaggttggttaggagggtaaagtgtaggagtgtcatatactataagcccggattctatccacatgtaggggccgatcattatttgttattgtctctgatgctgttagtgccctttcttatcctctcagcagcattcaactctactggcagtctgcttggggctgctataaccgaataccatacactgagtggctgacaaacaacagagatttacttctcacacttctggaggctgggaagtccaagaccaaggcactggcagattaggtgtctggggagggcctggtttcctgcttcatagacagctgccttctggctgtatcctcacttgctggaggggcaagagagctccctgaggtttcttttataaaagcactaatcccattcataaagcctccacccttgtgacctaatcatttcccaaagccccaagtcctaatactcctaatctcatcaccttggagactaggtttcaacatatgaattttgaggggacataaacattcagtccattgtatctacatagaaaaagctgtttgtggtgaacatgggtgaccctctgcctgagggctttttttttttttttttttctcctagcaggacatggcagaatccctgggtagttaatgcctcaaatgcagccctcagccaatgacagagggaggtgggggaatgaacacccggcttccttgccccttggtggggatgatgctgagggctattctgtacaggatgagacctggctgccatactcatgacttgctggataaggaaccgttgctgcctaccttcactccctgtcttcctgcccactctcctgcagtgtctccagggatcacctctgacatgagttactggcactggaattgcagggtctatttctgggcgactgaaagtaggacatggtagtctttaataattgaagagatatgcatatttggtgaatagataaattcctctaattgtacaaatgggttcagctcaagtctagtaaaccaggtggacccatttccagtgtctagacccagccctgtcatgttgtccatgttcacagggagctggctgcatccgcctcagggtgctctcatcatagtgttcaacttacacacccctgacctcaccccactcccaactaggattgtaaagtcctggaaaacaggggccttgccacactgagtctttactgtaagaccctcgcacagaataagtgttcgctgaatcactttctaattggatccagttaagcagaagaaaactcccctctgtgcaaaggcaaagctatttccagtgcctttctctggcttccaaagtgatgaaattcagttcccaaggccacagtggttcactagaaccttgtaatgggttcattatttatcctgttgtaccacccctgagtgacctttcaaatggtctcacaaatgtcctttccacaattcatttcaaatgcccctaaacagtcctctaatcttgagtaaagttcattgggcccatgtacagctggcacttcctttgaatcaggggcccatgagcactgtgattaatgaccaggagtgagtgtgggcgagtgtggggcacagggtcgtatgtcctggggcagggctccctgttcacggtctaaagccacatcctgtctgccccaggctcatattctgccagggaccacactgaacaccctcctcaagatgccagggctgcctgtgccatgtactgcaagacagctgggattgtcatggacatcaatatgaaaggcagtgcaggagccaggctggattccaatgctgtggctggctggaggtcccatccagtcaagtggctcgccacttaggtctgaaccaaagagctaaacaggagctggagagctctccctgaagcttccatccctggcctttagagaccgaagtctcctgaaaggcaggtccttgcaagaggtaaaaggctcagtagaatgcagcttcctggcccggctcccatagtggcccctcctggctccaccataccctcaccatgccaggcttggcaggccccaaactggacagacagaagctccctccaacctcgtttccaattccactcatggccgccatctatttgcacagctcatctgggaaggcagcagtgataatgtgagcaggagtccaagaggtcacgaggcatacccagctcctgccattacagaggaggacagctacccagagcacactgcccctccccacttccagtgtagttcctgcactgcccctccccacttccagtgtagatctgggcccctgtacatgtggcaagacctggaagtgggttccctgcacagaaattttctgcctaccttacagaaagactggaccaaaactgttctacatggccacaacaggcttggatctcattgctccagagaagcaggtctgcccatgccctggaagctggctcagtttgggctctggagccaggagcagacatcaagagcatccacggagcctcttttgatgaaaggagcagatgatgcgaaatacagtccaaatggactcttcggaatcagttcatccctcaaacagcggtgtactgccactcaaagcatgccgaggacactgccgtctgctctgacacctgagtttgagttgtgtgtcctttggaaggaagaataagcaaaaataagtgactccccctcaccgctcataaagaacttctaagtctgagtggggagggacatgcaggaccacctttgagagaaaatcaagaaggaggccctcagcacaaatggcaggcatgctgggttgtttaggtcctgtttcatgctacattatgctgtgtgactttgggtaagtcacttaccctctctgaatcttcaaaggcttcatatttgcacaaaactcttccacacttcacagagtttgaaaaaccacaagaaagaaaggaagaaaaacttttatccaagagcaggtatgaggcttctgaataaagctgaaagtagtcattctcctggactctttcaggagagctgagttaccttgtagatctactatgagaaaacctggattattgaggggcaaaggggctttttggtcatttgcagtagcctctcccttgaagaagcaggaatcacccttgtggcatttgtttgagcatcttcatgataatgggcagaaaggagcttgtctttcttgggtcaggagcagggaggtgaggagtgatcagaggagacctgagtctggcactgaaaccagctatactttcatccaacacatttcatcaggtcctgaacactgaagacaccagtgaacaaagaaacccccagtgcctgtcttcatggggcttacatctgtaggacaccctgccatcagagagtggaagaggaggtgtgactggagtgactcaggatatcctcctgtttcaccacagttccctggactttgtacttaatgcagacagtggctatgaggtaggaaatcagcagagcttgttttcccagcagtggtcacaacctgggttgtcaccttgctgattggagcaggatctggtagaaacaaggtgcagtgaacaagctggccaaaaccagcagacagtgatgaaagtgacctctagttgtccttactgctcattaacataaaaagatacttctagtagtgtcatgacactttacaaatgccacatcaatatgccatggcaatgacctgaaaattaccttgtatggttccagaaactccctgccccttttctagaaagatctaagtaaccacctcttaatttgcatgtaaataaagggggtataaacacagttgtcagcagcccatatgctgctattctgggcatgggcacggggcttatggggtagccctgctcagcaaggagcggctcccctgctgctgctgtatgctgccacttcaataaagttgcaaactgatttctttcaccatcatctccccattggattatttcctgggtgaagccaagaaccctcccggactaagccccaatttgggggctcacttcacctgcatcatttacatcaaacagcccctctaagggaccttaggccttgttatctttgaaaaaatgctccagagtgtctatcttttctttctctgtctccctcctatcccaccccatcctgggcttgttttcatctttgtcagtgtgggtactttcctgctctgtgctgccagaatggtgctgaatatgaatgagaaagtaaattagatactgatcagctctccatttccatagtgtgttgaataataccccatgacaactggggtttgaaaggtagcccagctctgggagcaggcctcctgggcatctaagtgacggccactgttcaccagctgtgccgagttactacacagcctggaggtcaagtccttctcccataatcacttggatggaaaattaaagcagcctgctccctcaatggttatacattctggcacagaaattaacaaattcccccagaatccataacagatacatctttgttcagccaaagaactttgatataaattgtagctttttaggacggctctgtcaaaagtgtaatatatcatggaatagtgaatacaagttcaaaagtacatataataatataattaagatagcttgacaagaatgtattttaaaagtataaaatacctgcaggtataatagcttcataaagtctgtcagatttacttctgctgtgaagaaatttaaaatgttttactttaatgtgatgcaaatgaaggctgaggtatgcatataacacagtccttaaaaaataggtagagggaaaagaataaaagtcagattcaggccaaacaagacattcaactttgcgggtgactggataatagatcaagcaaacagattggggagcgatgccgggctgtttgtagaaaacaccaatttcacatttccctcctttgctggctgcaggaaagtatgtgtttttattcaaaattaatgattccctttgtgcatttttctttttgctcacaagagtcaagcataattcttgtttaaagcaaaagcaatttttatataattactagctcatgaaaaattatttttcaatgtattaaaagctgaggagaagagtgggcgagtcataccctgcacacacatgtccggaacacctcaggtccacaaagaagagctgcctccaggtgaacaggagtccaggcatctgtccagcctcatccatacactgagcaacagtatccctcacttggctgactgggtgcttggacaaaaatgctttttcaggcaaagaagcagtaactgcctacctcgtgtacaagaacaccaacgtatggaattacaagattaatgcaatcagcagggccacatattggggcacccagaccaccttccacttctaactctcctgctaaaaacttttttttccaagaattctatctccccagcctggtggtttgcaccgtcaagacaaacccagtaatgtccacatctttgcacctccccttcctgtgcagatctgatgtactaaggtgatgcaaaggcacctatccccaaccgttacttaaatgaaaccttctggcctgatagcatttgccaagccttcattgctttctcattttctccttccccattggcattagatcgaaaggtctctgagttagctagctacctggtctcaggaactctcctaaacttccccagccttggtcatggtttacagtagagtcaaaagtcccttcccttgagacatggcagaaaattctgatatttcagctctccaaccatgcttatgagggtaggtgcttgccaaagcaaaaaagttaaagaatggagtggggagagccttgcaacaagaggcatctcttattcagggtaaaaattagaagcttgaatcatgaaacagtgtagtttaaaaatcagcactgccggtgcctgtgctgctgatgactgcactcggaagaattttcaaagtaaatgtacttttcaccattatctcactcatttgcattctgctccatttggattctgaaactcaactggacgctttattttcagggtaggtctgcatgatggcaaacaaacagtttgggaaggaattagccatatgggcctgggcattattttcttaatgtgggaactgggtcaaccctctacaaaatgtttcctcaaatacttaaactggcacactttccttttgagaggggaggtttttagaattaagcatcccagttggctgtgcgtggaatggtggctgcatagattccagcccccagaggctcatgaaacatcaaaggtgaagcaacgtcagacacagcctggtctggcctcctcattttctgactaagacatacaggcctagagaggtggagacctgggcaagatcatatagccaaggaccgagtccatgtcatgctcccctgtgtctcactgccctaaatcgggagaggtctgtgtctgccccttccttttcctccctatgtctaagaacactcgctgtcctgtagggggctcctcatctccatgtctgggccccaatccattaccccaatcctgtgtgattttagaggtggcaagtgtatatcaatcaatcaatcaatcaaccaaccagtcaaccaatcaaccaatatagtcttcagcacaccctccatatatgaccttgtgtccaaagcgtaggccattggctcattttctccttgtcctttctctgttcttcagaaccagggacaaaatgaaaaaaaacactgaagagaccccccagaaaccactcttctcccctagtgaaaaacgagagacataatgtggggaatgacactgtcaggggtgtcacaagtgaaggataacaatatatgaaacagagcttttaagggtaacccattatttttgtaatttgtttaaacaaaactgagtgactctttaaactctaattcacatcttggaaatgcaatgcagctatctcttgtttctctctctggagtcgtggcaataattttaatgccagcagaaggcattagacattagaggtgagcaaggcagaggagtctggcttttatcagataattaagatgctaccaaagtcaaacctttatcaacattagactaaaaataaactccttccatccagtgggctttctagcaagcattcaaagtgacagtgctctggataaggttttgcttttaaaaattgttcattgtttttcgacttttattggcaatccattctcattatgcccaatgcatttgtcttcataatatgtacttcacaattacaatatcaaagagtttgtatctacataataaaaatgatctatagaatagtacagggaaaacataataacacagtgtgattgttaatgaaatgaatactttgagggaaaacatggcatcccttgagagaacttgttcctatatcatgagatgctagaaacaggcaaaggctgggaggtgaaaccgaaattgaatctcgggttccctggaggtagggagtgcagcatggcactgcttggctttggtgatgggaggggcacaggaggggtattggaggtgacctattgttggaaataatgacttcaaagggcagccgtcttctactagctcttcagaactttctggccccaatactactagctcaacagacaactgaaatgaagctcaggtcttttctctcaagaataagcattggcaagttcttttcatggaccaagatttgctgcggctgacctgcagaggtgctgttcaggaagaaacagatctgctggaggcaacgatctctagactcagtttctcagcctgaaggcacggactacagaaagggaaaatgtggagaagcagatagcaatgtggtaaaaagatgcttggtgcccatctggataatttcatcctacagcacacccagggagaaagaagccacatagctggcaagtggggacacactgtgctatccctgctcactgttgcacctgatacacctatcctagtgcttggcttacagtacatactcataaatatgctttttttttttttttttgagatggagtcttgctctgtcacccaggctggagtgcagcggtgcgaccttggcccactgcaacctccacctccagggttcaagcaattgtcctgcctcagccttccaagtagctgggattacaggcacctgccaccatgcccagctaatttttttgtatttttagtagagatggggtttcaccatgttggccaggctggttttgaactcatgacctgatctgcccgcctcagcctcccgaagtgctaggattacaggcgtgagccaccgtgcctggccataaatatgtttttaatgaatacaaaaagaatgtcttctttatggagccaaaattttcacaattgataacccttacagtagattgcagaaacctataagacagactatcactgaactcataaaaaaagagttatattactgggcacccaggaaaaggaacaacagataaggaagaggtgcaagctgctgaggtctgcataagaataaaggttggttgtggcgcttggccaaagcagggctggggacctcttgcagggcgacgaggagatctgacagatgttccaaatgagaaagaggaggacaagcagacgttcagctctgttaagagaccattgattgaggagcactgttatgcctcttagttgacagccagtggcacgaatccactggtgagaagagttctcttctccagccagccaagagctgcattacatctggaactgggctcagatagcaaaagagcgttctatatatacatgcattttcaaaatattgtggcttctgtacattcaagttaaatgtaagtcaggttgggcagggtttggtcagtaacggggcagaggaagtagatcatttggtctctgaaacccaagcagtctgtagtgaaagtctgcaatcctgcaatggaaagaatctctttcctccactcactcacttccctccccaacttcccatccacacctatatggacacaaggtctacctccaaaaatgaaattcattatatttagagctaaaataattccagaatcaattgacgtagatgaaagcatttttgacttggcttatttgaaaaattatcccgttttatcaattttatttggctagcataactggtgcatgtgcaagtataattttgaacagggagagaacttagttgaattgtaactaaaataattctgggcacaggatggtgtataaaaatacaggcatgacaggaacaatgtaacagagaaagtgacatacagtagtatgtaataacagaagtatcttgaacctatcatccacatgttttttgtgcctgaaaaagcagaatattattataataggtgcaaaaacagttgcagcgtgttaaggctggaactcccccctagagacatagtccaagcttctcacttcaccaatgatgggacctagaatcaaagatatggaggtgactcgtccaaggtcttagaagtgggatgaaaacctggacaccctaggcttctaactcagtgtttttcaattctaccctatggcctttcattcacagagagataggcaggtaggtacgttgatggaagacagataaatacttattctccaggtagtgtcagcttttagacaaaattattctgtcttcagattgaacatcccataagcacatcaaaaactccctgtaggacatttaaactttactgcagagttaaaaactgtggagagttaaaagtcccctgcagctattaaaatagtgtgtagtgagaacagttgtattacaggtgactaatggggtctcaccacctcccacccccattagatatatatactgttgcatttctaagcaagatgtccagtatttttactcctgggggagggagcaattgctgactactatttttttcaaaactgcactaaaactttcttttgtaagaaaaacgagagaaaaaaatcaatagagcatgaaaggacatgaaaagtgcattttaacccatatataatttttttctaacagtgcgattttttaaagctctctacaaaaaataaaagtcaatgtgattctcaaagaaaaaaatgcaacacaaccctgaattcaggagcaaaagaaaaaaaaaacaagaataatgaagatctaaagatttgacctagtaatttgaggcacagatgaaaaatggtgtaagctctggccacctctgggattggcaggtcaaaggggtacattaaatgtgatgggaaacacattctgtttttggatagttcagcatatatccatattaaagcttttaagcctcccaactcagtgaaattactccgagaaaccaagtgtccccttgtggacctggccacacttctattttcgtcctcaaagagaaatggtgtggccaagaatgtgagacatccctaacagggctcaggtgaaaaggaaaggggaaaaaagagtgcaggttaaatgcaatattaaagacgatctctctcctaatcagtgtatctttcttccttacagctaagcaatctttgtcaattacagggcattactctgcaggccaaccggcaattacaatggcatctttcttcccatcactgacagcaaagggaggaaatagtctgagtccagctaaatgtaaagagggaaactggagctcatcacggaggtaatgtacagggaacctataaccaggatgcagatgctatatgcagctgttatgcaaagaagctcttgctctcagagctgatgtgtttatttagactagtgctgaggctgagttaatgccagtttccagaaaggattaatatacactaacgtggaattactgaaccgtcacacacatctggaaatgtatgtttcaactctttcttttttgtggcagccagctgtaccggagaagcagctgatgaggttgcagttgctcctgggccccagctgatttgatgtcatgccgttaagataactataggtccttctgatcaacaccatggtcctttctcccctctgatcctttcaccactcctctttattttggtctcacagtgagtttcttaccttcattttcaagtccaggctataatctcttccatttctcccatttctctcacctccaagccactttccatgtagccatgaggcctctcaaaagaatggagagatagccttgatatttgtggttcagtcatttaacctttgcacatttctgagtgggtcatctgagagaattatcctttggccaagagaccacttagaggaatggtaaaggacatctcaaggagctcaactggtcttatgaccctgaaccttctgtctccagagacaaacaacatcatgcccctcactgagtggttagcctgcttttgtgctcccatttcagaacagaccattcccccaccaccccgccgccatctcagttattcaagaaggaagccatggtatgtactgggaagtcttgtgcctatggaaattccttgagatagaaaagctaaaggcatgaggtattgtgaaagcaatttggctgccctacttctctctttcctttctctgtgcctgtcctttcttggatgaatggattagccaatacagatgtgcgaattatccttaagtatcctggaaaggctttgcctatttgaccttgggtgcggctgtaagtgtttgctcatcagtaattacaaagagcctggaatctagaagtaccttcccaatatcaaccacaaaagcaatttctagttgaagattctgctggggactcttcgacaactgttttctttgacccactcaccccaccttttgcttcttagacatccaactgttcagaaggatcccactgagagaacatcagtcaaatcgtcccttcgtctctggttccaaagtaccctgcaatcatttgtgccttcctccaaaatacctctttcactgccacatcagaagagctctttaaacgctaacaagaaccaatattttagattctactgctaggcatttcagctcaagtcactttattgtaaaattagatgtcattgtgaaaagcatggatataaatataagagcaaaaggcccttttcttaatgcagaaaccaaggtaacaatatcctatttttccttgttgtcaaaagttgtggtttttttttttttttgatagctcagccaatataatgcactgcatgtttacacttagcattaaataactattatgcaaaagtactccacagtaaaatctaagtatatttatggaaagctaaattatattgccaagtttattttagaccaaagaagcccctgggaagggatattgtgtattttaaagagtaaatgtaaactattaaatagaaagaggctttgtggaatgtaacacattctacctaggtaaatcacagagcaattacacagtaaacttttctttgatgaagcactgaagtgatgacatgtaattacttttccaatgctgtaccgtgtgtttatcaaaatgttaatgcaaacataataacaggctgtatgtttgtgctgagaatgtcagagccatccagctgtcaatcacatctgaaaataaaatcgcaaataagcaggcagcttgataacaggagtgacagccaatagtcactctgctgacaagtactttgctcccctccaccaatcacagtgtcactgtaacgtacctaataggaggaatatatcttttaggagctggaatgaaaccaagtggcataaatcggctgaactttgcatgcgactccccctccccctctctgttaatggggcttctttttggggccagcagaccccattccctctccccacgttccttcagatcagtgcccttgttaaaggctgcagagcccacaaacgggctggcattgtgaaaactcaattcagaccaggtctcccagccaactggcctggtttaatcagtcagcgtcaagccctgcggtactttccttggtcatggtcaccaacataggaagtcccagcctagatctgtcgcagccactggctgagctagtttttcttaaagctcttaatgcaattaaaaaaatcattttaatattttttgagacagagtctcactctgtcacccaagctggagtgcagtggtgcaatcttggcttactgcaacctctgccttgtaggttcaagcagttctcaggcctcagcattctgagtagctgtgattacaggtacccaccaccatactcggctaatttttgtatttttagtagagatggggtttcaccatgttggccaggctgatctcgaactcttggcctcaagtgatctgccttcctcagcctccctaagtgctgggattatagatgtgagccactgagcccggccaatgcaactttaaaaaaccgaaacaacaggtgtctgattttaaaggacaagtgccaaaactgctagggaatcagaatgaactaattagtgcttgcagggatacaaggcccatttgagagccttcctggggtgcatgtatgtaggggtgtgcgtatatatgggtgtgtgtgtaggggggatcaagccctaaataggcccctgattggtcaggtcttttcccatgatcatttccttgtactctggaacatctaggaaatgagcagttcagtcctggaaactttgttcaccctgactcctgccctcttgactttctctgagaacacttttcactgaaggatcctttcaaatgtatctaaaaattgccaaccacttgttaaagtgtaagcaggtgcatacatctccttctcctttagattaatgattgcagatattctttccagtatggggcacattttagaattttaccttgctgtgtgcagcagggcagaagaatgggcctacatccattgctgaacctcctctttctatccttattgttacaaaattcacctccttggttaactgaactagcaacacaaatcatccctacctatttgcattttgctgttacaaaatatagagatggtttgtccaccctgtcccatgcaattgtgaccaggagaaacgctctggctcctggtacaaagagatagtctggaggcatcccagtagaacgcagaatgcagggaggaattacgtccctcaatcctctggtctgcagtaatcttatttccattatttttcatgctttctggtgctgccaacaaatgttgcaaaggcaagagccgatctttgacattctcgactgcctaaagtgcagcaaagagctgctttaatcccccttttgtgcctgcaatgactagaagaaaatttttgatcccatgcttggactgactaatggtgcattttgagtggcagccttccacttctgcagaaactgtaaaactcaaccaaacctggaaacatttgaagtttctgggttcaagaaccatgggttcagagaccctcacctccatgaatatgacttgttggacattcaatgactgtgcagtagagacaacaggggtgagtgtttagatagacccagtagctctgcctgctgagcccctctgccagtactctaacttcaatggatgtgcatgattcttccgttgtagcaaatatcattgtagtaaaaagtaatacatctcctcgtttaagtgacagcaggtagggtttgttactttaattcactttgcctttctcttctgaaaattaattgagtcagatactgaatctggagcctaactccttggcagctgagcaggagacaggaggatcatcatctgctatagagagttcttgagaagccaggaatagttaagaggaaattgaggcaacttggaaaggcaaagcaggtcaccagaagtggtaggagagagatcttcaagcagcacagcagttaaagaactttatagcctcttcccaacaaatgctcattgtcgcacttcctgtcacctctctctcctgcatccctctctatctatgttccaggcacacgggactttgcattacttccaaaggtcatggtcaccgtcacaatttccatgaccttactcatgctggcaactctgcttgaaacgtccttaactcatcttctccacctggaaaaaatccaaacctttgatgaagtttgggtaaagtcactttctgcagtggagaatgctccaggaagaatgtattgttcttacgtcagcactcccataaaacctctattttagcatttacttccttacacatagactttttccattcccacttcacactgtgaggatctcctggacaagcattagtctcagaacttatgtttggaactcttacacaggctggattttctaaaagctactaaaaaaatgcttgtttgaaattaaagatccaatgttagaaagtatgttatattaaaaaatggccatcctatattacccagaatcaaaattggaatggagaggtggagacataggttttgaatcgatacaaagaactttctgatcactggagcagttcaacaatggaagcttctcaaagacatgagccccctgttcctgcaggtattaaagtggagggtgactggccacccggggagattgacaagtgattgcaatgatccttatgatgcttttcaatcttaacactctatgaggcattgggcctacatggataagtaaacaaaattgttcaagtctattaattagaaaaagttctctagtaccgtggttctcagtgtgtataagattcacttgcagagcttgttaagaagcctgggtccacccgcagaaattctgttcagtaacatggaggtggtcactgagaatctgcattttaaacaatccctccagatgactctgctggaagcagctctaggattgtcattggagaagcatggttctagagtgtgccaatcgatgggcctccctaagccctctgttatttaacacatctttactcatgttgacataaagtcagcccaacctgcaggtatgtcccaatacatgtgcattaaaaagtttatactctgggctcaaagttcaagcacagagagaattgcaaatctacaaagcgtgaccgccaggatgaggggctatccctgggaaaatagctaggagaggtctgaggaaggctgactgggttcatgacagacacaccacaaggggaggcaaggtctcacctctctaaagtcaaagacaacatagcacgccacggggtaaaatagcaaatgcataagcaagcaaggatcgtgacccaggaaactaattaatcgattcatcaaatgacaggttttgaggcatcttctagagaaatgagataaggagatttgccaagattgtggaagttctcagaagcaatgatgtcatctctcggtggaggctaatgaagtggaaaagcatagcaaccatctttcagtacagagctgcagtggtgagtagatatcagaaatgcaaccaatggttgcttggcaatggaatggcttccaattagacagtcaacacatgacagagtctgcagaattaaacttcatttggagttgaaaacttaatgttgagtgaaaaggcaataggttaagagatttgtgtattgtattttaaacataaagactcttccacaaatccaagttaatagagaaggcccttggattcagattggacagtggtaggaaatagggttatttcaaagaccttgcatatgggagaggaatatgatgcccacagatggccatgggtactatattctttattcttggacaacgacttacttttccattttttacatttcagctttgagaaagatcccagatgcagggctgtgtgaagtcaagatgtttcaagtgtaactggatcccaaaatgggaacacagtgggaagcataaaatatcccagtatggtgccatcttctacagtgtccatgttggcttcatgaacaccccagagaaagaaagacagcaacatgaaaacatagagtatgttctcaaaatggacacttggagaaattttcaggcgtatgtttatcaaatgcatttggtttcttaggaaagacaggtttagtacagataatcctggaatcccagcatccctaagatctatttaattttcgtttgcattgtttgtgaatacaatgatcatatcaatcatcattgtcaacctcatcatcgttatcatcatcaaagttattctctgagaaataactgagaaaaagccagaaatgctgaatctgccttatttttttctagcaggtaattctttcatggttactgggcatcccttcttttctgaataagagagtatcacttagctgaaggacagagcagagggcagcaggctggctcccgagctaccttaggttgtatgcctcaggcatgccccactgtgctgtctaattctagggtactttgggctttgaaagaggtttcacttttctatttggcaacaaatgtttcatctaaaaaagtgtgaggctcacagataagcatgattttaccactgtctacattaactgattatgggatattgaacctaatcagtaaagataagaaatatgactaagaaacagttttctttcttcccacatttaatgcgttcctcactttaattttgcattctcatctgctcttctctagctcaatgtcttgactcttttccactcttttctctttgctgtgctttgatactccctgcccacatgacattcctgttagtcctagtgaagaggctaagtggttttgacccacgaatacttacagatggtgctgcaaacccagctctgaggatgcaaagggtgcagaaatgtctcaatgttgggagatagccctgaagtgtacaaatcctaagtatagctccctgcatgatgataatggactcactaatatctattttcagcagccccacactgcctcttcggaatctctcctgagggctaagtgcatggatatttcattgactggcttcatttgtactgcctcagccccactgtatctcctaccagcgctaataaaaaaatatggctcattagacaagaagtgggctcactacttcttgtctgggttaactttgttcaccaaagataaacttcatttttaaactgaaggtcttctgcctgaaaacacagccatgttttgtgctacattccaaaacaggtgttggataattcagtaattagtatgcacatctaacttcatgcagcctctgttgatctctcaattatagttagctgggtcctctgaagttttctgtagttaattagagcattattgaacagttgggatggagagccaagctctgcaatcagttgacagcttggtcccatgaactaagcattgggctggtccttgactggggaatgacagtcttcagggtgacccagtgccagaatgggttagattgtcttttgaataacagctggagggaggcctcttttatgagctgagaataatggtcacattccttattctgccccactcttgacaggaaaattcacattccaatggtgatcagtttcagaaatgtctcctcaggggaaaaaggaaactttcaacattcaagaaaaaaggataattgttctgagcaggctccagaaagtcaaaacctaaggtgaacacgtgagttagtgctcagtctccctatctcatatggtttcaccttgactcccctcccagaagaattcaggaaaagcacagggggacagcaggaaggtgcatgaagggacccacatgagatgcactgcacaccaaattctagaaggcaatttggaaatgattgcttctgaataattgaggtatcatgtcatctgcaacatccgagtctgactgtccaaagctcctgataattgcccaggttccattttgaatgcagcccgtgagtattagagcaagcatgcattcatcactttaagaccaaaagacaagcatgtcttgtcagtggaacggaggggagatgctttggggactggaggctaagaagcaagaagcattactgattatggtcatggtcagcgtgctttccaaggagaattctccccgctgcccaaatttagcttctgtgctgttctttttccaaatttatgaagtcagaagggtcactgctctctcctcagcaagttgtgaggcatgttgttctgtaacccacccctcactgcagggatctgggctggcttactgagtaggttttcatttcccagcctctcctctctcccacccccaccaaccaagggtccccaatgtggccaagaatgtaaagacagcagaatgacacacatggctgaaataatgtttagatttaactaaatgttggaaatagaattggtacagtgaaaagaaggctgcctttggcaggatctcatctctactcaaccgctgagtaaccaatgtaagtattacttttctccatcatattagaaaaatgaagataggcgtaaccttcagaatcagttaaacataggtgaggtcacctgtctccctggggatggaatgagacagcacagcacaggagagagggggtgggaacaggggtcagaaggtagaagcttgattcctatctctcctctttgctcagtgagtggtcttgggcaaatcttgtattaatgtggacatcaattcctttaaccataaacaggaatcaataggacctatgctatacacccacagtatcaaggggaggactgaaagtaaaaactactgtgtgagagtactttggaatctgcaaagagtgatataaacaaacatacagcacatactggagtgaggcaggtgtgtgatcaagtgggctgaattgattgccaggaagcttgggagaaaattctgagagtttgggacactagacagcagccacaaaggctgacatcagacaatttacaattcagagctctctggggcctagaggagtctttgaagtgagggagctcagttcagctcttctacctcaatcccactctgctgtgctgtgaatttaaagggcccgtgccagattctcaccagggcccgtgccagattcttaccaggctgcctacaaatcagggaagagcataggagggcgcaacaaaagttctaggacttctgtcttgatcaccaccccacactgctctttccttcattaatcattatttataaaggctagaccagaggccctgaatcaggcactagactttgccaagtcccacttatcttagaatgtgttgctaagaccctcacgaggccctcccattccaagatgtatcatttcaggattccatggttcccaatcagaagttcattaaaaagatagtaattagaccaggtgacgccgctcgaggtttactaagtgtccttcagctcaattcaataaacattgcagactgaccgtgggcaagacaacagaccaggccctagagcagtagcactgacccatttcattgtcgacagtgattaaaggagatgaaacccatttgtgagtttatgaatgtatacacacctggattgctggtgctgttgttttctcatgttgatgttcctaacactcctatggggtgggcagggaaggccttatcattcccattttacagagtaatccacagtccacggagattaagatcccatacttagataaatggtggagccaagacttacccaaggggtgtgcctgtgttgtaacagatttactgaagtatgattgcacacaataaataacgtcgttaaagtagtatacaaggtgaggggttctgccgtgtgtacactcatgaaaccatcaccacgatcaggactgcaaacacgtccatcacccccaccaaagttttctcttccccttagtgacccctccctttttccctccccctctttattctccccctgcccctcaagtacccagggatctgctttttgtcttgaaagactagtttgcctttttaaaaaatacttcatataaataaaatcacataatatgaaccttttggctggcttctttcacttggcataattacattgacattcgtcatcattactgcgtgatcagtagtccattcctttctactgctgaggaatatcccattgtgtggaggcaccatgatttgttttggtttgatgtccaatgattttttaaaaattgttcttcttggaaaaaaaaaggagaagaaaaaaagtcaattccctcttctcctcccagaactctaaatgattaccactcaagtcttgtttctcaaatatttcctggttaaatggacaaatatattacaggccacatcagggcttctatgcacagcttcgggaagaatcagtttcagtacgttttattggaacctgcacattgagacgacagcttctttgcttgtagacaaggagaactcacaaaggcataaacaatagagaactttggaaaaattatgagagcaatttaagagtggataattagatatcttttgcagggtgttagggaaattaaattagctttttttaaaaatcaaggtttgtgggaatcacttcataaaaaatatctccgtgactgattatttttctaacattcttcgcctttcttccttgcatatccaaggaagtggcacttttagcccttagctgtggcagccaatcatagcctctaattgcattcactgcataaattgtcagtgtcatgaataataaaattagtttaaataaacccccagccacaatcacaaataactatctggtggaggatcttgtgtcctttcattctagggggatgggtcagtgcaatctctgtagttaaattcttgagttaaaatgaagataaaattattggggaggtggggatagagctgaggggtgaaagtgggaggagaatggtttctggctcccggcaggttcatgaaagagaaagggtcttcttcctgagcagccttccgagagtgcctcatacctaagacagtcagccctgaccagcaacaatagccgagaaagggcttgtactggccatgccagagtctagagggaagagcttggggctcagagactgagcagtcctgcgtgctcctgtggtggcctaatgtgacctattatccagcaactcccatctatttctgaaaactccacgtgctggtctggcactctaattgtccaatctgctgctcaattttcaacaggatctcatcaagcactttgccatttaatggtgaccaaatccctccagttttctgctccctggctgtggacagaaggcacctggaggggtgctgtgggagtcccgtggctgcacatcctggcaaaaggagttcatttcgatggccaagcagcttctatcagcttttctctttctttacaggccctgcccaaatactctgccttctgtagactctactgaagccactagggtgagtgagagagtagacgactgcaaacatgagcgtcccccagtcccagcaccacagcggcctgcctgtgcccagcgctgccccagcatcctcccaaccactgtcctcagcattgtttcaataggagtcacatgattttccaaaacacaatcccttctttcaacctgagcctcagctccctgatatgttaattcccaggctgattccagtgctgttggtcccccgcttggttcattacatttctgagcccactctgctgcctttatttaatgaggtttattgtttgtgcttagtaattttcaaaggcccatcaccctctttgagtttgcccttagatcttcagcctgccaaagaggtgggcttttgaagctacctttattaattcagtacctagcttctgcatttaatggcacatgggtttgaagtgtacataagccacagtggaaacatctgagaagcgtcccaagatactgcaaattataaagggtgattaggaaatagcatggctctctatcttctcatgccttagaactttattccttatatcaaaaagatcctgggatatcaaaatatcactgtctgactctgataatgacttcccagagtttcagacattggtggaaaaaagatataattttaattatcagcagctccacttaaaaaaatcttcagctattgtaaagggcaaggagctggaaggaaaggcagaagaggaggcaagaggtgagcccatgtcctactaaatgcctgcaaagtggctgtctttgagagcgctccacagtccctgccatggatggattccttggaaagagatgcacagggtgctccgactgttagtctgtcctgctatcactatcactgtcagggagcaaacggcagaagccagtctcagggaagccagtggcctgacagttaaggcaaatgcacagacttcagaaatcacaccaaagcagcttggcttctaagatgcagccctgaccggctgactcaaaggaagttggctggcaggttctgcgatccctggagatgggcagggctggggtcagactccggtgacagcagcagtggacacaatccaggacttcccagtgaggtctgtcttttctttgaaagggacagaggagtgtggtccttgggacatctagcccagggaaagaaatcttgcccaagaatacatatgaatatctgcaaaaacaaagttggggtttgatatctttcaggaagcctaggaattctaggccactgccagcattgggaatggttggctcccttccccttccttccatgcccagctggagacagaatgctggactctgggtgcctgaattctgatcctggctctatcagtgtctctgtgcaccagagagaggccacttagcctcccttggcctcaatggcttcttggtgatcttccaataatttttagcagtagaagctttcctttcctaattgaaattttacagggaacaatatttaaaatagctaagaggggctgccatgcctgagggtggtccctgcctgctctgttttcttcatccccttcgtaccctcctgctcagcagaagctgagggactccaggggaccccagccctcctcaggacccaccgtggaagcagaactcccaactgtctttctcactgcttgtggtttgtaagttttatgactcgattttaatctgtaccatttaggatatgctcaggaggggccctgggagaggcacaagtggcagcttttttttcttgaaaaatcagctattatttatccttaaggaagaaaaaaagcaaccctgagaaaatgattttcttttcacagccttattacaaatgctgagcacagctagaagtaaggcctggctctgtgcacgtgtgtgtgcatgtgcacgtgtgtatgtattatgtgtgtgtgtttccggtgggcaggtgtggctggaggcatgaccccttttctctggttgatttcatctccagtagccaagtagaaactacagcatgacctgacttctatgcccccagcactatggccatgacagcctccagataggagaagggtctggcttcattgacatttccacggtagtgcatacagccctcgagacctactcaagagaggacaaaagagaggctcgggtagagcttatctagtggatgaacctgctcctagacacagagcactgcctggcatccctgctgcagaatcgggctaggatagggctgagtattctaattgcctgtgggataggatttcactatatccctgcacagctgttttcatgctgtggttggattttgacgctgtcgtaatttcccccgttgtttgatattctcgcatttacattaaagaagtacaggagaagaacagtgttcttgggagaagatttcagcatttaggattcatacaaataaatgcatggactgcccacgcttccctcacatccgtcaaacaactcagttaaaaacaccttttcaaaaggctcttctataattttacttcttttaaaaatagtgatggggttatgtctgatgccccggaacgtccgtcatgcattgattttatccagttcagtgccaggcagcaattagcaaaggtaacactaattaggttttacaatgtaatatgtgtccttctaaacttaagtcatagcattttaagcttctaatgattgcaaggtcattttgctattcttcataatagcagggatgctaatgagtgcatttggtatgcgtggggatgcccctgtttcctcctggggcttatcagcatttactggggacactttacttaatttgttgccgagctcatgacctaaacggaaacattgaaccggccacctgaaggtctagaagttttagactgtggaatcagcgctgtggaaggcccggctacccgggttaccgtgagctgatcatttgttttcctctggacttagaagctccgcatccaccctgtccaatctccttagctggccaatctccctctcccacgtctgaatgcacttaaatttgctccttcctgctaagaaaaatgttatcctattaaacgatgcgtgttataaataccttaacattcatagtttcatgttttaatcttgctgctagcatattctgggcatgcttactggaatcagttttctatttcttagattgtaagttctcaggaggcagattaaaaactcataagatggtctctgtaaaatgtctttcccagagccgcgtgtgacttggtatttcatgtgggttttagatgtggctgtagataatgagatggcgggtatgacagtgttgagattcaagcagcttcagcaggctctcccccagtgcagctggaaaacatgacaaaatacatttccactgttgacacgtccacctcgtcctgttggggtggccccccagggtggtgtgggtttgagagacattgttggggctcagacttcctgccttcctcttaaggaaaaataaggaagtgatgaattgaggggaatacacgcaaagtagagaaagctagggttgtcttaatttcatttatttgctgggtaagtttctactcacttgaagctatagtccaggcattgtgttaggtgtaggggtgtcgtggtgagcaagacaggtatcatccctgcctccagagcttacagcccaggctggggagtccacagtaggcagcaaatgctttgagtgattcttatttcaaatcgtgttaagtgctgggcatggtgcctcatgcttatgaccctaacagtttgggaggccaaggtgggcagatcccttgagcccaggagttcgagaccagcctgggcaacataatgagacctcatctcaaaaaaaaaaaaaaaaaaaaaaaaaaaaggaaaagaaagaaagaaagaaagaaagaaagaagctaggtatggtgtcacatacacctgtagtctcagctactcaggaggctgaggtgaaatccctggagcccaaggggtcaaggcttcagtgagccatgattatgccactgaactccagcctgggcaacagagagagaccctgtctcaaaatcaatcaattgatcaatcgtgttaagtataataaagaggctccagatgctatgaaggaatagtgggcctgatctattcagtggggatcaggagattcctaaaggaagtgatacttctgctgagctctgagggatgaccagaaatgactagacacacagtggagggaaagccattctaggcagagagaggcatgtaggagggtcctgagataagatcattcacagtgtattccatcctctctggggattttcaaggggagcactctgcaagagtcacaggattagcctaggaaagaccgggctttaaaacaaggagctcccaggcacagagattcttggttctcaaatgttgcagcctgtgacgattcctagtgcttcaggatggctgcttccccacacggagcttccttcttgtgaaagcaagaagaaggccgggtgcagtggctcacacctgtaaccccagcactttgggaggctgagatgggaggatcacttgaggtcaggagttcaagaccagcctgggcaacatggtgaaaccccgtctctactaaaaatacaaaaattagccaggcatggtggagggcaccagtaatcccaggtacttgggaggctgaggcaggagaattgcttgaacccgggaggcggagattccaccactgtacactgcagcctcagcaacagagtgagacactgtctcttaaaaaaaaaaaaaaaaaaaggaaaaaagaaagaaggaaagggagaaggaaagcagagagggcatgagggaagagatgaaaggaagaaaggaacttccaaagcaatgctctgggacaagcctttgggattctcctgccatccttttaagggaactgaaggccagaacctgagagggagacattagttctaggtcttagacccagcaagggtaaccagacagggttactactgttctggttactgaaggctcccgtgcatggagtgttgcattccccagcctctggagctggtgggggttggagcttcacagggtcacctccctaacttcccctttactgctgtcctgagcctggttcagaactcattctgtcaggaaccccagtgaccacatgacccagctgcccccagtaggtggctgcctcagaccctaggcaataaacactccttgcagcactcacttaatgtgacataaagagaagaaactgcagcggtgttgtcactagagcgaatggcaaattctcatagctagataatgcagaaataaagtgcatttgtaatagacaacaaaaggattatcccccattcatttcaaagcaccttcatcccactcagggattacatttctcttacttatcttgcaagtagttttttctattcttgtttatccctgaagagcacatgtatagcttatagcaaataaaaagctggacctgttaaaggcaaggccttcattagtcagagagaagtcattctccaggactctgtgagttctctaatccactgctaggcagtaggatacctaagaaactaaccctataccatccaagacagaactctgctagtctgcaaggatgaacatggtccatgagaaatagcagcatctcccagaaaacctgagcaggtcaggggcttctctgactcctctccacatttgaccttggtctctgagatgctctttgtggctctcctgtatgcctgttgagatgcccatgccctttccagagctacagacaggcatgctgtcatcagacttccaatctttactctgaatgagaaaaacatcaaaatctgagaagcaggagagctaagggtatcctagtgaatggaatgatgatgcaaatatcctagaaagctgtgtagagaacgtggggcctgtccatgggcttcagtgcccaccatgcagtgcatgggagaccgagggaatggctgggactttaattcttttgagggccgttgctcttctcagacacccaggggaggggttccatggccacagcaagctctctggcagcctctgacctgtggagattcattctcaccacgtgttccaactctagaactatgtaactgctcagatcttacccaagcgcgtgttctcctctttcatagcttccattcttacccccattcacatatcatcatgtgcttcacacgcagtggggatcttaacaggcattgccatttcttttgcttgatatttctggctcctttcttttgttactctaagactttgcagaatcaaaagattctaagaagaggccagggaaagagcagaccatccaagtaccaaaaatccctagtaggcagccttctcctctctcttccctgctcttcctcttatccaagttattaaaatacgaaagatcatctcacgaatacgggctacaaacaactccacaactaaagcaaacccttctggtcaccctgggtcagaggagcacaggtggtcccatggggaagggcagcaatttggccccaggacaccaggttggtggcagaacctgctgagtgttttcccaggctggcggggaatctcatgaggaggagatcagtcctggaatgtccaggactgaggggacagtcatgagggggagatgacacagtttaggacaggcttccctttaaggtatttaactttatagaaaatggaaagccttccccaagcgttctcttattttggggaaaaaaaatgaatgtgcaattcaactgtaccccagaacagtccatcatgaacttggacctttgtcactcacctgtcaaccccatctaacaccacccccaaaaggagtagaacaggaaaccagctcccacagagggttaaaggcacagcatcctcctgtttgtatatagcagaccattagggtatttttatttctcttctctccatgttgcacaataccacatcaaaaatacatttgcagcaaagcttattttctgaagatagataatttggttaaatcttttccactttgatttcatctccagtttcggacgagcagcagtacaacatgcagcagcaaaagcccattttattctcatgaaaaagaatttaatgaccctctgatataaaattgatcctctgataagatggcacttgtgggttactttgacagaaatgttaaactaagtaagtctgcacatatccactgatgtatggcacctcgagttgctgctgggactgcagaggacacatcattctgcctctgcttgggaagggggagtgggtgggagcttggactgtccacactggtctagcactattgtgtcactgaattcctacagaatcttagcagtcattgtgtggcctggagctcacatgggttgggaagtttggacaactgtcttgtagaatcaaacattttatttcaggcattcccaggtggtgtttgccctggttccagtctctgatgccacagtcgcctatctcgtggacaggtggaagtaaagagttaggatcaaagctgttagtaacaaggacaatgaaacactactttatgccaattaggttagcaagaattagaaaactgaaggataccaaggactggggaacaggtggggaaactggaactgctctgaaccagtgttgagaatataaactggtcggatattttagaatattcctggcagtacttaatgaaattgtgcatgcatatatcctaaggcacataagtaagtattgtgtggtggtatgaatgctggattctcacacagtgggaaattagaagaaacctggagatgcaacaaaacagaatggataatgaaattttgtgaatgcagcaattagaaacaatgaagtgggcagatacctaacaatacgaacaattcctaaaagcagcgttagttgaaagcagaaacagaattatatctgtagcacaatgtcctttaggtaaattaaaatcatgcatataggtaacaccctgtactttacatatattttggaagacctttatcaaacatagaatagttacctgggggtaaaggaagggaaatggaagtgaggaccagagacgaagatggaaaatataaaaaaagagagttcttagatgggttatgatgtgtcataagctgagaaatatgactaactcaagtctttgcagcttatattcaatttaaaaaatagcacataacttagaacatggaataaatgccaacttaagtggtgattttgatggctacaatccaggccccctttcccaactgtcctccaaacctcctttatcctcttgaacaatcagagggggatgctgtaagatgagacttaaaagccgcaggggagtttggggggggtctctcgcattcctgaggtccctttgactataggtaataaaggttaacagaaggtggaaggctggttagagagtcaattacaaactaactgactcacaaggatgggaaaaaacccaggagatgcactacgatcttgtaaaagggagatttcctatatatatatatatgtttctcatttggggagtgcattgactttttgacttgggtataatgatcacctggagaggctgatcaaaacaggagcctgcctgaatgctttatagcctttcactccttgtagacatgaagatagctaagaaaaagtaaatggaggtcatcaaagtcatttgcacttgtaaaatgtgacccagcaactattaaacacaaaatctctgataatagccgtaaaagaaaagaagtgtcacctatcctaactgacaaaggaaaggaaggagggaggtgaaagtcagatgcagaacaccgattaacttcctcttctgagaattaaaatggtgaccacttttctccttccatctaaccaatttgaaacaaagacaaggaaggcaaagcttcctcaaatctggatcaccactcaacctttgaaaggctattccattgtcaccaattggcatatctgatcgggcaaatcaaggactgaggtttggaaacagatatagcaaaaggtgctatcaagtgaaagggctgagcaggaaggttgattaagtccaggctgagtaggaaggttggttagctagggctagtgaagcagctgcccctgaagttctgtaacaactgggtacaccatgtagtttacaagtaatcctcaaacctggtcaaaaatgttgtcattgaggcctagtggttgagtttttagaacagaaaaaagtagcaagtggagactctggaagagctcctagacacagaacatcttcttagagctttcctagtgctcaaatcttctacaaagccaaaaccgctctttagttaagcaaatttgggatgaggggaagtaacaaatagtcatattaattgcatggcagtggttgttttgtaaaaggaatagctagctggtgggtcacttcctctgctctccaaatcaattgttttgcacaatggagacacactccttgggtcaggaaactaaatgtgagtgtatctgttcccatgtgtgtaaatatacagctctcatgtgcctaatttatagcaagtcacctactactagaacatcggcccttcagttttggatcacttgaattattcaaaccaaagacgccttcaccaccaatgatcagaggaaaagtgattcagatggggtttagaactactcagagtcttccttgagtgcaagcagttccggcttgtgagaaattcagagaagtctagaaatagaaataacaaacacaaaaaagaaagcctgcatgtttattgataacaacctgataggaatgcatattccttctccaattccctttccttctgcaaagagttaaacaaaaaagtaattaaacaataatttctttgtgagtgctggacttctgaggcctgttttctctgttggaaaaaaaatagatttaagataatggccctattctcctcagaataaattaagctcagagataaagaattccattactaatgcctttcagcaaagcccaggcatcttttaaagtcaaactttaaagtataatatgccgtgatcttgttaaaatctttcctgtaatgatatttaagtgatgggcaagggtatcaatggttcaggcaaagtattgattgtatatcttcagggctgttgagctctttcagagtattctgtttgagggaatgcattgtacttatttaaagacattttcaaaacagttgcaagttaactcaagtaactgattttttgtatgtaaaactgtaggaaaaaagggaaagttggaaggggaggatagaaagataggaacctgaaggatactcaagttataaatcaatgacaaagaccaacagtaagtggatcacgaggtcaggagttcgagaccagcctgacaaacatggtgaaacttcacctctactaaaaatacaaaaattaactgtgcatggtggcgcacacctgtaaccccagctactcaggagggtgagacaggagaatcgcttgaacctgggaggcagaggttgcagtgagctgagatcgcaccattgcatttcagcctgggtaacagagcgagattccgtctcaaaaaaaaaaaaaaaaaaagactctgggatattcctataaccagcacagcacatagaacctgcttcaagttaacgattcttttaggtgcttagctctcaccattttcttttctgttgaagtattgacaaatgactcatcttcacccttgtggtaagaagtagtcccttcttccttggggagcagggggtttcttggagaggagatagttagttgctagtctggaaaatctgcagagtctcagcaaatccagctccattctctccggaagagaatgtgaagagtcagagggagcacaggaacaattcagtgagcaacgatggaggatactgtctgcagaaagcatgggtgatggcttgggactatggtggtcctgctggcaacctcttggtggtgctgaaagcacctgaaccattatcctatttaagtcacaacttggatgtctaaagccatcatatatgatgtccacatacagatgatgaccccttgaacatgggtttgcaattcccattcatctcccctacatgactgtatgtgttttaagggcagagtttgaaaatcatcccttcctcacttgataacctgaataatattcatggctctggagagcaaaatccttcaaaaactggttttcctccttgaaacaaagaaacaaccagtgagttttcctggaactaatgccatcctagagttcgcagctaaagtgacaccagttgtttgccaggtggcttcgggcacaccccaactgcagcatggaatgtctcaagggtcatagggctgggccctgcctctccactcttctcttatgcaggagaatgactaacaccccctaggtgttagttggattctgcactcggattctgcaaagactatcctggctcctgggcatcaactttcagttggaaggagctatggaggcttgttccagtggtctcatcatcctggaacatgcacagggctttggggctacttggcctgatagctcgtccaccaaaaggtgctgtcattgatgctggcaaggaaatacccactgtgggaagggctgtagatatcctacaaaagaaatccagttcctggtgaggtggcacacactttcgtgtctttgttatagaggaagaggatcccattgcttaacatttctggcttacatttattccaattctttggattgaattaatctatttgaaatatgtgcatgcacacacctatatgcacatatttatgggatatatagttgctcgtgactttaaaatgtatatttcttatgaaactaggttaaagttttatagaacagaatgtgaaagaatgctctcataagtatatccccctaatgcagtgaatttgtttaacaaacatttgtttggttcttgctatgtgtcaggcaaggcgccaatccctgtggatacagagaagtgtgcgtcaaagtccctctcctccagagtccacaatctattgaggcagatgaatgagaaaacctacaaagtatgttaggaagcagacaggatgctgggcaaacactgggacacagctcctttccaatattctggatggaaaaacctagttcttacagggctatagtcatggaagagatgcaattttgtattctgttttcctcctacttgtgttttaatcacatttccttctgaggctacatggttgcaccctcatctctcagaaagacttttctttaaataaacagagatccagatagcaaaatgctaccatccaatgtctttgcctatatttatttcattacttcatctgaataatactttttttaaaaaaaaggaagcccagcgtcctatgaccttgtgaaagaagcaaaaaatagcatcatttactcagcagcatattgtacctttgcctattgttttcttacttgtctaattatttaaaaaagaatagctgtggtaaagcactctctcaggcacaaatatgcttctgatttaagaaattattatagaaaaatgctggaagccttgtagtcatctttgctatatttagagggaaaataacgtccctctgcaattaccatttggtatgaagtttaggcactcacatttttcttttcttttttttttaaactaattttttcctctttttctctgggttaacaatgcagggatcatagttgcacaattattaaaaagaggccacttaaattcaactctccatggatacagtgtctgtggcaatgtttaattagagattaaaattgaggaattgaataattgaggttgctaatgaatttgaaaactcagcaaagcaaggagagctgagcgtttttccgacttagcttttctttctctaacccttttctcatttcctactattatcacatttctggccttgactgctgagtttattactacccataaccctggcctaagtggaaacaaaaaagctgtagcctctttgctgagctcctggagacatttggtctattggatttatgacatgttcagaagcttgcagttgcaggaggctgacaatgatgaaaatgagatatgttgggccaccaacgctttctgtaatcaccttaataggtcaacataacaatggatgttgctggtggaaaaaataagaagacggtcctaaatcaaaggcaatttaatatattagaagttctattgctaccccctctagggagactggattatttgggtaccttgcttggtaggcttgcattagcttcaggtgcccaacaatgaaagtaatcccttggttcaccctggaacagaaccagttctttacaaggtgaccctataatagctatccccttggtagatagcacatctcaactctggcctggaggtaattctcaagcagggatttctgcactgggaggaggccagattacaagaccctgaaggtcctttccaactctaaattgctatgattttatgaagatggcatagaaaaaactgcctcactctaagagaaccataccctttgaagcctctttttaacacacaggtaaagttttcaggactatttttatcatttggacaccgaacttcagatgagatattccaagtttcatttagcacaacatatagatggtttaaatctacattcaaggtaaatgtctgtattttatggcccgaagcccccaaactcatgattatttgctattttgccattgctagttaaattgggtcttgatgtttactgcatctctgactgcaataagactgatcactagtggggatagtgcaactgataaaaggaacctgctccaaagcaatgttaacatagcagatatttggtcagaaaatcttttatgaattagaagtcattcctaataacatttccttaaaacttcttagccacacttcttagctcagctgctgatggcttcctactaatgactttaaatacatgtttttgacatcaggaaaagaaataatctgtcttacaaggctgttcttacttataccaagaacaatctgtctcctgctacagtttagcacagctatagcttgggggtagggggtcaaaggaggaagtatgcataatgtacatatttaatcttgtctcgtctatttttatcctatgttcactcaatatttgtagcattctctttgcgtctgtaagcatcaatgctattcctcagagacattaagatcccagagaagagaaactgtaaaaatgttctttgatggtatctaggacaactccaagtatagctaagtatataataaataactgactatccatgatggggatgatgatgatgatgatgatgatgatacagaaatagtgtgtaaaaaaattcatcttcagatgggtatttgtggcaatgcttcagaggggagagacatttcaagagactgggtcattccctggtttggcaaaaagggcgacatgatggttggtgtctatgaagacagctgtgtgtcatcaacagaaggttctcataccacacagctcagcttgcagaggaggaacggggcttgattccatggcttccctacttgaaggcagggcttggcttacttccaataagtcaccttccatggcaaggggagggtgggtgatattttttagtgaaggagatgcttccggggggagctgcaagctgaggggctgcaccaggaatacaggattcctgggagttgatgggaaacttctaaccttcaactgccttcttttctcatttacacaacgctatcctggggtaaagagccctaaataattgcaatgcatcaacttggcagagggctacacattaggtaggtccttccataatgtctttctcattaagagtctaagcccataaggcaatttgtggcatttactgttcatcgctcaggggtcagagggtggggagagggatctttcattttgggccttatcgaacctgtcccgcttgtgacccacaagagcattgcaagcctcatcctgcacagtggcttggtgtgtgattcggtgtgctaaatggcatgtctccattctccaatctgtctggccatgaacccttaacagaacaccagagacctatgtgagatggaattgttgtgtaccgccacagcctgacaacacagagccctatctgccgctgccagttcgggcggatgcctaacgagcacactggggagagcctccagtggggacatgactccccaaagcacttcaggggttcctttgtccgcacccagccatgcaaaattcctggtgcagcacagctaagtgaggatgcacggaggagatgaaacaggctgacaggcagagccattctgtttggggtttgtctacaaaattgtcagttcaggtctccaggtcaaaaatcattttatctgctgaagcagatgctttgtagaacaaaatgccaggccgacttcaaggccgggaggtgtgcagagccccaggctccaatcacactgcagcaggagcacactccagcccatcctgcccctctctgaattccctcactcagagataggctctcttttctctctgtacactccagctccctggaagactttctgacagctccctttctgcgggctgactgctcaagaagcaagatgttcaaagacatggctcccagtctcggaaatccaaacctcacgccttgtgtgactgatgagccacttttcgttgtttgctttcttaaaaataagcattaaaaggtagggaggtattgggagaactggaatgatcagtcttatcaaaagagggaaactgaggcttaaggaacggaagtattagcagcaaggttactcccaaagagacatgttacagcccctaccagatggcaagaaccttgaaccttatttgattgctgcctctgcccagtaactttaatctccctccagcagagaagtggatagggacccccctgccatgaaaaacagcgttgttttttgtttttgtttttgcttcagatctcctttcctttcactgttttttttagcatgtatgggaacattatattcaccaaaaatcaggactagcattaaacccagaagatgtgaactgcacgcattataaggcaaattagatcctgaaagtctgcactgcactcggatccccagcacctcctctgtagcccacagtgcaaggctgcctgtggcttcttcctgggacgtctgctctgcctcctgaaaggatggctttgcctttctgaggtccatgaagggaagtcagagtggcttggctgagccctacattttctttttctgtgtaattccatttgataaagaaaaagcatttagaaaggttcattgtttagatattgaaagacaggagggaagcagacctaggaaggaatccttagtttccttttgttgtacaaggacactgctctcatgcatgtcaacccattcctcatggggcccaccacaccataaatgaatcaggcaataaaggatcccagtggtaccattgtcagaatatctaaattttgaattaaagacttggttaagatatgaaactacctaccttccatttggaaatgtcccttgaactctttccctagacccccactgattggataaggtgagtgaacccgagctccaggtgcctcccaagtccactgtgaagatgccctgaacacgatgtggaacctaggcgagggaggggtctgcattttatcagatcatgatctgtgtcaaatatagttatgagtattttcatcaaagaatatcatagtttccccagcactttgtgaaggctgcgatagagaggaaattgaaaggcagggtcatttccaatggcacacaacacagtgacctcagacaacacagtgagctataagaaaaagatggcttgcagacgccaggccaggcaaagagactttttgctggagggacaggttgagaagcataagagaacttcggcaaccacattctttttaaagtattggagctcttctaccatttgctcaaaaagcgttctgagtaccaactatggcaaggtttggagctaaagtctagagctataaagatcaatgcatcttttcccctagtctaatgggatagacaggccttgaggacaggaaatgagactgaagtgacgagatggacacgaagtcagcaggatcgggcccctgctgccctgcaacctcatctcctcccattctcccctctggctcattttgccccaaccacactgaacttttgagttcccccatcaagtccaggccctttcctcctgagggtcttggcatctgctcaccctctgcctggaatgctcttcccctgggatctgcgtggcttgctcctcactttcttcagatctttactcatacatcaccttttcaacaaaggctttcttgaccacctgtgatgtcacaccgccacccaaaagacaccccccaaattcttccctgctttcttttcctccatagcccttatcagtacctaacatataaatctgttatgtatgttgtttatgatcctgccccctcccgtcagaatgcaagtcctatgaaggcaaatatctgttttgtttactgccgtattttcagtgcctaggcacataatagacccttgataaatatttattaaataaataaatctaggtggatattccaatcggttgctttgacattcatggatgccaagactaagagatttttatgatcattttgtccagccaagactaagagatctttatgatcatttcgtccaaccaaagcaaggactccgaagcaggactgcttgtgttcaaaactggcctccatctctgaccagctgtgtgactttgggcaagtcactttaacctctctgtgctctggttttctcatatgcaatgtggggacaataatagtgacttcttcacagggttgttgtaaaggttaattgtaattattatataaaatacctagaacagggcagggcatagggtaaacgttctagaaacactggctattactattggtattatcaagaaaactgaaagtcacaaaaggtaagtgatttgctcaaaatcacaaattcattcatttaacaagtattaaagggcttcccatacaccagaaactggggattccacagtagattaaatataatagtttctgcttttatggggcctatagtctaggtaggaagataaatgtcgaacaaagactcaggcaaatatatgcagtcatccctcgttattcaaggaggattggttcctggatcctcttgggtatcacaatctgcggacgctcgagtctctgatataaagtagtgtagtatttgcatataacctaagcacatacactttaaatatctaattacttataatacataataaaaatatatgctatgtaaacagttacttaaatttgttatattatttaaagttgttatgttaaatttgtgttattttttattgttgatttgtatttttcaaatattgtctattcacttggttgaatcatctctgaaggtgcagaacccaggcgacacagggggccaactgtaattgcaatctgaatgaccaccatgaagacataggtcaccatgaacatgaagtgtgggagacctaatttctcttctcaggcagggaaggaatggggtcggagagggaggagttcatgggaggtgtggcactaaaacccaggctccggcctgggactctttacattataagtgtgtggccctgggatcaactgtggacttcttcactagcctgagagttcctcaaggcaagagagcaaggacgcattgcactcatccttgcatatctgtagctccacctcaggcacggtgcccagctcccagcatacccacagagtgagagccatgcctattccttcagcacgtgctaagcgccgactctcagggcatggctctgaggatgagagagtgctctgagttgagatacaccgcccacaatacaccccgtgggtaattaacaaccgagaaagggctctgctgaatggagtcgcaacagcacctgtctctggtgtcctccaccctttcagcaggccaggagtctcttgggaagcctaccaaagaagggagaaatgtcctttgctctccataaccctaggggaggcaggatcttgacctcagagatgaccttttgccatcattgtctcagctttcatgaaaacagttgtgcatgaggctgaagcaccgccattataaaaaacttggttaaaatatggattaatccctgggagggtgttatgcaagattcagatatatggtctgtgatatggatatgatatttttttattgcaataataagtttctcaactcctaatggaccctgtattaactgaagatgacagggagcgagggatggaaagcgggcaatttgttaaggttgcagagcagcagttccagggttgtaaaagataaaacatttcagagtcattaaaatcagcctaaattgtctatctgaactcaaagcaacaaacccaacttggccctgagtccatcaccagctatttttttctttacagtgttttgattctcttggactatacacacagctcaatcttctactcccagaaggtccagggctttgaaaagactaatctcaggacttcctggaggaggtggactttgagtgctcaagcagtggaagggaggcagcctttgatggatacacatacctttataaaaaggctttcagatgcaggaagaggcagccaaggtacagtgggctggctggagagaagggatcactgggggtggtcttaaggcctttttggggttggggcctagtgggtagaaaagatcttgaagcttctgattaggactttgtagttgtctgtatgagccaagaggagcataacaaggatttgaggacaaaggtcagactcatgagttagtgggtatttccagtgaagaggctggctactatttgctaagagcttactaaggtccaggctccgtgttgagggattttcataaactaactcactaaattcttacaagaatcccacgaggtaaataatagtgtatacgcatcatatggatgaggaaatcgggcaagtttctccacccctttaggactccacatcacataaccaataaggcagctggactagggttcaaaccccaacaaactaacctacatgaatgtgttagctggaagatgtccctctttattctgatataatgcagtaaactcccatgtgtcaggctccattcacctgctaggggaaacatctctgatggcagggactgccaggtatccttgctctcagatgatgtcagcagcaggaaggcccagcagtgatgctggactagacccctgggcttagcagtgagcaagactgaaagacagatgttctcattgccgggggaaggaaaggtgggctttataacaccctctgcacctgccctgggccacagggactctttctgcattttatcctctgtggaggagaaagtcaccatgaacagaaagggttggcacagaagagagcaggagggaagcaagaagcagccccaaggttcaagggatgacacagagagaaagagagggtggtgctggtgatgacaatgatgactgcatatttctagacatggcccctccaagtaggagacatgggcagaaaggagaccagcaaataaaaagcagccaccatgctgagactcttctttgaaaatggcattgttgtcaaacttagaaaacagtttcccaccctgaataaaacactgacatttgtctaattaaaaaaacctaatggagattctgcagacagagggaagccgccagtgcatctgctggtgaagtctccatatggcccaatccaatgtgtactctgctgcagagacagagcaggactctagaatcgaagctgcccagccattaaatcaccttcacggcctcactggccacggaccaacagggcaggaaagctcagcccagatttctgctgtgcccctcctctctccccgcagcagtaatgatctgacctgtggaccacccctcaggaagtgttagtggcaggaggtgataaggaagagaaggacagtcaggaaggactttcctcttctgggccccagcagatggtgggatgtgtccataagaacggcatccgggcacggtggctcacgcctgtaatcccagcactttgggaggctgaggtgggcggatgacgaggtcaggagatcgagaccatcctggctaacacggtgaaaccctgtctctactaaaaatccaaaaaattagccgggcgcggtggcgggtgcctgtagtcccagctactcgggaggctgaggcaggagaatggggtgaacccgggaggcagagcttgcagtgagccgagatggcaccactgcactccagcctgggcgacagagcgagactctgtctcaaaaaaaaaaaaaaaaaaaaagaacggcaactgggatgactcagtagagactgggaaggaagccctgcagagaagctgccagcccacatactcatggagagccccaaatcgtccttcagacccctggcagtctggaagcctagatgtcgtgaatcaagcctctggcaaggacagcgcagtgaccaaccctcttttcagaaggacaaagtggaatgaaagcacaagccatcaatagcatggtcatctccctggagatgtgcagatacccttcaccttcaagcaggctaaaccggccgagagtggctctgaggacctgcaggtgctgcccacatgtgccctgggctggtcctccctcagctccctctcctgtcttcacctccctgggccatgtctctcaccttttgtggtaattcttcacttctctccacactaattacccctttccatctcacattcctccagctggttcagcacttccgatggctccagtcctaagcacccctcacagtaggcatcaaccaagaacatatcacactcacctacaaaacaagcaacccaccatgagctgtgagatggaaataactcatcttatctattcatctggaatacgatcctgatgaacaggagaagggagaagaacttcaccttccttcaagaggccatgctgggtagcaatggggctcctgcccctgctgttcatcatgtttctggggtctttgtttcaaatgtgaggcacaacagagcatcctgctgtatcagcctaattaccagcctctccttccattcctgctggcatggcaggtgaagtatagcgaagaggaacttggcgtgataatggaacctagtgatgaaatttcttggccactactggccattcatgatcataattaccaatgacgctttatcgtgatgacagaggagggcatgcagagtggtgacacctggggtgcacccatcagtctaagtagtcaagagaggaaatgccttaaggaaccacgagatcccttgaagagactcagctgagcacacgtagttaccagaagtggctgttaggcaagtgaaatgtagaatgttcctctgaccttaactacccaaagattagaacgctgctgttctgtaacacctggagctgaggctggacagttgagcacacatcatccatctttcagtgtcctttctccatgagatagttagggtcaatagtgattgcaggtgacacaaggttttccaaatatggttggggaaggcagtcactcctcaaaatccatttcatttctcttccatagtggcagtattatttagggaaatgagcagctcactggatgagtccattgttctcagggctatttaacctcctcatcactattcagttcagaatggggctagtgaccttttttagactaatgaaatgcaagggaggattgctgaagggtgtctgaccaattatctcactcttaagagagaggatggaaagccacacagtttctccgactgactgtaaacgcagagtgtcttgcccagcttgcagctggcagctatctgatggccatgaaggaggctggcctgggaaaaacgcagtccatgaagaggaaggagctaagacaaagacagaaaaagagacccattgccttcatcaagcggtacctaactctgaccttctggttatgctagtcaacaaaattgcttattgctttagtcaattggagtcagtttctcttatcagaagcccaaagaatgccttccataagaaaaagtgcctcctctcaagtctgcttggaaagagactaccatataagagctgagtgaagaagctttgaagaggcctggcagagtagagtgcaggtggagtctggggaccgcatagcagaggaggggtctgtgtggctgacacctcatcagtgtgcttcagaggaagctcattgctaggcagcacatctgtccatactcatgaacaataggtcaccctttccacctcaaggacaacaagtcagcagcattacggtagactatattttgtttccaactatttgcaggtcagcatcgactcttgcttggctttgtgactttctttggccaatggaatatgagtgaatgtgatgccacatgtgagcaggtgtttgaatgcaagcgtctgatttggcttggccaattcctgccctctgtcatgaggaaggaatgtctcggataggtgctatgcctgtggccagggccctaaaaggaaagggcacgtggagtagggccacagctgacccacagcccacttgtgacatgaaagagggagaaacaaacatttcctgggctaggttactgggattctaacatagaagtatatacaaagcaatactctattcccaggactctatgaagtgatttggaagataaagaatgatgagacatggtttccattctcagagaatttataaacacagcaagcaccagaaagaattacagagagtgcagaatcctggaataccttgcccatacagattgtgaggacactagagttcagaggaaaggaatatactggctgggatggcctacaagaatgggagaatgggtgagtgacagatgacattggatagagttaacagcagacaggtgtcacagcctgagctgaagatttgcagctcaccttgtcagctgatctcatgaaaggagggacattgagaatgcctgggtagcatacgccactttttcttctgtctgccggaggcaaagatgctgagactttcactttcatgtttgaatgaaaatatcttagtgtacaaattatcactttacaattaattatgcagagcaagtaacacacatgagacctcaatattatgacagcttggaaatttactgttttcgaacttaacatgcaacaagtcttgccaaatgtacgttgaaaagtagcacaagattagacaattaacattttaatgttgtatattcacagcacatctgtgggtcagtgtaaacaccacaaacaacttggcagatgatgtcaagtggacacccccctaagactctgaccttaaaaaccaacgctctttaattaggcctttccttccccttctggctttgggagaagagactgttatgaaaaaagacatgattacaccatattggagttcaccaggcatctcaaatactttgggtttgataaaaaacagcagatttcattgctggaatcttcccttcagaatctgtaagcaccatgtggatatcaaggggaatttcatcagtatgtttctgattcctttacacttacatcattaaaagatttttgagggtttttgaagtccaataactctcctgagccattcttcccccactcccagcatatttttcatttcttttcattaaaattaggaaattgaatttcagctctgtattttttttttaaagctcgctgcttgtaaataatggtggctaaggattaaatccccaattctaaacattcgtcctgagatccatcaagctgatgaagatttgtgtatcctcatcgggcccagatctcagacaggagagacgtggtcaactgtgatttgagagatgaattcaggcatcataggcttcctttgcctctctgtagaatccagttttgtccaagcgagacagtatcattgactcacatgaagagtggaactgtagtgttggaagctgaatgagcactaaagtaccactcatctaactctcctgccctcatcaggccaaggctcagctttgtattttcaaaatctctttgtaagttctctcctggtagctgataactgttttagtcacattgtagtcaacccattctttgttatttctgacataaagtgatcttacctttaggtaagagcatttcacattctcttattctcttaacagatctgaacctagtcttgaaatgggtcacataaccatttgcaaatgtaaaaaaaattcttcacaaaggttccagtctgtatataggcttcatgacagcagggcctcatctgctctcttcgtgcaacctcccccagccacagaacagtctccagcacatagtagatgatgcataatatttgttgaatgaaggagtgaataaaattctaatcatatgtaaaacatatacagcctttcacagtgcttccacacctagtgattaatagcgttctaatgataccctgaatgagtagcaaaggtagggtgatccttagattatttataaagcagatgagcccagatatggaataacttaagatcttatggctggtcagtggtaaaactggagtaggtttcagatcacctgagtctcagaatgtgctgttttcatatagaccagtgcttctgaaggttgagttaggcatatatcagagtcacccaaaggatttattaaaacacaaattgctgagccccatcctcaaagtgtcacttctgtaggccaagggtgggccgccagaatctgcatttttaacacgtacccaggtgatgtcagtactgccggccctgggaccacactgtgaggacaactcagaaaggccatagtttacgaactgcaaaatgaaggaatatgagggagagagaaagacacttcttaacatcctccgagactatgtttagggtatcaaactcaactgatcggtacagaaagccaggctgtgtgatttaactgcagaagtctttgctatcccttaaaaagcaaacaaacaaaaaacctgctaatgtagatcacgggacaggaagttccaacctggggatattctaacttagaatgaaggttagctggagtctttctaagtatgaatttaggtttcgaaaagagattttggagctggataaagcattagttacatggtccaaacttctcacatatgcacctgcagaaagaaaggggttagaagggtgatgtgcctagtccagtgtcccagactctcttcatgcctgattcttcagctgtaaggcataatcaaaaggggacaggatgtcccccagcttggttctcctacgactgtttctgcggggacagttggtcaccctatacatgtaaattcttttaacttgtacaccaatgttcattgcagcagtattcataataaccaaaaagtagaagtcacccacgtgtctaacagatgaatgcaaacacaaaatatgatatagtcacacaatggaatatcattcagccataaaaaggaataacattctgatacacagtatgttaaagattcaccttgaaaatattatgctaaatcaaatgaaccagacacagaaggatatatattgtacgattccacttatatgaagtattcagaataggcaaattcataaaaataaaaaatagattaaaggttatcaggactgagacggaaggaagtgggagttattgcttaatgggtacagaatttctgtttacagtgatgaaaaagttctggaaataaatagtggtgatggttgcacaacattgtcaatatagttaatgccactaaaccgtatacttaaaagtggttaaaatgtcaaatttcatgttgtatatattttaccacaataaaaaaattaaaaaaaaacaaggaaaaacctgcaaacaacaaaaatctttccaaaccacgtagcacctccacacctatcctgcctctcttagagcactgctcagttgtaggctgtgtggggagtgagtaatgatcacctggtgcaatctggtttctagtatgagttgcttccactcatactagaaaccatatatgtataccacatactagaaaccatatactagaaaccactcacactagaaaccaatagtgaggtggttgccactatttccattggcaaccaatacttttctgccactccactcattgtctaaccttaggcatggactttagaattgaggtggcgtttctgaagaacgagatggtaaaaacagtggcatttctgttccctcctccaccccagttgcacgctttggtaattgttgaactcgatttcacttggtgtgtgatgacacatcttacagtgatggagcagaatttagatgctgtgactcatctctccaagctgggtttccataagactccacactgatctctggcatgtttactgctgcctgggaaactggttttgtgcattctcagaaatacgagattggcccataatgatatgcatgcctctcagagggaagacagagactcacggtatggcagttgaaggacacacgacttgagggagatggatgttactgaggcaaaagaaatgttcattgcctactcgctcatcatggtgcttccctcccatgtgtgtgtccatttgggcctcagcaacatccccagatgctgggcagatccagtgaattgcaagtaagcaaataaacatgatttaatagtagatgagaagactttgccacaccatggtacctccccctgcatttattttggcaatttggtgccgaatatttacgacagtgctttagaccatccaggtagttttagcgtaaggagtgaagtctttgtaaactaagctgcttgttcctctgacagggtgataagcaagcttgtggtggagggcagttaccggattttaattaactagctgaattattacgtttttgcataaacattcttcaccatcatccactcatgacataggttaggtacatttacacagagaactaaaatgatacattctctgcctcctaggagtttataatctaagaaagggattgcaaatacatagaaaggctattccattcttcatctctgtgacatggcagacattactaatcaaggatagttccccttttcaaaatcttttcctgcattggatgccaggcagccattgtaatcaattgcagggtgtgcaaggccttcctgatgtctgcatgttataaagaatggggagctagctgccaagacattcctatgacaccagatggggaatgtattgttacatgtattttaacaatgtaacaatattgcatagacccaaggaaatatgattttataacgtcatatgttataacatcatatgttataagatatgtattgttacatcatattatattattatttgtattatatatatgtatatatgtattattatgtgtattaatactatattatatataatatgatgtattgctacagacccaaggagatatgattttttaacatcaacttaggttttcatacctttcaagtgataaatacatgcataatttgtagaattaaggcatagtgcttttgtgggtttcgataagcctgacttctcagtgtggatgctcccatgttgtggatgagattgagcgctgtggtaggtgcagccatcactaatgtctttgcccctaagacaggagcaagctgggccccttggttaaacactgattacagccacatactctcctcacttcctcctttctgtagttccagttgagtaattaaaatcacttctgttaaagtagcatggttggctcaacaagccaagggcaagtttacggatctggaggatggaaactactttaaaccttggtagttctggctgcagtgaggaataacaattagaataattgataaccaggtccttgatgtccagtcaccacccaaggcctgcaacacatcagagacaagcctgattctctggctggagtagataacagagctggggttgggctattctggttgcttaagctgcagtggccaaggacatgcttcactttggtgacaccagttgtgcagaagctcttgaactcacacagttgaggtctttgtggtctgggagagaaaccctttccctgatatgtgcacagtaagcatggggctaaataggtgtgcatgactttcagattacatgcaaagaagttttagaggttaagagttccaaagaggacagacaggatttgctggagcaggcctggggtaatacagaatattccagtaacaatagtgtaactgcactactacagtattaagagtaacaatattgttactaaacaataggaggatactactaagcagtaacaatgctactgctaattgtgtgccatttattgaacaatgactacatacctgatatgatgctaaatgtgtttataatgatagcatttaattttatcatttaactatatcatgtaatcttcatatcaaccccatgacgtacttgtcacttgtcattcttcttattgtacagatgaaagttttcaaagatgaagtaattttcccaaagtcaaacagacagggagtggcttggttaagaatctgcccccaaaactcatgctgctcacttccatatattattgctcttgcacaatctgatatgctctcccatggctgactccataaatgcctcttttgtctatatcaccataagatgcatctttagatcccaagaaatctatcgattagacaaagataaatgctcagcaccataatcatgctatcaaatcattgaaccgatgaacgaaaggtggagttaaatctccctcaatgtgaagatccccactgcactgtggaatttagtccatttgatctggatttgggattccagttaaagaaatcttcatgtgaagagatactactgctgctcactgtttcttgccaggtggtgtcagtgctctgtttgcctaaaggataaattcagacatttgattttctgcccatagcatcctatttttcctgatcttacttggctattcctcaggatatgttttaagacagatatgttctttgatctcattttaaacttcctctttggtctctctactttctccctgtcttacagacccctgggcaatcacttttttccccaaccagctcagactccatggtccatcacttcaaccttgtagttacatcctcgtcctaacatcgtaccttcctagaaaaccccgcgcctaggtcactttacaattggccttctctgcctgattccaggatgctgagagctgctagacaaaattacctcaacactcagattggcccccgtgatggttaatgttaggtgtcaacttgactgaattatgcgatacccagatagctggtagagcattatttctgggtgtgtctgtgtgagtgtttcaggaagagactggcacttgcatctctctcgccccctgtgggcacagaccatcaaatcagctaaaggcctggatagaaccacaaggcaggggaagggcacattctctctccctctcccctggaggtggggcacccttcttctcctgcccttggatgtcagcactctaggttctccaacctatagactctgggactcgcaccaggggctcccccagatctcaggccttcagagagttacaccattggcttccctggttctgatgaccttgggcatggactgagccacattgccggctatcctgggtctccaccttgcagaaggtttatcatgggacttctcagcctccataattgtgtgagccaattcacctgataaattccctcatcctgtcttgtatctatctatctatctatctatctatctatctatctatctatctatctatctatcttcctatctatctacctatctgtccatccatcttcctgtgttcctatctattatctatctgtaatctatctatctgtctgtctgtctttctttttctttctatctatatctatcaatctatctatatctgtcttctatctatctatctatctatctatctatctatctatctatcttcctatctatccatccatcttcctgtgttcctatctatctattatctatctgtaatctatctatctgtctgtctttctttctttttctttctatctatatctatcaatctatctatatctgtcttctatctatctatctatctatctatctatctatctatctatctatcttcctatctatccatccacctatcttcctgccttcctatctattatctatctatcatctatctttctgtcatcctatctatctatctatcatctatctccctatctatctatctatcttcctatctatctatccatccgccttcctgtcttcctatcatctgtatatctatatctatctatctatctatctatctatctatctatctatctatcatctatcttcctatctatcttcctatctatctatcttcctatctatctatccatccatcttcctgtcttcctatcatctatctatatctatctatcgatctatctatctgtctgtctatctatctatctatctatctatctatctatctatctatctatctatctatctctatcatcttttggttctgttcctccagtgagccctggctaaccctaacctgcttgtcatgtatgatctccctcctcaactggcccctccatgctgcctccagtccctgtgtgcctctgtggtcagatcatccattctccatgaaggctgaatcaaaccttctccactttataaactttactactgcatctcctcacccctactctcagtagaaggcctcttcctgcttcttaaacgaaacagaagccgacagataagtatttcctccatgtccatctccaaactcatcatcgtgtgcctgatctgtgcccacccttccactttccctgcccttacatgagaagcatgtaacgttccctcccatacaaggtgaatccctccatcctccactggctctgcagacccctttccctcccacttctagggaccttgttctgtcaagtttaccatctccccttcttctcagtagggaaagtctctaaattatgtgcaagtctctcccaccctaaaaacaaataaaaagcagcaggagcagcagcaacaacaacaacaacaacaacaacaacaacctcccttcactccactttcctctgcagcaactgccctattttctcttattcaataccaagccccttgaaagagttccttgcatttcccggactcatttcttacccactcttcccacaatccgcagtgttctggcacccatgtctaccctcttcccagatggttcttgccgaggttgcgaagggcctcatgactctgagtccctgtgaccaccaggcagtctttgcatccctcgagtcggtgcccttgcaccaagcattcgtgccctggctcccatggcagcatgccctcctggttttcctcctccttctctggatgtttctgctcagcttgccttgtggatcttcttcttcttcttctccttctccttctccttctccttcttctcttcttcttcttcttcttcttcttcttcttcttcttcttcttcttctcttcttcttctcttcttcttcttcttcttcttcttcttcttcttcttcttcttcttcttcttcttcttcttcttcttcttcttcttcttctccttctccttctccttctccttctccttcttccttctccttctccttcttccttcttcttcttccttctccttctccttcttccttctccttctccttctccttcttccttcttcttcttcctcttctttcttcttcttcttccttcttcttcttcctcttcctcttcttctccttcttttttttttttttttgagacagagtctcgcactatcgcccaggctggagtgcagtggtatgatctcagctcactgcaatctccacctccagggttcaagtgattctcctgcctcagcctccctagcagctgggattacaggcacctgccaccacgctcagctaattttttgtattttagtagagatggggtttcaccatgttgcccaggctggcctcgaactcttgagctcaggcaatccacccacctcggcctcccaaagtgctaggattacaggcatgagccaccgcacctggcctgcctacttcttacgtgatggtctatcttgagagttctgcccagatcctttttataaccatagaacaggtttctctactgagctccagccctatgtacccgaatatttactggacatctctacttagaggcttcataagtaattccagctcaaatgtgtccaaagtgaaattcattggctttccccccaaaccttcttttcttcacatgatcctgatgtggctcacccgcttgtttaagccagaggctagagcatcatccaaggcttccccatttcccttagcccctatgaccagtcactaacttttaaaaatcttacttctaaatattgttcatctctctattcccagtactcgtcatagcgccttgtagacacttgataagcagtggtcttatggctggtagcccaggcagctcttgatcctgtcccctgggttccttccccctttccctggctcaggccaccatcacctttgacctgaatgcatccacgcaactggttttcccaccttcagttttcccttctagctcgctcactctccacaccacagagagtaatctttcaaagcacaaatgaggtctgtctcattctcttgcttacacccttcagaaagctgtctcccagcacctagcataacaccaggtccttataagtactcaaaaaatatgtgttcaatgaaaaaataattgggatctaaaataaagaggatttccaggcacacgggaagtctaacacccattaatcctgtgccattattgtacttgcccgtttgcaacaaggaacatctttggcttcacacacccgacccacagactgcgcttcagctgctgctgactccctcccagaaggccccagagtagtcttgatttaaaggcagggctgttgggggatttggaagaagtgttaaagaaaaaggagcagctttgctctattaaaacccctgcctttccaagcaaatatggctgctcctgagctcaccctggcttctgccattgcttggccaaggtgattaactggatgcctgctgtgtgctcatccctgccccatcaacaccctcacctcaaccctcctggttagcctctctgatgttgagaatgaaagttgttattagcatgattcactctccaacagcatgaatattcggtgtgactgtggctctgtgtatgtgtgtgtgtgtacatgcttatgtgtgtgtgtgtgtgttgcagtggaggaggttgggataaaattgaaaaaaaaaaaaaacagtcctaggagttatgcccttagggcaaagggaaaaggggtgctcacacacttgtcctagagagagatgtacacttttgcacagcttcctcctcaccataaaaaggtcgggggggggggggggctgttggtcacaggattgtgcaaagccctgcaagggtttggctggtgcacctgctctgctatgtctccacctgccacacaccattgcaaccccctggtaacagaaaggttcccttcccttccccaggctgttggtgccgtgggatctaacatgcatgtgtcctgacaggatgagagagcaggcacacgcatgaggcagcctggtggcagaaggccctgctcttttccaggatgcctgtggtggcggggggagcatggcaatgaagaagggatgggacagtgatcaggaaagcttcatggctgtcctatgatgacataggcctggagacacagaggctgcctgaggccagcttgggggatttacgaactaaatggaagaggctgtcaggttcgagctgagctcagtatgagggctgagcaggagagcagatgtcagggactgggagtttggccagccctgccctctcctccttggcagtatgtcttcctgttgtcaatggccaccagccgtccagcttcattctccactgggtctatgactgccagcatcccggagccacttccagggactgggttaaggtgagaacgttgtggtcacctctgctgcctactcccaccctccctgctcctgcacttctctctggccacaggtgccaggcagcatggctgcactgcaacagcctccctaccagcccaggtaccggccttctccatcctctcctgccaccgcatgtccccaggcactccttcctcctctatctgtgacagtcagagaacagggctttctgccaggttgacatcaacagcaaacagacacccccggatctgagacatctgtgtcctatccagaaacatacctcatcctatgtactgcagtgactcagtcatgggcagagacacctggctgtcttcccatgatgttcttatatgactctaaccaccacgcccctctgcctcgaaccccttacccacacaatcactttgggcctcagcccatcgctccaggagtggaggagatgattggtaagaagaacgctggaggtgcacactgcctggcaacaaaggacaggtgggtggcagacgaaaacttggggcctggcacacctgggtttgaactctggatagaccatctacttgatgtgtgacctctgtgcagcgattcagttccttcttctgtaagatgggaaaagaggatctagccagtgggttgtgagaacgaaagttaacattaagcattcctaacacagtaccccacattgccactgactgtagttatgctcatttgaatatttccctgtcatatggtaatgagcagctctctttggagccacgcaccttcctccctgggctctgccaaggtaggtcacggctctgagagactgcaggaaggcttctcagaggagctggtactatgaggggtgactcggctgggcttctgtctctacacacgtcccttgcctttgcagaagcctctcaccagcacccttcctgccccggtgacttgctgccagagctctgcctggaagtgtgatggaagccacctggcatgagcttgaaaggaactgcaaatctcctatgagcatttcccccctgctctgtggttgggatgcagtgcacggccaagcagcatggaaacctctgacgttgggtggcttctgaatactaaagagggcgcggaaaaaatgaaagcaaaggagaaagatgtcttggtcagaagtttttctaatcgctatggatttttcccccattttagtggatttgagagagggtataggaaaaggaagagaaaaaaatcaaaagcagattattaccccgagctgctcttcctttttatcctgagccatgacagcagctctctgcctgccctgtctgcatgctaacagctaaggcatgatgcaggcaaaatattggcaatcgagctgagattataggttacttggatattgaaaggcagaatcaattaaaataaagctttccagtcactggccaaattagcctctggaatcaaagcctttcttttcattgtccagaaggttctaaggacagctgagatggggttacccaaatgactgaaatgaaaagctcccaactgcagcacacgacacctggggagtaagcacacacacacacacgcacgcacgcacatgcatacatgcacacacatacatgcacacaacacactatgcacttgatacacagtggttactcaatgaatatttgttgagtttatgattttgtgtgtgtacacactcatacttatgtgtcttacccagttatatatacaccattctataattatttcaactttgcaatgctaggagttaactctgccaggcttctgtgagtttgtactaggcttacatttttctttctctctttattataacaagaatacattattttaataaatacaaaaaggaaaggtctcctttgaccactctgcctttggtctacttttacagaaaatgcggacattatggaaaactttatagaaatgtggctttttactaagccatctaacaatagaatagaaaagcaacgaagatttccagtgcttcttccctcctccctctgtcttccacctcctgaatcttcagcagcatgcacagaaaaaccaagcataggaatgtgctttgatatccacccggggctttcccacattctcaaaatctcaagagtagctcttcttagaaggtgtggccttggaatgtggagaggcagcaccatccagacaaggctgtccaggcaggaggtcctgcacatccaccttgcaattcacttaggctttgccactttggggatctacagttttaaatagcttatgatgaaagctcataactttttcatttataagtggagaatttcaatgaggaaacaaataaaaaaaccaatatttgttgagtgctcctgtgcttctccaggctggatgaaggctccaagatggcgtctcacaaggagttcagaatctaatgtgctcaaatcacacaagtcattgccataagtgctaccgtcaatgtatttttaaaaagagcccagaaaagagagattcactctgcataggagcttcactggccttgaggatgtgcaggagtttgctaggtagagaagagatgggatagatcccaccagtgggaagatcaggaacaaagctcagatatctggatgtgcacccagtgtttagggaatggtggatgtggggctagagcagaggtggggaagaaatgaggtggaaaagttgactggggccagatgtccttgggccttgaaatccttcctacttcatcctttaggcaatgggcagcgattcccggacataggtccagaggctgggattgccctgatcagggctggttttggaaagacagctctgaaattagtgtagggaatgaacttgagaaaagaggccctgcaggcggacactgtcatgagctggaggctgaagcctgggaccccgacgtggtggcgaaaatcagggaaaaggcaggactggggctatttcagaagtgttagccatgcttgggggagagcaaggtctcagttaatgcaaaagaccctcaccagcatgactgggtggaaaaggatgttttaatggacataaggaacacagcagatgtagagttttattttttttctttttaaagttggtttgttttgttgattggtttggaggcagaagaggtcacgaaggagagggaagaattaagttaagtttgtggcgcttatgagctatgtggatggtggtatctagtttatttctctgagcttaggtaaaaggttaaggccaaactatgggcttgggagccatgagcaaacccatgattggtcaaactatgagaatgaatggatgaaataaatcaacatggacagaaagagagagtaaaagaaaagagagagaaaaatcagagatagaaagacagaggtcaagttcagatgtacataccccttaggagcttttcaaggacgtcggcagggagctgggtttacagagtggagaggacacatctgccaactgtgactgagcgtggtcagagggaggagaaaaggcacaagagagcaaaacatcttgcaagctaatggagaatagaattttaaggaggacagagaggtcaaagtccccaggaagtcaagtgacaagatgtggtcatagtgtagggatgagtcccagagcctcctcccaggtccaaaatgtagctaatgatccgaatgaaatccagacagggagtcaagacagggaaggtacaggcttgtgggtgctgagggtgtggacaggaagagaggcaggagactcagagtgaaggggagaggccttttgtgtacagaaagaaggaggtcagttccacaaatgctgccgtctggaatgcagaattttctgacttgcctaaaaagatcgaaacaaaacctaagaagcagaaaacaaataaaaataagacaccaaataccaaaagccaaataagaccacgtaaaagcaaacagagcctcctcaagccagagaggcccctgacccagttttgcagcagcaagacccagagttccatccaggaagcaggctgcggcagtgagtcgcccaggcctagaaaccaaaaatccagcctgcctggagtcctcttgggtatgaaagttcctggagaatctattcatggcttccaatttccattcatcaggctgcacatttgcctaagagcgattccacgctaaacataactcagcccagaaaaatgctcctctgcgctctctttccactgctgaatttcagcttggcttaagtaacaccatgtgacataacacaaagaggtgaaatgagagctcataattgcatcagagggctgtgggggagccacccccccccccccacctcaccgattcccaagtacacttgagggaggaggaaggaggggtgtgtaatttgttcatttcttatattttatggaacacttcactttgctttcagcataattatttgttgtacattttgctgattcccatttgtgtgcttaaaaaaaaaaaactcttcactcccccctgcacacttttcttaatgcattaaaattaataactcgtaacagtgacctaatttgctttgagtactgtaactcagggttgttgtatgcgtgtgtattttttttctttccagatctgctaaacccttgacatgttactgtggtaacaggagcaacttgggaagttcatgaatgaacctcattgtgttctcccaagaaagccctctctcccaccattctttgcgatgtttggagctcacccttgcctgttgtgcctatattcaaagcattggaattgggctgctccaggctgtctccaaatccatgctcaatccccatcatctcactgccctactgcggaggtagctgccagtctgcccttaactttcctaaatgctccagggctctgcatcaggagggttctccttctctaagaaaatatactttcttggtttaaatcttctgcccttccctgccatgtctgtctgggccctcagctaaggaagcctgctgaagataggaagtaggtcactggattgcttcatcccctgactaccacctcaatccaagccaccagcttcttccctaattgtctcactgcattctatctgctcccccaaccccctccatatccagtgcagttagaggggtcttactaaatcaggtatctggttgtgttactgtcctgctcagtgatcccaggattgtgtccctacccctgcacacagctgaccaggctcttcagagtctgcagacatagagctgtacttgccccaaggtccattgcctcctctgtacatgttcctcctagctatcctgaacgacctggatttgccaggctatggcacagtcatttttctgcatgctttcacattcggttccctctgccagaattcccctatccatctcccactctcacacaggacgagtgtagacagcaccttctctcagaaagctttgggcagttggataccctacctgtgagttcccacaggcctctatgctcatctcagcatggaacttatgtgcactacctgtgtttgtctgctggtcttgctggcttccccagtaagctctttgagggaaagtcctgtttcttggacactgttgtttcttggacactgttgttatctccagaacctatcgcagtgtctggcacataggatgtactgaaatcaagattgaatgaatgaatgaatggatagactggaatctattacctgcctttcctccctccctccatacattccttctttccttccttcctccctaccccaccctactttcctgtcaatcactccacaagcattcactgctggttatgtgaaagggaaggaggatataaagacggattttattgtcttccaggaacccatagcattgtggcatccagactttgagacaatcttaaatacgttcttctgaaggctcccttaagtaagccctcttggctagtcattctagagaatgaagctgttttatgtccaaatctactttctagtagcaagtataagaatgaggattccaagtcctagttgtctaaataatttaaatatggaatagtggcagatacccatattcattcttccttacagcattctggggaagattatcaccagtttacagacagtagcaatgaggccagaaaggtggactcaatccccttatggcaaagagaaaagatggtgacaaatgatgctagtaactgagggctgccagcacccagggagccccaggacacgtgttgccttctcaccccaataggagtagatggacgaggcatactcgtaccaaggagggcataaggattttatttccacagctacctggagaagaaaattcatcatcaccctcagcagacagcaagaaaagaagagaaagaataagaatgtatcaaggaggcttggtattgattttgaaatcctggctgacaagacaatgatttgagtccatttccattttgtggctgaagcctggtgcattctttgcctctgcctgacctcccagagcagagttcatcaagaatcccctctgctgacactcctatcctgattctcaaacagcctctcgcctgtttgtctccgacaagaaaggacatgcacgtgaaaggagcagtgtggcttcctgtgtctcctctggaagaggagggccctatttcaaggctgatttcaaatagtacattttaaaagtctgcttagcctcacacacatatgagcatcaacattagtgtctttacggaggttttcggcccgcacagaaagggcaaagctcaatgcattcaacccaacaagcagcaggttcccgtcttggacaccgaaagtggggggtcctatttcaagactgatttcaaatagcacattttgaaattctgcttaacctcacacagatatgaccatcaacattagtatcgttatgaaggttttcggcccatacagaaagggcaagtctcaatgcattgaacccaataagcagcaggtccctgtcttggacggtccctgctacagccacccccagcaggctcttcaggccaggaaatgtgcttctgctgtgagtcccagctcttcgcatggccagaatcctaagtaagggcaaaaggcctatgtatttaatttacttgtaagtgaacagcttctatgtgttagaaaaaaataaactcaacctacaaaattgtaattgcttgagatttcacctcctggccacgtttctcttcctatggagttattaaaacccacacaatatgatctaataatttattaataatcaacataaatagataacagctcacatagccataatagccaatgcatgttaaataatgagggattatttaaaagacacttcgctggagagaaggagacatggtagttagaatctgcaattactgctgcagttgcagataagcatgtacacaaggccttcttggctgttcaactggctaccttgtgcccctgttactccatctgcatttggaaggggtggggtatcagccagtccctgcttaacagaaaaagacgtccaaattaattggaagggaacaaaccatttcttcacaggacaaaggaaaaatgctgtgcaattcaatttctctgaaaggagctcaacaatactccatctcctgtcccactatcaaagtccctatcatcaaacctgggcatgtctttctcatggcagtttctttatccttactccttgaaaaataagtgagtgagcctaagttcattgcagcctaatgagggactccctggtcccttctgtcattctagtccctatttgtaagcccttcctccttcaagtcatcacgttatctgccttaggggaacctcctttatactctttgcatgttttaaagaatttcaaattcaatatcagatgcttggcaactagattggaaggaaagcagaaggaaaactgtctttatttgtagattatttcatatgtaaaaaaatcccaaagaatctacaaaaaaatcactagaactaataaatgaagtcagcaagttcacaagatcaatacacaaaattaatttggtttctacacacaagaaatcatccaaaaatggaattaagatatcaattccatttacaatagcataaatagcattaaaataatcaaattctagaaaggagtttaacaaaagaagtgaaatacttgtacaattcccaccaaaaaggaaaaaaaaaaaccaaaaacatggagagaaattaaagaagttctaaataaatggagagacattccattttaatggttaaaaaatgttaagatgacaattcttcccaaatcatctttaggttaaacacaatttctattaaaatctcaacaggcttttttctcccctaaaattgacaatcaagttctaagatttacatggaaatgcaaaggatctggaaaagacaaaaaaaaaaaaaaatgcaaaagaacaaagttggagcatttaaatttcctggttttaaaacatactacaaagttacagtaatccacacagtgtggtgctgacaaaactatagacatatggacatatagatcaatgaagcagaattgagagcccagaattaagctcttatatttagggatttttttaaagaaggtatcaagataattcaatggaagaatagtcttttcaacaaatggttctgaaacaactagacattcacaggcaaaaatatgaacttagaccctggcctcataccacaagcacaaattaaccccaaattgatattgacataaatgtagaagctaaaactacaaaaattttaaaagaaaatatagtagaaaaccactgtgactttgggtttttctatacacaccaaaagcacaatccatagaataacatgaagaatgtgaacttcatcaaaattaaaaatttctgcatttgaaaagacaatattaggaaaatgaaaagaggagccacacactgagagaaaattccatgaatcatatacttgataaataacttgctgtagaacgtataggaaactcttaaaatataataataagtaagtaatgccattaaaaatggatgaaattcaagagtattaacagacagttcataatggaagaaaacatttgcaaaagtcatatctgacaaaggaatgatatccaaaatatacaaagaactcttaaaactcagcaataagaaaatggcaacttgattttaaaaatgagcaaaagacggccaggcgcggagactcatgcctgtaatcccagcactttgggaagccgaggcggacagatcacgaggtcaggacatcgaggctatcctggctaacgcggtgaaaccctgtgtctactaaaaatacaaaaaatagctgggcatggtggcgggtgcctgtagtcccagctactctggaggaatggcatgaacaccggagtcggagcttgcagtgagccggggtgacaccactgcactccagcttccagcttgggccatagagcaagactccgtcttaaaaaaaaaaaaaaaagagcaaaagacaccaccaaagatatacaagcatgtcaaatatgcatatgaaaaaatgcttgtcatgagagaatttcaaattaaaacaacaataagataccactacatacttattataatgaccaaaatccagaacacaggacaagagcaaatgctggcaaggatgtggagcaacaggccctctcattcactgctgctgggaaggcaaaatggcacagccacttggaagacagtgtggcagttaaaaaaaaaaaaaaaagaaaagaaacatactctcactatatgttccagcagttattctccttggtatttatccaaatgagttaaaaatgtaggtccacacaaaaacctgcacacagatgtttatagtattttcattcacggttgccaacacttggaagcaaccaagatgaccttcagcaggtgaatggaaaaataacctgtggtacatccagacaactggaatattatttggtgttaaaaagaactgagctattaagccataaaaggcatagaggaaactgaaatgcttattaccaagtgaaagaagccaatctgaaaaggctacacatactatatgattccaactagatgatattctggaaaagacaacattatagaaataatacaaagattagtggttgccagggtttgtggggaggaagagatgaaaagtagggcacagaggatttttagggcagtgaatctatcctctttgatactacgtggtagatgcaagtcattatacatgtgttcaaacccataacatgtactgcactaagagtgaatcttagtgttaattataaacttcgggtggtaatgatgtgtcaatggaggtccatcagttgtaacaaatgggccactctggctggtgtgagatatcaatactgggggaggctgtgcctttgtcaggagcagggtcatatatgggacctctgtactttctgttcaatctcttgtgagcctaaagctgctctaaaaattaaatctacattttcaaaaatgggcaaaaaatcttcaaaagacatttcaccaaagaagatatacaaatagctaataagcacataaaaaactgcttaacatcattaatcactggggaaatacaaattaaaaccacaatgagataccacttcatacccactagaatggctataataaaaaagacagaaataacagatgttggtaaggatgtaaataaactggaaccctcaatacattgctggtagaaatgttaaatgttacagccactttggaaaatagttcagtagtttcttaaaaacataaatttaccatatgatccagcaattccactcctagatgtctgcccaagagaaatgaaaacatatgtccacacaaagacatgtacacaagtgttcacggcagcattattcataacagcaacaaagtggaaaaaaatctaaatgtccatcgactggtaaaagaatatacaaaatgtggtctatccgtacaataaaatgctattcagcaaaaaaaaaaaaaaaagcaaatgcatattgaatgcatattgatgcatgctactacacggatgcacctcaaaaccatactaagtgaaagcaaccagatacaaaagaccacaaattgtaaaattccattgatacgaaatgtccagaaaagacaaatctctagcaatagagtatagaattgtagttgcccacagcagtgggtgggaatgcagatgatctgcaaatgggcatgagggatcacttgggagagatggaattgttctaaaactagattgtagtgatgtccgaacaactgtgtaaatttactaaaattcattcaattgcaaagttaaaacagtaaatgtgatggtatgtaaattatacctcaataaagctgttaaggaatagcagatgcttattaaggatgtcaggagggtacacgaatgcagagggcacacactaagaacactacctatgattaatttaacataaccccattactggtgaatgtgtctttcaggaatacctcctgctgttgttgtatttatctaggacatagcctcacacttacatcaagcagagacaattgaagccaccaagttcaatccaagcatcatctcactggcagaatgaaacaggataacctccagcttagccagaaagaggatatgacccgtcaactagtactgaaacaaccactgccttccaaatgcctcccatttatctcagtgtgggttaaaaggcctaagcaatatagttatcacttgccagttgactggcctctcctttgtacaagggcttggatagggataataacttacttttgtaaagcacttacaaagtgccttaacatacactagctcatctattcccatagcagctctatcagcagatgtggcaggcgctcttggttgacaggccccgtcattatcgcagctccagtcaaggacacgtgagcatacatttcctggaggagctttggagaaagcttttgccttactgatacaataagacagatactcggtctcttcctcttttccctcctctgtgcctgaaacaaggatgatgccataaaaaaacagcagttggccgggcgtggtggctcatgcctgtaatcccagcactttggaggccaaggcgggtggatcacgaggtcaggagatcaagaccatcctggctaacacagtgaaaccccatctctactaaaaatacaaaaaatcagccgggcgtggtggcaggtgcctgtagtcccagctgctcgggaggctgaggcaggagaatggtgtgaaccaaggaggcggagcttgcagtgagcaggaattgcaccactgcactccagcctgggcgacagagcgagactccgtcccacaaaacaaaaaaccaaaaaaaacccacagcagtcatgttggtactgccaggggagcagtgggtagaaagggccaagagaaccccaaagagtcacagagatgctgcttctgacatgggtaaactgctggaccaactctggcagcatctccctagaagccatgttaagagaaacaaatgaatccctacttgtttataccattgtggttgggttttctgtttgttgttgccaaacctatacctacctggcaaagtaggaattattagtcacacttcacagatgcaaaaagttgtaagtctttgaaaaactctgcaacccatcaaaccaacatcaaaatgccagcaacttgcactcagtttcctgaatttaataacagagttaataacagccacaaccacaaaagccacctattgggttccaagtggtgtcaaggctctaatgacactgggcacttgactggcatattttctctaattcttacaactctgcaggctgagtgttactatctctattttatggatgagcacagtaaggctaagaaaggtcaagtaaattgctcaagatcacataggtagtaagtggtagggccaccattctaaactggcatgtgtcttgcctgctatgaagaaagcttaaaggaataaaacatacttcctaggattaggcaaccagctactctaggtctccactgattaaaaacattatgtataggaaattagcagggatgattgctcgtgggagtcaggttagctagccaaactcataatatttgcttgtgtgttccaactgtcatactctaaactgtaacataaagaaagtttctagacacaattttcttttcactgtttacaaccacttttgtatcttatagaaataaaatagaaaaaacacacactgattacaagatgcacagtacctacgaaaatctctacaggatatgtgagatcagctttcttccagagagtgggtaacaattaaaacaccagtttttgtcagcaccaggcctaaggacagcagcctggaacccagaacaagtaggatgagacaggagtctctaggtagagggtaaagatcagcctaggtacctgccagggaaaaagcttcagtgtgagaaggaagctcctagctgagccccgccctgccaggcacacatagtacggacccgcagtgatgcctgttgttatcaatgtatggatagtattggtagtttctagtagacttgagctgctgtgggggtctgtgcatgttggattggacttagaggagggtggtaaaaaccagttcagagaaatttgtagatgttaattgcaaactgctttctcttcaccagaagcaatctctcccttctgagatgggcaacatcatctatctccatcaggcccaatgggctgctccaccttcgagcgcttaattagtttgtctttctggatgctctgtcctcccccatcaaagacaagtaattggttctcttaaacatggggcatccagaactgatggagaagtcttttcaagggatcatggaactctgtgctagggagaagacaggcctcagattctgtcaggtagggttctagatggtgctgctgagaggctaccttattttcacaagttccaatgctagcagggactctcctggccaccttaagtggcgtttccaggagaaaggctgctcctctggtaggctgcaagcatcacttcgatttgtgaggtaagacaaaaaggacaggtgaactaggaggatcacaccggtacctttgtgaggagcaagcatctccccttccttcagactgggttgtttagacccaaacttgcccttggtcctcccaaatgctgctatttccctctatatgattgagtcagcatttctactttatatgaaactgatattatagcaaatcttatcaccatgaatgtaatgaatcttcctgccaagttatcatcttgtgtctctcagaggtgtgtcttctttcccaaggtcactctgggcaacttgagtgagccacaggttcatacaggggccttgggacaatcattaggagaaacccagtacaaataaaaatctgattagactttacctcctctgacttttcaccacctcctctatcctactctaccaaccttcagactcttctagctacaggctttcccagagcccatctctggggataaaatggactcatttagctcattgaacagatcatcaaatgcccactcccccaagaaaagaagcagtttggaccacaggcaggtcagaatgccctagcacttccacaaacagcctgctctcaaaggattgtcaaacgtgcaacaaatcagtgttctctcatcaaaagcatcataactcatttaacattgagcctatatctttttaaatatatcctttttttctagattggaaaaacaatagttgtttcttttttcttttatttcagcagggttccagataataaaaagatttataattacgccagtagatttacttttgctatgccgccctagattatgaaaaagtataattatatgcaattaaaaaatgaacagtatttcttacccgagtgaagctttaaaagtcattatgaatccattagctcagcagaccttacaaacggccttcactactctggactgcatttaaatttacaacagagagaagtaacttttcctcatttccacggtgtgtgtgtgtgtctgtgggtgcatgcattttcacccttctcagccatacctggaagtggccattcatttttacattctaaggccatgttcttagtattgaacttgaccacacagctcataatgctttagaagcctccagctagaacactgaggaatgacctcagaattcttctacttagccttgtccctacctctttactcctctgtaggcagtaattcttttttcttttctttcttttttttttcttttggtgtaacagtatcgcatgagccaagactgtcatgaaactatttggatactgtactctggttccttcatctcctccatctgcatcagcctaaattgtcctagtgagttcacttatgtctgggttactgtagatttgggttttgctattactagttgtctcacttatccagataattacctagcttgattgaagcttagtctgttgactaccagaaaacaacacatacgggagaattgatctagataattcagacaccattcatgatgttatttcaattgagcattcttgtgtgacaagaactggtaattattgaaaatttcatctgcataaaaatactagatcttacccacaagtccatttcctcttgtctctcagtgttagactcaccctcagcatcatttttggcagtggcccagcagttatagtaaaaacaaacaaacaaaaaaccctccattgtcttttatttaactggccaaaattgccacctgatctctccagtctcactgtatttgtctgatgctgttagagccttctctgtagtggctgcaagtctgctaataatcagaatcacttgggaagcaattagaagtatacagagatgagtcctaacccagactcatgatcagaaattccagaagtggagctcaggaatctgcattttaaaatcactcaccaggtgattctcaggcagccagcctcgcatggtgcataaactgacgttgacattccggcagcctagacaatgggtatactcaggtgaataagagggatggtctcttctctggtcatttttctactcttacctcttcatcctttcttagtcttctgattcaagcctggatgaataaggattcctggaatagtacaaaatacttgcaactctcgcagtcttcccagagtgggctggatgaagggtgctatccccaaatcaggggccgtgccctgggaaggatggtaggcctccagggatctatctcagtgtaactaactcctcagtgggctcaaaactttccctcttgctttctagtttttaggttttctagttctgttgtgccctttattcaatgcaagccatcaacaagttccttaaacataaaactctgtgacactctaaactgcaagacaatgtgacaatgagtatgccagtctgaaaagaacaaaggagcagggttcagaagaactggcctttaccagctctgtcattttccagtggtgtggccttgcagaggtcacttcagttttccaggctttggccaaagaaaggtgggggcaggtggtaccttcccagctcaagtcttctggaatagagcgtacgcccatgaagccctgcacctgttggagcttcatagctgtaatcaaggtattaatctctctgagccttagtttactcattaataaaattggaataatagtattctcaaccatatagttgagtaagaattaagtgcctctaaaacccctagcatcacgcctggcacacggtaaacactgagtatctttaacatgatgtcatcatcatcatcatcatcatgaaaaacatactttctcatgttctaaagggcccaattcatactgcccactgtatcactctgacaaggtaacaaagtgacctcagaaacctggctaacaagagatcaaggcataaccctagccatggattcagggaacagaagctggcccttctgtggaagtcccggctgcccaggtccatgtcgtccctggctcttccagctggagggggtcactcaagcactgtggagtgacagccagacaggaaagcaactgcatttgtcctaggagtcatgtggcatgtgctggatggcgttttgaataacattttaatgaaccaagtccttcagtgtaatgcaacctcagaggtctgaacatgctggccttctcccctgcactctttgtgtggccactccaagagtagatgcgctcccttgaggcgctcccttgagccctggagcttgccgggggcagccaccccttccaggatttctgctttccatgcaatctcccttttccttctctctctgagaacctcaaaaccaagttgtttgtaaactcctctacagccccaaatggctctgttgcaaggctcggctcgttaacatgcaggcagtaaagtatgtcaggagctctgatttgtcatattaaggaggctatatgactgtggagaggaacattaaaagattttattctaagatattccctccaatccccacccactgcagacaaagtctcttgggacaagcctctgcttcagtgctcttgattgcacagatttctgataaatgttttcatcagtgccataggcctgggtgctgctcctgctccactggggccttctctttggggtctcaggattggcttttgaggtgtttctgggccttaagcagctcccatggtaaaacattcaccgtcattctttctctcttctcactcactcaattacagttaaagccctgttccagggaggagtggagggagactccatctccaccacggaacgccttactcctggaactaatcacagcatttctctaccctcctcggaacaatctgataccattatcactgacatcatcaaaagaagttccctttatagattgcattgtacaaatagaattgcctagatgtgatggctttgcccattaggagtgtacaagcatatttacacaacgccatggagcatgggtgaaggatgagcccaggacaagattaaatcagcagactgaacgataaatgaacagtaatgcattcatatcgaatacatctcagagcataagtgccatccggggtagaaggcagggaaagggcatgactgcagggtcaccagggccagaatgactgatgtgaggggtcaagggcaggctttgcctccagggaggcattaaagggccacctcctatagtgaaaggaaggctgccacatttccctatgccccctgagttttagagataccctatttgaatgagagaaaacaaagtgaggaaacggctaatctcaaggtttaggaggtgagggggacatagtatcattcggtttggtctaggtggagacttcttaatttagatattgatgcagttcgggacataccaaaatatgtcaccttggcatttgacaaaacagcagaggcaggaagtttgctctcaccttcccctcgcctttctcccctgaagcaggtggtaagattctcattccaggtgccctccctacccggaagaaaggaagatccttatctctgaagataccaggacacagagaggaatctgaataaatgggccttgctaggttccccagcttaccatcatcagattacaccctttggtcctcctattatatctctccaccactgtccattcctcatcaagtctaagcatagaaatgcacaggtttccctgtatctttgggtcttcattcccttaagaaggctcttgtgtcatgtaagacttatattccatacgtgtgtgtttttctctggttagtctgtcttttgttacaggagcctctgccatgaacccggggataagtgaggaaagaaatttttcctccttcacagtatcaagtgccaggccagggcactttgtccaggcctcactgtgaagaaagagtaatgttcaaggatggcagcaggaaggtgagaggatgaaaccaaatgctcttggagggcatcgggcttggttgccactgagaacttccagaagaggcacagctcaacgcggggtgccagtaaccgtcatgccttcctgtcccagtgggctgacttgagacaaagcacagctgtggtccacgccttgagacttccactgggcaaggaagcccaagtgaggctccccgcacctctgccaccttcccctacacccacacctgcaaacctggggagagtgacaccagccttccccagctcctctctcagtctaggctggagctgactcggagagaattgaattcccttctccattgctcctggggccgctaattcatagctgcattagctttcatttgggtaacagcatgggggattgtcagatattggctctgaccagatttaatctacaggctgtgttctgccctctttccacttgcctttcattcaggaccctaatgaagaggtttatctgattggtttactggagtcctatgtgggatgaatagcttcagcctttgcgcttgcacctctttgctgtccactccaatcaagaacgggggccctcgcaactctctcagttctgaaacaaattaaatctcagtgacagactctatctgcctcgagttctccattatgcttcgctttaggtttgctttggcaatgacaaaactgctttgacatatttgcggattctcaggcccgtgttctcagctcccccacctccacctttctgctgtccaatgtgatttttgtaatggcaaaaccattgcgatccttctcaggcatcccagtgtctatagcttttcagctacatatcagcaacattcagccacaagtgtggctctgacaggctgtggggggcagaggtgggagaatgccagagactggggagtggtttcctaagcctccttcctcaccctccttccagcagttcactcctttaaagagaaatcattctctcccgtgtctccgcaggtcactggaagaatgtggcctggggcccttcagtaccatttaaatctatgcttgcaatttagcaaatctttagatctgttcccccaggctgtggggaaacagatctcaggtttcccctgatgccttcaggggaagctgcaaaactaccttcaccctaatcacctgcctcattagactcacaacagacagatgttccctcctccttgagggcttctaacttaagcctttctcacctaagtttccttataatggcgggaaaagagaggaacagaatcccaggtaggccatcaatcatcctaacgttgacaacaataagcatgttgacggttataaagtctgcgttttccaagcttctgttagtatgctaagagttgccctgttggaattaataattgcaatgatattggtgttgtagtcatcacttgaggcctattaaggtcccttttagttctaaaatactgttcattcattgcctcattcatgcattcaccaaacactgagcatccaccatatatcagagcctttggtcagagttccctggatggaagtcctgtggtgactgctgctccatctgagccccttaaaatctcagagactgagctgggtgttttagaaattcaggtagtcacaaatcctgaccagaatggctgagatttctgagctggaacccagcaccctagaactaaggctcaagccccttgtgagaacaagaaccctaagcttagatgccagaattcaagtttcagtttttccccttaaaatgaccctaaatcccttaaaactgcaaaatgagtggtcatgccccagactgcggcctccagactctgctactagccagccactcttgtcatctggaagggaagatttggttgctacaacatgccaccatactgggagttgcaagacctggtttggtcctcatgcattggatcaccttactcaaaccaccttggcctcagcttcttcattaataaaatgctattagactttatttacacacagttgaaaaaggactaatacaaatgcccataaaatctacagactagactagatgttaagtaaggtgactttccactctaaaactctatacattatttgattcatttatttaacatatcttgagaacatgttttatgtcagttactatgataagagctcataaaatatgtcccaatatccataacaggaaggacattacttcataataagattaaatggctgcaaaaaattcaatgcttggatatcctaataacaggtgtaataataatcactactcttattaattttgtacttatcatatgtcaggcaacagagtgaatgttctacacaggttttgttgcaatttatcttcacgaaacaaccatataagtagatatcattgtacattgttcaaccactatttattgtgtaactagggtgtggtgggccttgaactaggcatttggtatcaccatacagagattgaatgtgcaggcattgagtggttaaataacttcctaggcacactgcttgcaaatggcagaaagaaccagaaatcttatccgctaggctctagaacccaagttcctaactgctaactttcatgcctacatcagcttggttttcatgatcctcaaaatgtcagtcaaagccagtgttttctgaatcaataactccctccctcacagtgtccttttccaacttagctcctctcgtttatgagccaaccatctccatggcagtccccttcactatgaaatagtcgtttgtattctccaggcttcactagttctcattttcaattgccacctgaacactgctactgctattttcttcttgtcttccactctttgctctctccttcacctctcctataactctgcaaaagatctgtgaattggctaagctgaaggactctaccataacctgattccagagaagcaaactgtgaacccttttgaaaacatttgctgcactactcagagcagacgtagtgaccaggaattcaagaccaactttcaatgaagctggaagtgtgcctgtcttggcggatttagaaactggacagccccttcctatcttgaaaccacatttgatttgacagcgtagctaaaaggaaaaggacgaatagtaactgagttgagttttatgtgcacacggaacatataaacacagcttcaagataaagaactttgagtcagattttcacatgtcatgtgtgagaccatgcagcaaacaatagagagatgggatgggatagctgttgcagactgagatgggattaaaaagggatcccatggcttttcacttagctaaaacaatctggaaatgttaacgtcataatgcacagcatcaccttagggagttctccaaaacaatggctggctgttcagactaatcagacattggtataatctttgacctcagtctaaataggtagctctcagaatctgtgtggctgttcatgctgtcaggggccatgatgctggaatgggaggtgaactggaactgtgaagctacttgataaaacatggtgttgggctccttaggcgttaactcagatatcccaattgctgcttggctaccccaaaactccaacgcacctcattatttcataagagatgttaaatacaaattgttcattaaaatacatattattggatgttaaactaccgtgtaattgattttctatccattgcctagtggttaaccctcaataaatgctttttgtaatcaacttaaagtataatacctaccacgcttgatgtctttctcctttgatttaataagaaaccaattctatattattgaaattgtacttgataatgaaaaagttggtcaaatttcaagaatagcataaaaaaaaaacctctttggcctgaacctgtccaactttatagagggatctcagtacaacggagaactcaggggaacctaggtcctgttccaaccatggggtattagctaaggtccaagagagtcaagtgctatgctcagagctaagagaacagcggggtagactagaaatactatgcagggactcttgttcatagtgcaatgcccaaagaactagcatagttcttccccagggttatgagatcaagaaaactatgagggattttaggcttcccaaaaagcataaaaagcagttaagcatttaaaagatctatgggactcagtttccttattcagagcttgaccagtgctcttttttgctttcttcaaaatctggctaggatttccacctcctcagggagtctgccttgactggatggaaatacaaggtgactgacgccatccatagggtaaacaaagtggtacaatggttagttcaactccagcaaggcagacagctggatatggggaggagttcagaagccagggaaagagatgtgagctcaccctcaaagcttctgaagtgtccacataatccccaaccctacagcctccaaaacataatcccatatacatataccatataacatgctgggctaggagaagaatgcctgaaagaaaacatgcactgctccaggaaaagcaccaggcacagagcaagtgtttaaaatgttagccattcttggctttttatattaatgtttattattctacaacatgatttttaatttgcttaaataatctcctgactaatggacattgagaggaatattatacagttatttattcattcatatattgcctcagctttctaaatatgaatttgctgggtctacaggtatgatttctggtgagcttttaagacatggaactcacactcttactagaagtgctgtacagaagcagcgcatgagatcattgtggttgggtgatctcaccatgtggttaccatggcctaggaatctttgtgaggtggtgggtcttctgtcagggggaggtagaaagaagcagcagaatgactctttatcagaactgctctaaagggactttatgtgattagtaggctttggaccctcgcatcctttccagttctgaaatgttctgattcataggcttctggaacacagagatgctcatgcacatgcccctccccatggagggacacaaagatgcatttccgcctggaagcacgacaggctgctaagctttttgcctggatgctctcacccttggagatcagaagctgagcatctctccattcagccatcaacaaaagggagagattgcctgagcagcatgctgttgttagacaaatcggaatcctcttctagaaaggcattctcttctgcatagtgagtgggaagcctgctgtatctaggacacgttcccaaaataaaattcagtggtcaccaactgactcagtgtaggagacttcattctccaagagagaagggctgctaagaatggcaggaaccacccacagatggtctgggtaccagttgcatcaacagatgcatacacaacacagccctttcctctaaagcatccagccaagctcacatcgagttctccactgtgtacattaaaaccaaaataaataatccaagaaaatctgcacgtctgtgtgtttagggttcaagatgaatcaggcaataggccaaaaaggaatgtaagacatttgaccactatttttttcttccttgttttttttaaatggaaacctaagcattagatcactttccacccttaaaatatgcaaggatggccaggcacagtggctcacgcctataatcccagcaatttgggaggccgaggcaggtggatcatgaagtcaggagatagagaacatcctggcccacatggtgaaactctatctctactaaaaatacaaaaatttagccaggcatggtggcgagcactcccagctactcaggaggctgaggcaggagaatcacttgaacctgggagacggagattgcagtgagcagagattgtgccactgcactccagcctggccacagagcaagactccatctgaaaacaaaaacaaaaacaaacaaacaaacaaacaaaaccaaaaaacatgcagggacacccaatgtctacaataccaaggctgacctctacgggcaggcggtaaagatctttcagaatctggccccatttacctaactcattacttatcttggaaatgttacagttcatctggtaacaatggtgtcccattgttcattcttatttttgacttcaggtccctactcatgcctagtgcattacaaaagacatttttcttctccatgtagaaagttacattctccttaatgtggatgccttcaccaactgctgctccctttcttctcccattgtacatcacacagatgaaggaggaggtggagagccacctgtctgcactcctagcctggggattctggaatgctagaacagcttcttaagagtcccatttgcatagagcaccaaagctcctcattagaaaactgatgaagaagattagactgaaaggtcctttgagggaacaaagattaatcctcccaaataaaggggagtttctaagaacaacccagttagagagattatttctgccccaagagggcaaagaacttactcagaggtaggacaaagatcaaagacatgtgttctgttaagaaaaaaaacagtttctggatgtggacagcagacagaaatgttcccaagttcttaacccaatcacatcttccaagcccctttgcaatgtatcgtcagataatcccaggctctggaggttaggatgtggatatcttttggggggccatcatctctctacctgccatgtgggataaggcacacatagtaataaggatagcttcagaaaagaggagcctgcaccttttgctttaagacaaaacagaagaaacagaaaaggcctatcaacctagagacctgagattgaaaagataggcgagtacatccgttgagatgctctgggtatttgataatggactctcatatttttacattttctctaactagaacatatgctttagaggggtagaaaccatgtcttacattttccagtttattgcctgcagcatctggctcactgaaggacacaccgtagatgctcagtaatgtctcactgatcagtgtgagaaggaggtatcaggaggagattatcgggggtatctgctgctggagatggttgtattctgcttaggaatgatacagaatagcagacaatcctgaataggaagaatttattgtgtcagggggacaccagggtataaggctgaggccccaatgagaaatgcatgcctacttcctccttctcttcatggaatgagtaattgaacttcaagtgtcaggcattaagcgaagacagctgtggcaatcattttgttaatatatgagatgctggagccaaggtaaccagaaagagaaccaagcctttgagtgacagaaacaaaggcaggagccaccagtcgctgggtccaactagtcctgcaaagaggcagatgaattggctaaatgctccctggaaaacctttccactttactgaaatctgtagtgatgaacttatttcaagaaaagaagcaattgaccaagggaaagggaaagaagaatggaaattatgctttaaaaaagatccatgatgagccagagttcaaaattacttaggagaaatagatgtgtattcatcatatagatctgtcttggaaaggacagaaaaaaagagaggagatagaggaaaaatgagggcttaagaataaatagagttttggctgggcacggtggcttacgcctctaatcccagcgctttgggaggccgaggccggtggatcacctgaggtcaggagttcgagagcagcctggcctacacagtgagaccctgtctctaccaaaaatacaaaaatcagctgggtgtggtggcacatgcctgtaatcccagctactaggaggctgaggcaggagaatctgttgaacctgggaggtggaggttgctgtgagctgagatcatgccactgcatgccagactgggcgaaagagcaagactgtcttgaaaaaaaaaaagaatattcatatccttcacacattttttgatggggttgtttttttctggtaaatttgtttaagttctttgtagattctagatattagccctttgtcagacgaatagattgcaaaaattttctcccattttttaggttgtctgttcactctgatgatggtttcttttgctatgcagaagctcttaactttaatttgtcagttttggcttttgttgccattgcttttggtgttttagtcatgaagtctttgcccatgcctatgtcctgaatggtattgcctaggttttcttctagggttttcatggtttgggtcttacatttaagtctttaatccatcttgagttaatttttgtatatggtgtaaggaagggatccaaaaccacgatgagataccatctcacgccagttagaatggtgatcatcaaaaagtcaggaaacaacagatgctggagaggatgtggagaaataggaatgcttttacactgttggtgggagtgtaaattagttcaaccattgtggaagacagtgtggcaattcctcaaggatttagaaccagaaataccatttgacccagcaatcccattactgggtatatacccaaaggattataaatcattctactatgaagacacatgcacatgtatgtttattgcagcactgttcacaataacaaagacttggaaccaatccaaatgcccatcagtgatagactgaataaagaaaatgtggcacatatacaccatggaattctatgcagccataaaaaagaatgagttcatgtcctttgcagggatatggatgaaactggaaaccatcattctcagcaaactaacacaggaacagaaaaccaaatatcacatgttctcactcataagtgggtgtcgaacaatgagaacacatggacacagggaggggacatcatacaccggggcttgttgtggggtggggggctaggggagagatagcattaggagaaatacctaacgtagatgaggagtcgatgggtgcagcaaaccatcatggcatgtgtatacctttgtaacaaactgtacattctgcacaagtatcccagaacttaaagtatatatataaaaaagaataactagagttttgttcatcttttcataataaacgtgctgatagttccaaagagaagagcctgcaaaaaagatcatggatgcaaatgtggatcaaatacacacacacacacttgggagagatagagagacagagagagagaacgaccaagtacgatgacaagataaaaaggctgattgctgacagaaaataatcaaatcgttctccaattttttgcaaaagagtaattctgacacatttaaaccacagactagcaggaaagagttttcatgatttctgcctctcagaggtctctcaaacagcttttctgatatactgtttttatataaattctgcagtgacttttccctggtgttattagttgtttgggtttttctctgcctaccacccgcttatttatgttaatctgatttagatcttttcttttcccctttctttctttgctgaggctagatttcacagggcaatctgctgagtgacacaacgacaagatgcacatctgtcagaggtgtgagcctgtgtgtgtgtgcacaggggtgtgtgtgcacatgcgtgtgcatgtgtacatgcggggtctaattctccccagggtcggtctgtgagcgcctctaataccctatgtggtttcttgagatttccaaatgagtgaggtggggggtggtattgaggtattgaggtcatcacttataggtaagtactggaggatgtagcgttagctgctgcctggactcaaggattatagaggaattctgggaagctttcatcaggcctcttaaaaaaaaaaaagccctgcctcacagttgacattttattttatagtcacgttagagttgagttcagacttattttgtgctattatagccgattgattatttatcacttcaatgaagaatttattgatttacttaatattcattgctgataacatgaaggatctgtaaattacaaatcatctgggccctcagaaatgcttaattatgccctgcctttcttgttcctcctgtctatctccctcctccccatcccctcgtcctcctctaggcctttatccaagctgggtagaacagatggcccagaaagcgcaaacccaccttgtctgtgatgaaggtgagagcatcttcccaaaccctacaagatggcttgattcacaacactatatttcaacctaggaagcacccttagaggtcatctagtagaatatcacaggcagttcattttaacagtagtcatatattgagttcctaccgtggtaggcttcatccctgtagatggcctggcttacccttgaacaactttatcagaaagttttttctcatagaaggcagaaatttatctcctggagtgttcacctatcatcatacggcaagcagcagctcttaggtaatgaaagcagaaagaagacgcacctcaaacatactgtgtgggcaacaactctgtctcttgcattccctctccttgtcacatctgaccagtggttcatacagatgtgttacacgtgccctagctcagctgaggctgagaggctggctgaagcaggaagaactgaccctctctctacactggccttgctctgatgatgtttgtgccctgaaggccacatctgcctgagggggtactgctgcaggcgtgtggcttttcactgtgggcttcctaatgcagtaggtttcaagcatgaattaggggaaggggccaacagggtaacgtggtaatgaaggagatggcaaagtgaaaagcaagttgctttaaccctgaaagaaagtatttctctagcaaacagcaatgctttgaaagcaattgacagaaagctggcttaatccttgttctggagatacttacagctgcccgtggtttttaattaatacactgggctccctaacaaaggggaggaggttggagagcattaacagatttactcacccaagccaaggaaagtgctttggaagaaatgccctggccgcccatgggccgggatcttcctagccctcccttccctgcatggcaaggcacgaaggtggtctgatgtggattccagggtgaaggtggtttgtcctccagtgtgtgttggccagggagacttccttgctgcattctatctcactccaccccaatccattctttccttccatcatttgctccctcaaccacacatatttattaagtagctactatacacagaccaggcacagtgtgtgaactgaagaactacatttataccaaaggcttgagctaggtgttttaatgggatctaaaaacgaacatgatgctcgtcctcagaaagcttagctctagtgagagagaagcattcagggctgatgttctgaatggcagtgctgggttcttactgcccgtttccattctgattgtatctgttttgattggtcagcaccactgatgccccagttcttaagtatttttaatattaccctggaaacatgaattgaattacacaacaaaatgcaaaatgttaaacgttctatgaaaaaagggacagggaacaatggggccatgttgccttcagggacccattgctgggctctcagggttgttttctgtcattgagtgacacatatgcccacctgcttgcaagtcctgcatcccattcctaccagcttcctagactctgccgcctctctacttcagtcactcatctctcttgttcattcattcattcattcgttcacttacttactcaaccaatgagcacttgctgaaggccaggcatcgagccgtgcatgggaacacgatgcttcctccccttcccaatgcctcctggacttttcctagagactccgctcagctctccttcttactccttcccatggagggatctttctcctttggttagcgaatctgatgtcagagtcattccatctgacaaagtctctcctcgtctgaaactccctgtctcctcatatcttcatcagtccatttccacatgtctagtcattttaatggcatatggttccagggggaaactccaaatgagggaaaattagcaactgtgcttactgggctaaagaaaatgactggagaggaagttttctttagaaatatccacaagaagcagcagcccaaggagacgtgactccagtaaaaatgatgatttttgttaggggtggtagtcggggtggattatcaatcgcattttctttcccctggaatgtgtcacagtcattaatttgtttaatttatttttgcctcttccctagtgaagcagcccaatccaccgtctgcctacccatcagaacaaattacactttggaaatatccgagtgcttcagttttccattaaatataataagaaaccacaatgcaccgttatggcctgctgactccttgccaaggatctacaagcactttttacaaccgctgccaggcaattctggttgtcacccttggtgacacagaggcgcgaaaacaggtccaggatcaccaggccctgttttaatttgcactcgtgtgcacgcctcttgggttgtgttcttaatctgcttcacatgcacgcgatctgattctgcagcacagttccaaagtcttcatacaggagacacatgtcctgcttctatggtgtctccccactgtgccagagccaatgactgctattgactgatgaattaacagagttcagccctgtgaggacacagctagctcgtggctcatgaaagctggccttccaacttccagcctcttctacacatcacaaggctcaaatgctcatctttcttcttcctctgactctctggctgctcccttataatcagccattgctcaggtcgtgaaaactgctcatgactgcagttcagtctgtcctaaggaacattgctaattgatgattacatttcattttcaggatgttatcttacttgggcaggttggaaattgaaatgtccaggggttacacatatggtatatatggctctttcaagtcagagattaattgttgagtattaatatttaattttttattgcaaaaggcttgtcaaaggctgccacgggaaggtgagagctcagatccatcctacctgatattcagcgtcctcaagaatagagcctctagcactgccagctctgcaatttctaagtcaaagaaggagcagtctagtgagttggactatggcagtctagtgagttcttggatgggagaagtttctaagatgaaggaggcagggttggacgtgttgtagggagtaggtgacctgttgagtcagtgctgacctctgcctggacaggagagagctctaaggtcaggtcaccttaacatctgtgtacacagacagttaggcataggcggagaaccagatgtctggtgtcaacagaactagatgtctgaagacctgggtttggtgccaactttaccattcaccaacaaatcatctcaaggaacttctgttttctcttctgtaaaatggtcagggtgccatctatctcaagggctgctgtgccattcagtcataatactgttcaattgtgtgttactttgcagttttcaaggcacaatgaaaaatggggatcctctatcatcttgaaagccttacagattctgatgaggtcaggtggatcgaaattgtagctttgttgcactataacaaagggttactaaaagagttaaaggagataatgtatgtacaacacagtgcctgacactcaacaaatgttaactgatttcttctagtagttgcagtttaaaaaataataataaaaggatgtctgggagtgtgactatgaaagaataattgtgtaattgtgaccattagttaggcacaaagacaggacattggaaacatggagatgtccccagaggagcccagatcctaagtgagttacatagaattaccctctttctgacattggccaagtgtctataagaggctcctccatttgagcccaactcccatcctctggcccaggggggccctttctcatcagccacattgtgtgatgaggtctaacagagacccacattcaagatcctgagactggccagcctgacattcagccacactcagcacttgggtcagccccatccctacctgggtgtgttcactcactctttcattctatccagggatatgcctgcctctttcactaaatttgatggtatgaagtggtcttcatttgtgaattcatctacagtgcctagtgcagtgtctttcacacatagtttttctgcttaatcatgataacctgtgcacataaaggcactcaaacactcatgcaaagcatccctagcaaagggtggttagtgtggttttggggatatttcctataaattagagcatttctcctactttttaatactttcttagtcttctttgtcccttcttcctcctctaagtgccccttgtgatggttaattttatgtgtcaactcgactgggttataaaattcccagatatttggtcacacattattctgggtgtgtctgtgaggatgtttttggattagattagcattttaattagtagactaagtgaagaagactgctttcctcaatgtggatgggccccattcaatcagttgaaggcttgaataaaaaaaagactgacttctctctctctctctctcccctgaataagagggtactcttcctatctgatagccttgagctgggacaccagtgtttccctgcctacagactctggctagaacattggctgttgtgccagcttgtggactagaacagctcttctgggtctctagctttccaactgcagatctggatatttctcagcctccatacttacacagaccaatttttaaacagtaattctctttctcatctatctgtgtatctatctatctatctagtctatctctgtattatctatctgggataaagacacacatgtgcacgtgcatgcgagtgtgcacacacacatacacacacacacaattggttctatttttttctggaaacccctgactcttatacccctaaatgttgttgttgttgttgttgttttagccagggttctgtcttagcattttcccctcactctgcatgctatacttgaataatcccactttcttcaatggctcccaagaccacacttatgttggaaaattccaaatgtttctcatcactccagatccctcctgaactccaagatacaacctcatatattcagccatcatctcggtattcctccttagatatctcaatgttctcccgaatcagcctgtccaaaggagatggcagcactctctacacaagcctgccttttcctcccctgctcctgatttcacaccttgccctacctttcactcattacccaacctgggggccacctcttctacactctctgaatcccattagtcctccaggatgtggactgtgcctccaggacccctctcacagctaaccccttcccttaacggccattagcactgctatagaccacgtgtcaccattgctcgtactcactgcacatgtttgtataagcctttctacgctggattctgtactccttctgggtaggaatcctcactgatccactgtttattgtttttttaatccctcagttctcagcaatgtacttagccaatattagatacttagcacatgactgacatctgaatgaatgattgaatgaatgaatgacttcccttggaagtccatggggtatagggaaggaggcagagcatatgataagaacttggcctgacgcaggagacaagaaacagaaatagaagtcaatttgtttgccataaataaataaaaggcaaattctccttgattaaatttgaaatgaggaaaacagaaacaagcagttatcttaagagcagggtagtttaatatcctaactacctaccatgggataggacaaactctgctatagaaggtttttgttttggggtttgtcattttcagatatccagccgaggacactgaaccaaacgtagtttttctaaagaggccctaggttatatttaaagttctcccagtgctcactccctgggatcttaagactttgatttaaaagacaagcacagagcaaaactcctgaagatcaattaatctaactcatcaagacggatctgatttgaattgcggttccaggcagcaactagtagtccagagacaagactgctgagttggctgatgggtagagagagcacagcctcaaataccctgcaaaatgccagacagaaggctgacaactaagcaaaaaattcagattttgtagatcttacttttgaagaactccacccctctcttttctttcaactatttatcaatgtatttttttttcacttacatgcacaccttgttttattgtgctttgctttattgttcttcgcagacattgcattttttacagcttgaaggtttgtggcaaccctctgtccagcaaatctattggaaccatttttccaacagcatgtgctcactttgtgtctcacattatggttattatcccaatatttcaaatactttcattattattagggctattatggtgatctgtgatcagtgatctttgatgttaatattgtaattgttttggggtgccacaaacacaccatatgagatggtgagcttaatcaatgagtgtggtgtgtgttctgactgctccctcaaccagccatttctcatctttctccctttcctcaagcctccctattccatgagacacaactatattgaaattaggccaattagcaaccccacaaaggcttctaagtgttcaagtgaaagagtcgcatgtctgtccctttaaatcaaaagctagaaatgactgagcttagtgaggaaatcttgttaaaagctgagataggcctaaagctagacctcttgtgccgaatagtcagccaagttgtgaatgcaatggaaaagctcttgaagtaaattaaaagtgctactccagtgaatacataaatgacaagaaagcaaaacagccttattgctgctatagagaaacttctggtggtctgtatagaagatgaaatcaaccacaacattcttttaagccaacacctaatacagagcaaggccctaactgtcttaaattatatgaaggctgacagagatgaggaagttgcagaagaaatgttggaagctagcacaggttggctcatgaggtttaaggaaagaaaccatctccataacataaaagtttaaggtgaagcagtaagtgctgatgtagaagctgtagcaagatatgcagaagatctagctaagatgcttgataaatgtggctacactcaacaacagactttcactgtagatgaaacaactttttattggaagaaggcaccatctaggtctctcatagctagagaatagaagtcaaggcctggcttcaaagtttcaaaggacaggctgtccctctcattatggactaacataactggtgactttaagttaaagccaatgctcatttatcattttaaaaatcctattgcctgtgcagagtagattggaacaatgaaggctgaaggacagcacatctgcttacaggttagtttactgaatattttaagcccactgttgagaactactgctcagaaaagaagattcctttcaaaatattactgctcattgacacttaacctcgtcacccaagggctgtgatggagatatgcaagattaatgttgttttcttgcctgctaacacaacacccattctgatttctatttcaaatcaaaaagtaattttggctttcaagtctcattatttaaaaatacattttgttgaggctctagctgcctcagatggtgattcctctgatggatatgggcaaagtaaattgaaaacctattggaaaggattcatcattctagatgccattaagaacatgcatgattcatgggaggaggtcaagatagcaatattaataggagtttggaagaagttgattccaatcctcacggatgactttgaggggttcaagatttcagtggaggaagtaactgcagatgtggtggaagcagcaagagaagtagaatttgaagtgaagcctgaagatatgaccgaattgctgcaatcttgtaagattttagtggatgaggagttgcttctcatggatgagcgaagaaagtggtttcttgaggtgaaatgtactctcagtgcagatgctataaacaaagttgaaacgacaacaaaagatttagaatatccaataagcttaggtgataaagcagcagcaggatttgagaggatggacctaaattttaaaagaagttctattgtgggtaaaatgctgtcaaacagcatcacatgatatagagaaatctttcatgaaaggaacattcaaattgatatggccaacttcactgtggtcttattttaagaaattgccacagccactccaactttcagcaaccaccaccctgatcagtcagcagtcgtcaacactaaggcaagaccctccaccagcaaagagattataactcgttaaaggctcagatgattgttagcactttttagcaataaagattttgtaaattaaggtccataaattgctttttagacataatactattaaacacttaatagactatggtatagtgtaaacataacttttatacgcactgggaaacaaaaaaaattgtgcgatttcctttattgcaatgctcacttccttgcagtaatctggaaccaaccttgcaatatatctgaggtattcctgtgtttggaaagatctagccaaataaaaaataaccttttatagcctaaatggctgagagcactgataaaataatggagaagacaggaacagttgtggaagagatctagccttctaacacttagtttcctgaaataaaggaagtgttagccttctcccttgccatccttcaccaaacagaacacacatacacacacacacacacacacacacagacacacacacagacacacacacagattcttgaaagtttggaagcactgatgcttgcaaataggcccattaaaagaagataaatcaactggaaatgcataaaaagtctcatttatcataagacgtgttggacagggttttgagttttacatacatttattctagaaatctgtttatctgtgcaacgtttctgaacaaaatgctttgtgacgaaccatcctctccacttgaatctatatggaaagcaattaagttcaaaccccgaagacaaaacatgataaacacagcaggcatgctattgatttggaatttcacaactgcccttcttccttttggatatcatctccttataccccaaaaggcctcctatacctcctacacttatgaaatgtgtttcttacgtcttcagccaaggcaacttccctgactactccctgaggactacaaacaatgagttacttcaacatgtctggagatgattaacctgaaagtggttaaaagtgccacccctggagtgaatgactttcctcagcccagccaggatatgactccaatgccaaaaatttgcacatgtcccatttccccacctgcacttgtccataacggaagagggatgtgtatttgagcgaggggaggtacagaaaaaattagaaagccactcaacttatccatattacactttcaaatcccttcagtgcaagggacctatctcatgaattttttcattttccatctctagcaattagtgggcaactacaaggtttgagaaagagaaaaacttcatctgtgcacagggcctggctcagtagtttcttaataaatattcaatgaacagctattgaatgactaaatctgtacatacaaagcagaggattccagcccagctgatagactattccagccatattcataatctggggtgaaagcaacacatctgttccatcatgaagagtgttattgattagcatggtcagattggtgtccactgtctgacatctgcagacacaggctgggtggcatgtgggcaacacccccttctcccccatagatagatagttttagctcttcagtgaatataattgtcagtgtgacagactctagtaggagtttgcctagtctgcactttattccatgttgggtaggtcctcctagaacccctcctccaaagaagagaaataagaatctaagatcaggaattctcttagaaacactacaataatctctcctcagcatttctgcacaaatgcccaggggtacacccagcaacctcaccccctgagggcctgccaacagcttgtgctacaaactcctgcaaataggatttattagaacagaatcaagtgacagactcagaacgaaggcagcacagatgaagaagaccctgaggttctatgcagatgttgacttttatcaaggtcaacactgagatttattgacccaagaggtaaatattgatggaggctcaggaggtcaatatttgccccaaggtgaataaatcttcccaatgaccctcaaacagaagtctgtatagagtagactcagttcgaaaatgaattagctgtgacatagattaagatactatttcattagattgtctagggcattggaaagcaatattaatactaagcacttcatgttcaaagtactttccaaacattcattaaagtgcacctccctctagcagatgcataaaagtgttgtactcccaactcaacagatgggatattagagccaagaaaaagttaagtaattttacctaggccacagaaaaagcggctcaagaacagagagataaaatggagataagtgtgagttaggagctctggggatgagcaaaggtctacagaacagtgtcttaattaacattcctggtcaaattaataagtccacttggtttgattactttcatttagttaatttatatcccattgttcacaaatctacttaggctgttcaattgtattgcttatttacagagatgcttttcggcatttacccatgataaactctacctttggacatcggtactcaactcttaagaagtgaagagtgtgttagtggtcactgggaaggaacagattggtttatccatgtatttgcataatcattatcatcacattctaattctcatacaatacctcttctcagtaacaagatgctggtactgagaaaccagtatcctggaaccctattgtgaaagactaacacgtgcgtcattgccatttgaattcacggatccagtgatccctgcttttgcattgtctcaaaactgagctttaaatattataaaattttggttctttgctgatggagaggtcagagccatggataatcgaaacctcagccaaaagaagatcaataaatattatttccttctgactttggagtgcgttattttcccgtgttttacgttggccttgttgtttttctctggagagttaacatcagaaaagagtgagtgcttccagagtgccagcgatgatagccagacaggtgacagaactcgatgtgtgtgggtatcaggtcagcagctttgaggttgtgccatgtaatccacaggtaggtacttgagtggactggcctcaacttgtagaatttagagttttcaaagttacttcaatctactttaaatctttggaaggaacaaatggggtcttgagagtgtgaccatttggttcacttgaaaaggaaacaatttgacttgaagagatgtaaatggttagctgatgccagggtctgaggaaagaatttaggaattttgaccccaagctgcttagatacctcattattttatcctgcaataggattttggaattgtagctgttacccagataagtaagtgataccaatatgatctgatactgttacaaacggtaatttgactgacaataaggtacagacaaatgaaagtgtttacagggtttaatatttaataatgtaaaaggaaaaagtcggcaaaagcaggctggagatgaaaagatctgtatcgagtcagaatttttgccgattgtcagagcagcatgcgtctcctggggacctgaataagcaagctgctgttctgcagaaattgttatcttgggcgtattgattgagtgtgcaccactcaagctgtcagtttctccctcctatccttgctttatattttacatcatggtatcctcctaaactctcacatactgcctggccttcacactttaggccgcagaaccgtggtgtactctcgaaggagacctaggtggtgtgcctgacgtgttagttctgtctgtgaggagcatctcagtgactcttctctagggcatactaatgggctcattctggaggtggctgggtgctttgagtctagagacatgccactggcccttctcttaactagcatggccaagataccaacagacttgctccgtggacagttacttaacctgtatatgcctcggttttctcatctgtaaaatgggaataatgcttaccttacagaactctcaggaagataataaacctaaaacaatcagcacactttctgacacagagctgtcctcagtaaacaagaatgactgttatttattaatgcagtccacagaaatctgtaaattaaataagaaactgtttagattgcagaagacctagccctaaacccagaatcccagaattcttgagcgagaagggcatttgagaggtgatcttatccatctacctgccttctctgtaagcccagagagctgacaatctctttactttcaaaagccattagaaatgactctgaaactttctctgacccggagctcaatgtttgtacaacctgacaatagcttgagtagctcaaacacctctgacacctggagcagagactggaaccctttgtccagctcttcctctttgtgcgtaacactgttctatttctattagcttttcttcagcaattttactttcctcggtgctccttcaccatgcccgcacatccctccaaagagcactgcaagttctaacagcccctggaaccttagagaacaggagagcaccgtgctaatgagaccaaagtcaacaggttgcttcctaccagggaataacttcccacagggaagatctgccttctggcctccaaactgcagcctttcacttcaggagctgccttgcaataataataatgatcacatctaaccttcaggtgcccttttctatatttgaaaaatctccacatctcagctgatcttcacagtaaccccgagaaatgccaccactggacttgttacatccatctcagagacaaagaagcaaccgcagagaaatggccaggatcgtgtcctcagaatgaggcaatgttcactcaagcccaagccttctgaaagtgagccctgggctctttttcttcacattacacagcaaatgaaaatggtagtggttctcaggtgggggcgattttctcccactccctccctgggtacacttggtgatgtctggagatatttttgcttgtcgcagctggggagggggcttgctacaggcacatactgggtagctaaacctcttacaatgcacaagacaacccctcacaacaaagaattaccctgcccaaaatatcaataatgccaaggttgagaaatcttgtcagatttatagtaagaggacaaacaacagaatccagccacctgactaccagccaagccctattttcctgcctatcttactaggccaacttgcttcccccaaagaaacttcatagacatttgcaaaggactttgggatactcagaaaaaagttaatagctaaatgtagagttgttggattttgtaaagctgttggtaaagttattttcattttgcttttcaaattagtttgggagttggtgttcttctttacataattacaagctgacaaacatgcttctgtattttttttaattaacagatatatgtattcaagttctccaaattacatgccacagcttgcatattacaggacagctgccatgctccagatgtaggcaataaccagaacatggtaatggcaaaatgcaaaagaaagaaagggggaagaaaagaagaaaagaaggaaaggctaatgtatcaggacggagaagagcaatttcaatcaatgggtttggattttttacagagatgaataccttagattctcccaaattttcagctcagtttgaacatttgggatgaagctgtctgggtcattcattgctgccatcaaaggctcaccagcgccttgtaaaagcagattacagatgaaatggggcacatataaatgctaacagcgtgctggagaaactattcaaattgctcctgtttacaagtgccctattaaatgtgctcagctcctcctgaagaaagctgctctaagctgggtaaactgctatatttattttgcccatttataacacggcagccccttttggtcactcaatcccaggtgcaggctctgtctggtatccacaaatcaggaactctacaggatggggctctgcagtgagaaaggggcaggggcagtagatgaaagtcccagtcccacacctaccaactagcttactgtgtgactctaggaaaaggactgtacctctctgagactcagttccctcatctgtaaaaaacggggcatgactggacaacctctgaggtcccttcgactctccaggttaggagtggttacatttttgagtatctctgcagatacgggaaaaccctgcctctccttgcatagatgtcagaagtaacacttcaggcgggggcgtctgaggttcgcgtgtgagggaatcaggtgcattgcacagtcatctcctgctcaagacagaggagggcgctcaggggccaatcaaacgacttctaaaccgcgaaaacaggcctggggcaaaagagtccgtagataccgcagtcaaggggcgattcactccatttactgacacaatagacatggagtgcctcccatggacacagggaatgaagggatagacagatgtcctatctttgggaatgctggccttccaaggagagagttgtccactggggaaaacgcctgggcaattccctgcagtgtggcaggtgtgaaggtggaggtaagtttggggtgctatgggaactcagaggagggaaaaaagccactgaggaggtgacacccagcggtatctggaagaatgaacaggtgtgaaccaggggaagagggagtaagaacgtctcctgagggcggaggctgtgggtagcaatggagcatggtgtgttcagagccagccaagcaatcccacaggagaacacaagaaatatccccacggcacagcctacccaagtgaataaggcaggaaagacctgtgagaagtgaaaaggctcgggtgaactgtgatggtagccatgatgcttttccacgcccttgatgacacaggcttatttgaataattttgcagtgggacctggctcacttttgtagatcccttcaaagctggagattggtgccttccgggattctgccattgaaggaaggaaaaaggtagcagacagcctttcccttctcttctcctttctctctactctgcatggaaatgcaaaatgctggagtccaaacacattcataaaataattttgtagggctggtagttagttccagcaaaaccattgaggggaaacaaaggaagttttgtgttaatgtgactagtgtatgactctatctgagttaagacaacgcaatacgaaagaaaatctggctaaaattagccttcttctaccagtcacagccaagctgccctaggttgtcacctagggacggaacaggaaaatgcagcctctctaccactgcccctgccccctcagggatatatcatgcatttgaaaaattctttcttctttcagtttttcgctcttcacagctcagttaattccacttaagacactcttgtttccccgtatttttactcatttcctttggtttcctttttgtttttcttaatttgagctttctcaggaagttctcttcttttccttcttttcttccctttcttttctctctcacattatcttgtttatgaaacactgctctttattaaacactacattaaacacaaataggtaggcataaggttaagtgatagttgtgccaataaacagaagaccctaggtgtgtagcgacattagacaaaaagtaaccagtaccatcaatctttaaaacccctacagtgccctgtcaaccccacagagggtccagaaaaaagtcatgaattgtaccagtatattgtcatctaaggaaatctgatttttattaagtatcaaatcacagaacacgtttgcttttacttttgtgtactcagttaccgaattgctaatgaatttactaatgttgtgatgggattttttctattatatgtaaaatgataaacatacagcatttcaaccacatccctagttaagtaaaattttgtgaattagtgaaggaactccatttaatttagaacattgcttccatgagaacaaggttttcctagtttcaaataagtgatatctaaggacccatagaaacacttgcaaattaggatccaatgaggctcacctgctgccaggtatctacgcagcaggagaaccacaaacagaagcacatggcggtgctatggcttctcccccacccaccagtctcccttacagtagctgcgaggtgcacaggtagttttaggatttaacatgtttagtaaacattgcttttccattttccttttatttattgttccccactctcaacagtgtttgccttccttcccatctcttgtcatttccctcaaagaagcagattcttatttaggtggtttttgactatttacgagtacaaagtattatctacatttctgatgacatgaattccagaaacaaaactgaataaacattatgaaaagggtaatgtttgggaggttaaaccattagtgaaaaatcatcaaggtatgcttctgattcttgaatgaatagaggtgacagaggcaactcattcagtgccccagttttcccagctataacctgagaataatgatctttatctaaaagattgtaatcattacaaattgcttggaaattctgaagagataacagctaggtgtgaaaatgagagttgtagaaaccactgggagctggacagggtttttatgttctgttcggggtgttgtcttcccaggctgtcatttgacctttggcatcattgagtctctctcttactgagttcggcacccataaaaatatgatcacattacattaactcagcagtcctataggagagtgagttcctgtcgtgagagcactgaaaggaaccacagaaatgaaaatatcatcagtccgattcttcactttgggccctatgtaagatattattagggaaggaacttgtcataaatcgtctgtaacccaaattagcaaagggcatcgaagacggtcctctgaatctttcctatagtccattcaaaaagcttgcagggaagaggcaggaaaatcttgcttattttgattcacttgcattgattttccaaataagcctgttctgggtgacttgggctgagtgcttggtacagaaaagatgacaagcaactgaactcaaggaggtaagagcaatgtcagaaaaatccattcagtccaggatagacagattagtgtttgtgaatttacatggccctttatccaattcataactataaacccactgctgcagaagtgacacacaagctcatctgatttctcttgtttggaaagttgaaatctccggatgagttagagggcatgatgcttcagtgcctttttcactggaaaatatcacagggtaaaatgaatttgtacattttccctagacctggtgcctatgcaagagggtctggtagagagagagagagagagagagagagagagagagaggactgtgcatacacatttccacacacactgatctcccccaggaatcagggtaaaagtctccagatgtgtcagggtggatatttgctataccttttggcttcctagattgggggtaaattattccctctatgagtctttgtggaaacaaggactccttcccactctatgcaaaagctgacaaattccaatcttagcttttccagcctcccttgcagctagagtgcaagccaccatgattccgtcactgctaatctgacccactttccaggcccagccacaggacttagtgatgctgagaaaagggtaggccaatattccttccagcagagctggctgctgtggaaagatcaacacagtcacgttactgaaggagcaggcattctgaccacggtctgggatattatttaggccaccacagagcctggctcctcagctcttctgacatgcccaatgttgttttccatttaaatcagccagttggcttctgttgcttgccattaaagaccctgcctgacaccgtgtccgtatttgattgcgtgtatgccacatgtatgtacacacaccttctcttccttccctacatattcttctttccttaccttgatcaatgttatggtgcacctagctaaaaacaactgcagaggaataaaaaggaaaaaaagtcattttttcattttccgccatcgtgcacataaaaagggacagaaaagaacgaacaatgtgctgctctggttgagttgatagccttaaattctactcaccctttcactcaaggaggacgccagccaaagtcaatgggaattatatttgtataactaagggcattgctgaacccagagagactggagaacaatttagcagacaacttattccactgccaactctaagttttgaggaaaaaaaaaaaaaaaaaaaagacagaaattgagtcccgaggccaatctgcatgagcatgttagtcacgggtttctgaataacaggctgaatggccctggcatacaattccactcatttttatgctgagggagtcttcttagggcttctatatcaccaagattacagtcccatattgccaagttcaagctgacccaaccaatgtagacttagcctcaggggccaccattcagttgcatagagagctgcctaaggcatgcattccttctctgtgtgaaggccaagggactgcaggggtcaggggaatcaagtcatgaggggataaggtcaactacttggaagtgatgaagagttctggctgctgctgaaatcattgttcagagcttaggtctagatccatttctgttacagactatcatggtgaccctaagaaagtcacttcacctctctgaatctcaagtcacttgtctgtaaacagaactagcagaaatggcgtgaatttaggagacagaaaactcaacttcagaacttcagttttgttatttacaagtttgtgatcttgggcaagcaactcaatagcatttttatttcagcatctgtaaaacaagaataataatactttttacagagtttggaagaattaagagtaatgatatacacaaagtatgcactacactgcttggcaaggagggactcaataaatgttagttgcattcattcatccattcatcaaatatttattgttgctcccactgtgccaggtactattgaaatcctgggaatatagcaatttatgtgacagataatgtcctttccttcccttgtggtacttgcattttctctccctaccagaagagtgagattcatgttccaagggcaagactagggctcatgttttctttagttgtcctgtgtgctccctgagggcaggtgccacatctagctctgctttctgtgcataggaggtactcattgcacgttaggggttgaattcagttacataagatgcaaaatattgcaaatgccatctccacaagtaaaacatttaaagcactttatgcaacatgcttccacagacttgtccatctctttgtttcaaatgtttactcctcttttctatagagctcatcaccatctttcctttcctatctagacctctctgacttcattatttctgtgctgtagtcaaataatgttttcaataacagtcatgcatcacttaacggagatacgttctgagaaatgcattgttaggggactttgtctttgtgtaagcatcatagagtacacttacaccaacttagatggtgtagcctattacacacctaggctacatggtatagcccgttacacacctaggctacatggtatagcccgttacacacctaggctacatgatatagcccgttacacacctaggctacatggtatagcccattacacacctaggctacatggtatagcccgttacacacctaggctacatggtatagcccgttacacacctaggctacatggtatagcccgttacacacctaggctacatggtatagcctgttacacacctaggctacatggtatagcctgttacacacctaggttacatgtatagcctgttgctccagtctacaaggtttggctctatcacccaagctggagtgcagtggcacgttctcagttcaccacaacttctgcttcccgggctcaagtcttcctcccacctcagcctcctgagtagctgggactacaggtgtgcaccaccatgcctggctaatttttgtatatatttttaaaggcttaatgtgacttatttatttatgtatgtatttatttatgatggagtcttgctctgtcacccaggctggagtgcagtggctaatttttgtattttttgtagaggtggggtttcaccatgttgcctaggctggtctcgaactctggagctcaagcaatctgcctgcctctgtctccgaagtgctgggattacaggtgtgagccactgcgcctggcctcaaaacactattattatcttataagaccaccgtcatatatgcagtcggtccttgaccaacagctatgtggcacctaactgtattgtacttcttcaactgagtggtaagaatgtgaaaatcctggaggtcaccttagttgaggctttcttccaattcagcaaacccctttatgtcatctctgatgcactattatccatcctccatgtcaagacagctgtgaatagagggttgactgcccacaaggcccacttacttcatgttcacaaagctttcattcttgcaaggttctttctcctacccccctgaaatttccttaaataagtatttgctgaccacctactgtgtgccagaaccatattcacaaccaggggtacagaagtgggactaccagtattcctaccctccagtagctgctagtccagtggaagatttgttgattagaattctgctctctccacataaaagaggcttgttatataactgaggacagttatagtgttctcttctaagccagttttctttaagaatgacagtcacctgggatggtagttcaattgcaattttctgggccctcctggaactaattaatcagactctctacaaatctagggactggagcagctagaatcttcaagtttaaaaaagcaccccagttgattctcatgcacaataagcctgaagaactcctaagtcttgcttttctgccttaataatgctaagttcgctaagttcctcccaccttcctcatattacataattcccaggtttttcttttccctccctccctccctcccttcctccctcccttcctccctccctccctccctcccttccttccttccctccgtccccatatccaagctttcagtatatgccccagtttgtaaatggctaaggtgtggctctcaggacagagcatacccattccagatgtgggtcacatcagcagagggtgccatgggggtgttagcatcttccagatgaacacatcgctttctacagaggatgctgagaagcacattatttgtcaccatgccacattgttagctcatattgagatttcaataagataacactcctccaattaagaccctgcaatatacctgacagaggaaaatttgtttatcaaatttgtgaataacacaacatcacaaaggagagacagattatgaaattataatgacatattatttttcttaaatgagatgttagcatcacttgcttttagcaagccaaaggttgcttccagggaccacagattattttctgagtgtttatgaaccgttacattaatctcctgcagatttttttctggagatttatatgtttacctgtccactgtttctgaatctactgtcatctacaattttacttttttaaaaagtgtgacatttttccagactctcctattttgcagtatttcttgactattattcacccagaatggtaccaggatcatattttcaaacggtttcagtgttctgggaagttaattttgttgaatctagtaatcagatttgttttaaacataccataagcatcatcattattatagtgatagttaatatttattgaatttttctatgtgtcagataatatgctgtacttgcagcgtatcatttaatctacttaacaaatctatggcatacatactcttgatatgtctacatcatagaagggtaaaggagaggggaggttactactggcataaggttattacttcacggtggagctaggcacttaatccttgatctgggtgactctaaaccaccaacttgtatgatctcttcctgtcacatcccctatctcaagttttaattccttctcaattcagctgatcgtccctcaactatgaacagcacgataggaaagagagtaccaagagagttaagaagaagttctctgtaactgataaacatcatgctgcatttcccaaggaggactgccctttttattcttcttccttcttgaaacctaaaaaaatctctcttttccttttttctttttctgcaggcttcagctccttctgggtcttagtgtcacttggcacctttgttacaggctcctgcacctcttttgtcctcttcttctgccaggtgccccgcctgccatcttttgtacctttttttcaaaactgagctccttggagagtgtctgcgcagtcaggttggtttcttcggatgctgccgccctttccttcttcatcaggatcattcgtttggtgctgtcaaaacactgaagctgccatctttcttgagccacctttctttttcatcacccagcttttcatattgtttattttctactgcctctggcgatgctcctgatcctccaggatcagggtctggccatgcccagtgtcctgtttttattatgaattcctaagattagcatccactttctttcgagattcccattatattaattcaatcattcctgtattctttcaacaagcatttattgaatgcctactatgcacctgtctatttcatcaggtttataccttgttggcacaatgcctggcacatagtgggtgttcgataaatatttgttgaaaaagtgaaaatgagttagacttgagcccagagtgacagagtcccttattgatttttccccaaccttctgaatgatcaagctgcttgtaaggcaattaaaaagtatgtcaagaacactgtttcagcaggaccagccttccaaccagtgtctggagagctgaagttgtcaaccctggctggaactggctcctgtgcctgatgtatggttgatattttggatcaggaaagagcatcaatttcctgtgtaccacacagtcagaggcatccctgtctcctttttcttggtgtcctcactcagtttctgggcacgacatgtcccactctccattgagtggatttctgtagtacgactctgctgccagtctactgacagcctccttctccagcacggcagcccaccaaaagtgcctccttccaagcctgtggccacaagccccagggataatggtcagcacattgtggcgttggatttttctgctacttaaatttatgatgatgcagggcatgcaggtaatcaattatgcgattctttcagggttgcttctgcccttcctcttctccaacattttctttgaaaggtgaccctgctccacttcctctaccaacattcttcctgtgtcagatctgtcctcccctgtggtgggcgtgttcttcaccttcccttcaaactttagccaattaggtttcctccattcttatgtgtggaacctctggaatgaacctgcattcttttctttgttaacccaacccctggcagcaattatgtcctaaaggaaagtcccctggtaacctcaaacaggttgctccctctatcatccaatatattcttgtgtttacgtgccctggccagaaagctttttggcttccaggtctatgcccagtgcattcagccactgatgctccttggttctggccacgcccagctccgtgtgggtccctgagtggtctacgttctcccatgcttcccaggctttagcacctgctactccctcttctcctcatcccgctctctgcccattttcttagctaatgtccactctgccctggagctttgcttcatggtgggagtttctctgagctctgttcccccaaggtgggctaggcaaccctagtgtctgctcccacaggagctaccatatgtggatgtcccctgggtccctacctctctgcacccgggatgcttattctcttacctggcttccctgttatgccctgtgtccctgaatacattgaggtacacctgcctttctgaaagtttggcaggtttcccagtgtgtactgagaaaacaacaagggttgccagaaatgggaaacataatttcaagggggagaatggcaaatgtacaactctccaacaaaactgaactcccaaacacagtgaaaagcgcaaactctcagacaaacagctattaaggacatagagtccgaattcacccggaacaaaagacccgtctataaccattatttatcactcagcaaacactctctttttgttccattgtcaatgctccacagaccacatctgcctttgggcagaggggaaagagagaaagggagagagaaatgaatagaaatgagagtatgagtttcattttatttatttattttacatataaatcagctaatcggtttaacattcatattaaagttgtaatcacctttgcatacattaaaatacaaactagcacaagtaataggccttaagaacaacattacaatagctattaacatataacagctaccttatcaacttacaacatccctataaaataataactgcatccaggattgatttgcgggaaattcattctcccagagcactgaagcctgactcgaagtctggggaaggtgagagtctggttgttctttggctgacgcagagaggtggctcttggggagtgaaggacaccagaggcggagatagaggcttgagctttcgttttggctctattatccactagagagatgacctggggaaaatgtcttaacctcactaagactcagtttcctcgtcagcaaaatagaaataagggtgtttccttcatagtgtttctgtgaaaacttaaatgaaatcataggagaggacctggcctttgtagcagatgcttaagaaacgtcagcatcttttcaagaaaaccaggtgctcttagagggtgcaagggctggaccagaaggatgctacttagaacataatatggtatctttcccattcattcatttgctcactcattaaacatttgttgagcactgtcagagatgatatgaaaaattttaaaacattagagtttctctccttataggacttaccattgagttgggaaaatatcaagtcaagaacaagctggacagaactgaacacatgaaaggatagaatatacacattatgtcggcagagaagaaagggcagagtgactgtgagtgggaaacaggaaatcactacacagagaggtaacctttgagccaagccttgaaatatgaagcgtatttcagtaaatgatgaggaaaaggatattttaagctaagggaacagcataagcaaggatacaaaggcatggcatatccagggaaaatcaaatattctttttctggtggaagcttgaagagcaaggagggatggagaggaagatgctggaaagagagatggtgccagacagaatgaattgatagaacaaatgcaagtatctacagattgtaggggaccttcaaagctgggtaaggatggaggtgtcagataccaagtgaaggtattggggctttgttttacaggcaaagggtagccagtgggcttgctgagaaggggaggagtaaattgtgtaccctatgaagatacaagtggtaatgaatgacaatggtgaagggtgactgtgagaaaaaaaatcgaggaacttgatagggtgctataatagttttggagaacatgagtagggcaatggaaggaaaaatggaaaggcagtatagatccatgtgaaaggcaatagagattaaaacgtgtcatgacaagagaactaattggttatgggagatgagaaagaggctggtgacttggcatccacactaagtgctgggaatataggatgctctttacggagattaggaccccaattggggagaaaataatgagtttagtttttagaatgttgttttaaaagtgatactgggctacatgtgagagcatcaccgatcaggaaaatcaacaactcacaaatatattttcattgttactctcagaattagccaccagaatgggtgctaggagtgtgaacgtggaaagaaccaagattcagttaggacacaataaaataattttgagatcacttagaaattttcatcctcagtacttagcaatgagagatggtatacttagatctctgtaccgtggactatcattattcaatttaaattgctacaaagtactattcttacatgattggcctgaaagccttgatgctgagttctagatatttgaagcctaataccacaaacgtacctctctggacaaactgtcacctggatttttagacaaaagaaggaaagcatggcccgttggaccacagcaagaccttcttatttttgcaagctattctattttatttgttcttagtgttcagcctgggacctaggcaggctacagatgttactgctgatggctgcagtgaccagtatcaagtgatttcttatgagaccctgaagaaggaggctgatggccattgggcccactgacagcatattgcctaatcgccattattctggaggaaaatgctcaggaggtgttatatgtggtgtagcttaggattccaggcagaagacagtccagtaccttcctaagtcactaaggaagagctaaacacatggtccctgtttcactgaaatgagatctgcctctaccacccgactctatgaagcaaaggcaaggaggtatttcttaatctgagaagacatcttgccttttatggcactgttaaaaccacacatttgggtgtcggaggaggtctcagccacacatgctcagggggcttttatcaatgcacccccatccttggagtaggttcctgagcttggtgcctggggaactggggaaggcccccgtttctaccaaagagggcctctctccaaggtgcctcccagctctaggcctgaggtttctgttgacagtgcctggaggagccatctgagcttctgtagcacacactcccttgcttgggggctctgctgggatgacagcctttaaacacctcattaatattcaaatctattcaagtcatttcaatttgaattctatgcatattatcagatagaacaaatgcaaatatatacaaattcatccatatgaagaaataaataggggaagctctgcataatgggattataatcattctcaggcttgtctctttcttttaattccccagagcccagagatccagacccagcctcaatgctcccacctgcaactgtttaacagcaactaaacctttcctggacacaggttcctcaagggctgaacatttgagaaacctattatcattatcaacctattatcaacaaagatgttatcattgtctactggttgcttctctctctgggcttgttaaggtagagctgtcagagacttgtaaggtgggtgtgggcaaggggttggactcagagacccatctgtaggctcaggggctggccctagcctgggcacattggccttcaggcctaacagcctcaagtcttctatggagtcttgatgcatctggtgggaagacactggggaggggactaagttccctaatttcttaaatcttctcaaacctgagggagacttcataaagcctttaaagtacattaactgaacttcaacacctgggcaacaatgagtggcatctaatgttataatcgtatctctcctttgcagcaagacacctaagttgatcctggagctgccacttctcctttacttccacgtactgtttctacccattcccccagcccaacacctccaggcgtgactcttttctagccagatcctcagccaaatgctagaaacacaatgctgtaagcagacaaggagggaaaaatcaaagtgcaggcagtaagcctcctaccctgcagcaaatcatacatggacaaacgcagggtccattcatcctttctttcacactgttgttgttgctcatctctatttcatctcaactactccaaagacaggaggaggccaaggtctatagtattttaaaggagagttctcatactctagactaataaagccaaagtaaattgctgttaagaatcatttagtgaggtttaactacagcatctaatagatgtgcctgctaatctctcccccatgggacccaatgatagttgcatctagtagtaactccattgattatgtaagcgtaatttgtgccaagtcatagtatgatattataataaccattttgtactaagcacctattatttgataatccccatagatatacatggggaaggtcattttttctaacttataagtagtgaggctacttgtaggtacaatattataataaccattttgtactaagcacctattatttgataatcccaatagatacacacgggggaaggtcattttctctaacttacaagtagtgaggctgaggcacagatttcttacacagagaggtaggataggaaagcctatattttcttctgaaagggagggctcatctaacgtctgcctttggttcttgcggtagacagaataatggccgccaaagatgcccatgtcctaatccctttacaggacaaaagggattttgcagatgtaattaagttaaggtcttgagagagagagattttcctaaattaccctctgtggtctgatataatcacttggttccttatgagaaagaagcaggtggatcagagtcagtagtaggtgaggtgaagatggaagcaagaggttggagtgaagggaggaaggggccacgagccaaggagtgtaggcactctgcctctagaagccagaaaaggccaagaaattgattttccctatagcctccagaaagaaacagccctgcagcacctggatgccagcccgtgagatccattctagacctctgacctccagaagctaagatagtacatttgtgttgttttaagccactacgtctgtggtaacatgttaacagcagcactgggaaacaaatacactccatacatagcctttctcaactgagattcctcctctgaaccagagaaccccgagaataatatgattaactatttttacttctcccaaaagtagtacatatctagtatcattttagatgcataggaaataatttaattcattgcatgtaatggatgccttttatggtattagaggttaattctccccatgagccccactgagaaaacttgcacgcccagaaagccacatggcaccttgtcttgaaaagagactgaggatgctaaccagatctattctgaccttgggcagcagctcagcacatctggagacactgacccagaggaaggcaagtacctcacctctgaatagtgcccttcatagagtttcaaagccctcacaaaaaggtattctctctggagattcacaacaacttcatgagtcaaggaggagaaaaaggctccttccctcttccataccaaggccatgcaccaggcaagtgacagagcctgtagcctgtctagcctctgctctagggcttgtgtcacatgcttggaggatgaggagttgtgatgagtgctctatgccttcaagcaggtcttccttgattgacaggggggcagacggacacttcatggcagatgcagtgcaggggggtcacagcctatggacccagtaaaaggttgccctgggaaaagcttccaggccattctcactggctgctgccaggtgctaagtccttactataatggagttattatgttctctttgttatgcctcatttacaagagagggcctcagtcaagagcagttttcccctagcctctgcacagagacccttgtgccatagttggaatcaaccaccactttttaccaggaactttgtccaagctccccgcacaaattgctctcctgcctctcaatgaagtattcactccaccaagctccatgtgagcccgcaggaagtgcccccaggagcttcctctgccaagaaccctctaagcacatactcttcgggggcaggaacccagggaggagacctggaggagggaaatggaagaaccctgggcttggatttgaactcctgggttttcattttaactttcccacccactacctgtatgactttagagaggccacttaaaataacctggccttattttccttactttttaaaggcaggataagagttgattcagggaggaagaccataattaatgtgaaagtgttctggaactatgaaatactatacacatgcaaggaaggattaaattattatcaccttttccccaaggaggactcggtgctcataggtactcgagttgtacaaggcaataataatgataaatagagcacgttctctgatgaaacactttcatgggtttgcaagtgaaatgctgggcacggaaaggtaggagttgtccagaatccctgacacattatgctcttttcccatgtaagaaatactgattgtatctgactctgcgcccaagtccaacaaagccactgcacggtagatggaggtgagaaggacccagccctggccgccaggaagctcacaatatggaagggaaggcggaccagaaacactccatgtggataaatcatagtaagagccacaaaaggcttcctggggcgctgtggaataaggaaggaagggcatttaaattagattgtggggagagaggtcaaggaaacttccaccaggaggcaaaaggagctgagtctttagggtagaagttatctagactaacctgggggagaggagacggccactccagagggacaggaggcacgagggagcagagcacattcggacaatgtcagcggctccgtgtgttggagtaaaggggcatatgagagggtggggagactttcattctgagactctttgtcctgaaggtgtcgggatgctgtcaaaggaacgtacacccatgagaagatagcgaactctgtgcaaagctgatgatttggttattgtcacagcggagctactgacatagttcaatgatgaaaggaaacttcaaaaccttgagtataaggcatgtgccttcatgacccccctactggatgggagagagttaaagctgttgtttctggacactatatagcctagtgatctcctgaagcctaaaatgagtatctcacaaacacgccagctcacttagtctttctgtttctctgtctctcctctctggcctgtacaatccaccacctgtgcctttcccccttcctctaccatcactacagtactcagccacctggggatgcacacagggtgtacacggcatccactgtgggatgagggggcctttaaatctgtggctggctccccccaagcccctcttggttgctgggttcatcagctcatgcatttggtttcccattggtgagttgggttgaaaaaagaggcccagatgcctagtgatgagaacatttttttttatgaattgaaaaataaaatgacaataagcagctagcagatcccagttcacaatgaagtgaatatcaatacttgtggttgtattgaccttgaatatttttttaaaaatacagagcaagaattctcggggtgcattattatatacattctgaatctcttcactgtacaaaacagaaaatctatcctttatggacaagagcatctctggtgtacagcattgactttaaaatcaactttctaaagtgcaggtagaagaaaatctatggctactcttagagacattcttccctgtcaacatagattatgacattgcttccctgggttccactggggtgggacagggaggaaagccctgctgaaaggaagcactcttgatttctttccagttgtgagaggaaggcaatgatgtcagtgacggattggcatagctgctgtgttccacatcataggtatgaccttatcgtaagtttggcttcttatgcccaggacagatcccgattcctgatgtaacatgaaaacatgagaggcagctcccacgagtcaccttaaattctctggttagaaagtgactttcgactcccttgtagacttactatcagcagtgtccacatggaggtgaaaatgaggggacaccataaggaagcaagactcagccttgatggcacctgtgctccaagctgagcaggcctcaggagcagctggtgggctcggtataacacaggctgctggtcaaaacccttctgatgtagaaggtctggactggggtccaaaaatggggatttctaacaatctccaagttgacctgcagaccacacttgaagaaccacggtgatagagaatctacgaactcagataacccaggaaccatagaaagaccctaatacttccttgatatgtgagataattacctgtcaggaacacgcaaagggagtctacacctagaattaaggggatacactgacccacaaagattccttttccattgcaattgtgagtgagcaaatctagcagagtctatagtacgcataaagtcaacaatgaacaagactaagacaatttaactaaaaaatacaaccgtctatgtattttcaaactttccttggcatgaatacaatggcatggatcttagaatatctgttgataataagagtgaaaggtagatttcctgttattttcacagacaaacaggagaggtaagtgttcagattttctggttggtatgtcttgattctgaccagttccagtattcagctgttttcacctgtaaagtatggatttctctctgcaaaaacctctgtcccaatctgatgaagagaacacccaaaacaaagctcatgcccagagaaaggagcattgatatggatttggaacccaggcatcagctgccaaggctctgttgatatgacggcatgtcccactgaagtaaaaagaaggcatttgaagtattctatgcagagatctatcttccttgcattcctcctctgtattgctctgattcgatctaaaggagctttgaaaacgtcaaagaactttcatgttttgctagtttatcataagtgtctatcttaaaccaatattacaattttaagcatggcctgggtagacatgtgccatcttctaaaatgatttctgacacaaggtaagttgtaccagccgagaccaaagtgaaaagaatcataggctctatgacactcaggctctcctacattctaagagtctttttatttccccctaataaccattattaatcatttcagaaacacgtaatctcctgatatttttactattctagacttgacagaaaaggagggttttgaagttctggaaagtctttttatgtagagtagctccattcttccagcacacagctaccacaaggctcaactctccctaagcagaatgggatttatttatttatttcttaatccactgaagggaagctgggtgatgatgaattcttttaaagaaatcagcatttggctttcaaaatgttaagctatactggaagtgggttgtggaggcagagagcagtcgctagccatggaggaaagcttctcaaattcttactcagcttttgtttgggggaagaggttttcttccatttttatcagctctccgtcccaaatcctacaagctatgaaggaggggacccaccggccagggcaggggtttctgtggcttgctgatggtcacacggctgtcgggacaccagtatttctgaaatccttcctgaagaatttcagaaaaaagaatttcagaaatactggtgcctccacagccgtgtcgagggcacaggtgggcataggcctggaggtggctcctgaatggagcagcagcaagggctgtaaggggtctgcacaagggtgtttgattggcaggtctttgactctccagtcgaatgaccttcaggcaagttaccgaatctgtctaagcctcagtagttttcatcggcaaatgggtctaaggatccctactttattagattgctaggggatggaataagggaatgcatgcaaaactcagcagtgggcctggccacaggcctcagtaccatctccccgtggctggtccccattcagcaatcacaaggcttcgggggtagagaaacatgctgaggccagcacactgaaaccattacaggttttgatttttttttctcaccactctcctccctcctcagttcagctttctattaaggtatcccaaaacactaacgcagctcttggtgaaaggagaaagggaaaaagtggccaaatcaaggggtcgggggacagcagggccaaggtcaaacacctcgttggtataacatcttttaatttgaggaggagctcagtccccattattttcagtaaattctcaaactatgcagctctatgtttcctcttctacccttgtagcatcaactctgcagtttgaagtaaggttttgcaaaacttatgcaaaaagttttcttttctacaagagatgctgaagaagtcacctggaatttgctagtagaactatcagtaaaatgaagacagcaatcctgccttcagcccaactccactgcccagaaaggctggcactgtggggacgaagggggcagtggcagctcaccctgatgcagagagagcggcaagggactctgatggtgagtcagctgagggaagctgctggggtctcagcacaccgtatagaaaatccctccagcaacttcagaaaaactgaatgaaaggccaaaggtaacataaaccgccagctctaccaaccactcaggctgcagaccagacaagggagtggattgttcccatggtggctgcacctttccttcattctattcccgctatcttagttcacgctgcctgtggatcaactcgggatctcagacacatctcgtcacaattatcaagtggcaaaaaaggtgagccgccatccccttggaggtaaagaaaggcatgacgaagtcttagggccaacaggggaacgaagtcttagggccaacagggttcccccggtgtctctcctgcagcatgaaggccattgtttccagggcctgtggccaggatccagttatcttgcctggaaggatgttcaaacagccatggcccgtggtggttttttataatggtgttgttggaaattagtaataccatccagaggtgaaaacagagtagcacctccacagcctgcccaggagatcaggaataatgaagcctcattttagcatctgtttgttttgttttttcagcatttgcggggaatgacaacagaaatattggctccctgaccctggaagggtggaatcactccttgtggaagggaaaacgcctggagcggggcagggggcacaggcctggaggcggctctagggagaggtaggggctctgggctggcggtccccctgctggggaggactcaccttcacatacaggagagaaacatcatccctgtggcagggaaacccgtgtggtgggctgagcttcctcgctccctctctttgaagctctctcaagcccctctgagcatttgcaattgtacccccttagctgctgccacccttcatccggatcccctcaaacactccaccctcacaccctgcagaatcaggagagaggaacccgcctcctgcgagagccgccgccatctgtaacgttgccctcaccacccagaggcgaggaggagagccccccatccctcccgtcccttcccagctcccggcagccactaggctttccccttccccgtcctaagggacctcccgggctctgctctctctgggcaggttcagggctttgcaagcgctgctgctgccaccatcaggctgactgaggcactgcagccttcacctggcgtcagggcccaaaatagtgccccagctcttggtgcggcttcagaagaacagctcctctctgcctccgcagttgcccctcactcaggtgcagcttcctatgtaagaaaaaggcttcagagggcatctccctgaagaaacagaactccttgtgaatgtggggtggaccccagcgtcctctagcaagacgcagaaaaagtgcaggtcctaggatttagggaacgcaaccactgagggattaagtggtggttttgctttctttgccacaaggtcagtgaggcagggaagggtgggaatcactcctcctgccactcccggatgaacgtgctaagcttcctgtgcaatgaaccaaccgggccccagtgttactctgaagctgtcattgctcccagcattgccaagggtgacaggtggactgtcacactgcaccagagccgagtcacctgtgacatttgcaggtgactgacagaaatgggcactgacatgcattaaagaacagaaggacgcgatggtttcctgttgaagctgagcagtgggtggcttggcagaggctgtttctcttggcgttgtctctggtgacccaaagggcattcaaagccttccagaaaggaacaacttcctgcagggcacgtccacacttcacttagtcaggttcttcttctgcctcctgccaggggccctctcagcatctctccatgtgctgatattacaagcactgctggcttctcctctcattacccctcattccattccaatatttccacacttattcacagccttctatgtgcccaatagtgtgctagacaccaggggtgataaaagacttggattttaatcaaccaattaagagaagcaaagtccctgcctttgcttccttcctttttattattattattattattatttgtcagaacagccacaaaaggagctactcaagcagtatgtccttaattactcttcagccccaaagcctggcctgttatttcctctggaaactttgtaccccgaggtaaaactgaatgccagaaagataaagaaactgactcagaaagagtctggaataaaaaagaaattgaactacaatgctgcctccttgttcgaaggtcagacctgggattcggatgcatgattttcataggaaactccctaaaatccttttccagtcctagacactggggattgccacaaattataagactatgacctgtcttatgacaccacagcttaggatactctcctgcattttttagtgttgatgtggaacagctggatgtaccagcatcttgaggaacatcaaggcacatgaataagtgaaccagactgaaaatgactttagtcaagcaaagtaacctctctgggggtatgacagcaataatgcccacttctcattacttctgctgatgaaatgaggtagtgcttgtgaaagccactctgcaacttatgaagctttacacaaatgctagttatcatcaccatcatcatcataagaacataattactgccacgactaacaacaccctcaacaaccaaaagaatttgccaggcacctacaagaaaatttgctggcaaagagcaaatagaatgcatcacctactccctaggaatgtgtcatccaaaataaatagattgttgctaagagataatattcagagaatcttacagttggagaggttttggacgtcatctagtctactctctaacccatttctcaggaattgactcctacattcctgatggcctgaattccaccgtgagtcagaacactctcagcaatgagagactgttcagtgggccagccttagacttgagacttacatatccgcagtcatggaaataacactgtctatttcttgctgaacaatcggggttttgcttcatcattgagcttgtcctgccagcctccaccagttcctgaagagaacaggccaaagtgtggaacatacaggtagatctgatgatattctctactcttaaatggaagggtactcagtgccagagccttgtaaaacatttccaacatcttctgagtagaattgtttcacttgtaaccttggtttccctaaagccagtataacttagcttcctcttgagaacaagaaagacatcatcagcaaaatgtccctaggtttttgtgctcacctgctccagtgctgtttcctcttctggttagcacccatcttcaatgttaggctgcctgcgcctctaactagccaaggggatccacaaactggcaaatctcattcctcaatgcactctttctgctcaagtccagcgtgcagccagcagtcctgcctctgtgtgtttccatgatcttttttcttctcttccacattctttagctaacacatcattctggcattcatctacccaccatccttctgtgcctcctctctggaatgtggactaaccattaaggtcagttccccccatacttattctcttgctcacttcatccatcagctagaaagaacgattaaaaagtatatttccattcaattttacatttttagccccatgtgaaacacaagaaataccaagaagtaaaaataacatgttgatccctaaacccgtgatgtagagaggaccacaaacccataggctactagcaatgtttctcaggtgtttacttaattatctcaatccatcctcaaaagatgtataatggcacccatggccattcacgagttgactcttcccttcccaaccttcctctcccacttccctaacacagcagcactctagccatcatactgcccatggcttctgaacatatcgcattctgttctgccttttgtatttgcatacactgtaaggtatgtaagagactggaaatcgcttttcatgcttcgtttagagaactcttgagcatcctataatatcaagcatgatgtcatctcctctgtgcaaccttttctgatgcctttgctgatccacctgttttcagaacactctgacagctctgaacccatcatattgtaaccttaatcgaagtgtctgctccccaaccagactaagagctctggggcagaaacatggtcttcattatctttgcatcaaaagccccagcacagtgcctactgcataggaggcccacagtgagtgctggctgagtggtcaagggctgagccttagtgtcataaaatggtatttgatcacaaaggaaggagcagcatatttcacccactgagacactagactatgtggagcccctgggggaaaatgtggaatagtgacagcgatgtttgtttgttattgctgcaactcttggcctcagatttcagattccagttgtccaggcataagttaaaaagaatctgcataagttaaaaagaaacttgcaacaacaatccactgaatacaggccaagtgagcagaccatctagataattcagcatgatgcgcacacatcctttcttatactgacatacataggccatccattgcagttttagtttcaattatcaaaaaaaaaaaatcagcctcagataaatctactttgctttgcctatgaagacaggcaaagagtagggtgagagcatagctcccatttgagaaaagtggctgattctggagatatcacactgatttaacattaagtggtgtgtgcgtgtgtgtgtgtgtatgtgttcagtagggggtcaggagggcgtgggaaggcttccagatgccaggaaaaacctgtccaggggatgcaggcaggtgtctgtgtttggctgccccctttgcagttatttccaaggagaagaaggatgacttcctctttccacccttcatgccccaacagaacagctccacacagagcagattcacctatgctggccattatttccatggctttaacttgttaccaagtatgccaaggaatagctgacatttatttaatgttcatagtggtgttgactgtgtacgcactgaaacattgtatgcttatggaagacatttgtttccaagcagcttatgctaaattgcagtgatataaaggaaacacttatccaatattgacatttaccaacttctagaagtatacagccagaatactcatttttaccactgggagaggagaaaaagaattaaaaagcataatggtcctagctccttcagtgagttagaagctatgagtgaatgaaagttaacgtgcagtagggggaggttcaatgggggagaagatcccccaccctcttgtgacccttggctctatggcacagtgtgctttctgagaggactgaagcccttccgtgcttcataataaagctttggcagatggcaggacatagcatcccttccccaaccatgagagaagtattctgatgatctataaggtatctatgttcttacttgacctgcacttctaactgggtaaattctgactttctcttgggaaaagaaaatgacatgcaatgacgtatggaacagtactgtgtctcggtgcagtcgattctcacatcattcctctaactggaaataaaaatcccactctacttggaatacaggatgaagcgattacaacctgggcgcagtatactggctggctttgctgctcactcccttacgaatagctgtgatgggatatgaaatccaagggaactgttagccccccagagcagctgctcccaccgaccctgctccaagagtgctgggatgtccgctggcctcgaggcaagacaagagctccaatcactctgctgcaagcgccaccattaaagtcaagatcactgtggtggggggagttgaagtgtgcattccagcatgctcatgatcttactgaccttctccactgatgaattagaacacccctcttcccaggcacaggacgagttcagtgcctctctgtttcttgatggaccccaataaaaaaacgcctgcactgtttttcacctaaggtcatctcgacaatttacaaggataaggattgtagctgcaaaataatgcctatgcccctctagcccccttagcatcccccatctatatcaagaccataaaaccagtgcttttggccctcctcctcactcctccagtatgggcaattttcttttcctcatccatgtttccaaaacagtttatctttttatctccttggaagaaaagtactccacaaatcaaaggtatcattagtattgttattattttgctattgaaatctcttcaattcgctctggattattcatgtgcttttttgggtctgcaatataatgctgcctaagtcatccccactgggctgaacaaaaaagaaaaactgcatcttcgggcctaatctcctgctccaccccatctcctgctggccctggcttccaccaacacaggcacacaccaggcagggctgcttcttggtaccatgcctagcttgccgctgcctgttccaagccaaatcctcctctgtacacccaagagggggaccccatggtatcctcttagagcaatgtgaaggccttgaccccaccccactcgtcctccccctagggactttcttttccatcctcaataggtctggctggcaactgaggactccctactgggatacagacatgcaaccacccccatttccaacagacatgccccagtttccccacccgaagatttgttaaagaagtggtcccacacccttggcagctgtgtattgaccttctggcacaaaagaactgattcttcttcctctagacaagacgtcatcccacatggggttctggtaggagggagaaacacacattacttccctcatcttttgttttatgacatttctgagtgagtgtaagtgtttccaaagttgctgttcactccccactttgtttgctgattccttctctgcctgtaccccctatgatccctccattctttaggccacctctgatgtgttcaggctctcttccgatgcctccccaaccctgcccctcccaagggaactccttgctagttcaagcctcttgaagtggctcctccttttccatgcttcttgtcatctccatggctcccttcaccctggctggctccctctgttcactctattttacccttctgtctacgagatgcctttctattccctaggagattcagatcaccatgaccctctgccctctgacagctgctgacagccccttttggtgtttccagccaggcaggagagcaagtgggctgcttagattcttcccagtagggagatggtacctcaaatgcatccttagctcagggatgccattaacaggtaaatgcaagttttcacttttaccccaatacagtacagtgtgcatgcaaagccaaaagatctgggttcagcagaattagaaccttcacaaccacagaatcacaaggcaggacaggacgctctaggaatgccagagcaaaatgccagagagtagggaagagaccacctttcttaagagcgagtgtctggagtagaaggcgccaagttcttgccactgtggctcccctgtctatctcccctgtctccgaggtggagatcagagatctccctggaggcagggagtcatcagtcctctaggaccttattccctccaagctacctaagctgtgcatgtgcaggctggatgggatggggcttgaagcttaaggagggcacagaaggaaatagttgtgggtgaactgaaatgataaagaggaaaaaatatagcaagttctaagtttatggatgacaaaagaatcgattattttttcacccaggggcagaacatgtctattctcagcaggaggcaaattgtgctgtgacattatccctctctgaacaaagcatgaccgtcctgacagctgagggaagaggcatccacggcaagggagaagcccacaagcagtacacactggcagctctccattcccttgttgggagccaggcctggggactctggcgggggtggaatcgggaggaatgttatttagccttactactgccaccttaagaaagataaagaaatacttgatctcaatctacatgaaaagcccaaactttcaaagaatagggacccaccatattactgatattaattatacattgatttctgttctctgtctctctaaaaggttataagaaaaagtaaaggtaaacaaacatttgacaaattaggaagaaaaggatggctggaacggactttaagagtttatttgtatcttgagagcactgcttggagcactctctctgcacggggaccaagatactgggagcatggagcttgggaatcttgttcccagaaactcctaagtgccatgcagattcccactgtgagatgtgttggacagcagatggccatgtcatcggagtgccagataaggcactaaaaacaaccctggacatttgttgtctctgagggaaaggccatcccctgggtctcttcacatttcctgggagaggcatcccagcatgcaggaggcaggggtcaagcaggtggctgtgtgagggtgccgggtgggggggtgtaacctcaggcctcattctgggggatcacagtggagccatttagagccatgtgggctagacctcccaggacctgttagacatggatgcgttctatccaataagttgatgaatgcatgacactgggtagaggtggggcacagtacatgagctaagcatatatgtgaggatggtcaaatagaatcctctggggaattcataatgctcaaaacaacatccacataaacaaatttccacagatcaaggcaaaagataaccatatcacattgcagtgaagtccataaaacaccttcccacttgatggctggaccccttgattcccatagtcggacactgtctattcaagaagcacaccatgtacagggatgcagggtatctgaccagccatgtccacttgggtctcctcatttttgtttagacctgttttccagcctctggaccaggtatctaccatttggtagggtggacagtgatggccaagctcagaacactccaggagcacaaggcattaagaactgcatgatgttatggtttcttcctagcgctctcaggactcggggtagataaaacagagcatttaacctccataggtaaatatttaaagattcacatgaagcagtcaagaaacagctccagaccaagaaagaaataagcacaacagaagatgtacactgtaatgattcagacggccagggaggtacttagacacctatagccttcttatgccaatctacataagtatcacggatcaagcttctaactacacaaaaggctgattaaagcatgcactggtcccatgcaaatgtgagtttgtgtgtttacggggggttggttggaagattccctccttctcaggggttctatatcaaaacttcctgagtgaactggtaagaagcaaagacgaatgggagtgtgtgtgtgtgtgtgtgtgtgtgtgtgtgtgtgtgtgtgctcataagcaagcacatacacatccaagaaagagggtaatcttaccaaatggtaatataactgaacctgtctctataccagtgttctgagagagttcttattcattcagcctgaaactctggggaaggcaatttatcttcctgctgctgtagggagccttggtgagaagcacacaaccatatgaatacatgagtgtgtgtgtgtgtgtgtgtgtacatacattatcattatacacaggcattagtatgcacatacaaatatgaagaaggagccccttcggtttcatcaggaggaccagaagcaaagtttgaactgcacagataaggagaaagtctgcagtgaccacaagcacgggtggaagagcagaagaaggaagccaggtttttgcttatatttggcttctccccgacaggggagaaacagaagacatgctgtttgcttgcaaagccagccacccatggcagtgctttgctttctcgaaaacttttacccttcatttaatcaacagatggacgtgctctgttgtggattttttctgagtcttgcacctctaagagctgtgttggctggcacaaatgcagcctcagatggcagaggtgcattggcattccaaaagagcgggaaggagcccatgtacttgcccctccaaactcaattccacaggtgacttttgatgcctttggccaactaggcactcacattccctctcccgaatttccctctcctttctgcaccactaccagccccagggctcccagtggcaaggagcctagaggtggcaaagttctttccggagagtccacctgcttctctgcccctgctaggctgcagaaaggaaaccatcagcaccacgggcgaaatttcattttataccctgaattcagtgctgtgtaggattcagaattcaacctaatttagggaactcgatgacgttcaatgaaactctttacaagcttttcccaaccactgcaaattaccccccacaatacattctgtaattgcaacccccttttcaacggtgcaaaccacacacattcgcttttgaatacacttgtgcaagtcaaaccctattcaagctgaaatatccacctaaaccaagctctccctccctgccgtctccttccctggcctgggtctgaaggagaggaggtgcccagaagttcagagcggcataaccacagagatactacctaattaacataccagaagcataaagaactcatttgcattggagagtttgagctggatattgacaagtgagaggagaaagtcattcccctcccctcccataccccttctttccaaaggaaaataaacagtaccattttgttgcattcgcaaaggcgaagaggcaatgccagagcatctcagcccggcaccgagagacgcatccatcagtccgagttcccgaagcctgcccacgttcctgcccacagcctcccgcgccctgacaacccagccgactttcttccaactccagcagcgcaggggtcctaccttgactgaagaggaagaagcagacgaagagcagatcgagctggaagggtttcattccttagcgcagcgaaggaaagccggcggggtaacttggctgtggttagtttctcttccttggcggctctcggtgctcagcctccgccggtcctctcgggttcgcgcctaccatctgtccgtccgtgggtccctccgggtggcttcggtctctttgtgcctctgggtatctgcagccagccgacacaaactgcctgttcttagccgcctcgggaagccgggattgtcagcaatgtccccactcggagaagatccattctctggctcttggcatcccaggcacacggcttcctcaggcgggctcctcccacagtgagcgagcgagctagtgacgagtgacagaaggactcctttcactgaagctgaggcgaggggagagggaggggagacaggtcataattaaagaggaaacactcggaaaaaggagatctatgcaaaacggacagtgggggaaaaggctgtgttctttcttttccctaaatagggaaaaattcagcttttgtcaccattattgaccaaaaggcatcttgagcttggagtggagctgtgactttttgtccacacgatgtcctgtttaacagtgaagttaaggatgactatccacatgcatgtgcacaaaaacatgcacgccctgcctttgcaaaggaactggaaactgggctgaaagggaactaggaagggggggtgcgcatctttccctcggaaggacttggccaatgtgtgcagcgggaggctcggagttggagaagagataagcatgctttgcatttctgagagtttcctgtgggtgggtgggtggttgtggtggggggggggggtaggtaataaaacctgaacatttggatcttagttgctttgcactgctcctggaagacaaaatgcaggaactaaagggaaggcaagtaggcttgtgacacacacccatttattatcattatcctggtttgtgcatttcctaacgaggacaggggagcagcctgtctttgcattcagagcctctcctctaatgagcgctccatcactctgagcctgtcttttctccaagaggtgctgtgagtccaattgcaaaggagaggccaaggtcatagacaactgcgtcctaaggatcttcaagccttttacctgtcatgaaattcacactccacactcaaatcaaactcggtttcctccaggatatcaacatgaatttatctgggtctatttacttaatagacatttaggcatgcttggtataagcaggccatggagggaagcaaaataataggcacagaccatgccttcagaagctcataatctagtgtgcaagcagagtacacacacaagatgcaaactctaaggacataacaaaacaacacagaaaaatattcaacgttatgcactgtgagaaggagaggtaaagagagaggagaggaaaatgaaagacgctcccctgacatgtgccatttagcattcaattctaaaatcagtcattactgtcttcagtccctggaccttggggaggtcttttgggaaactcttagcctttcctctttcagtagtagcacatcttttgaggactctgctcactacaaggcacattccaactccaagtttccatgcggatgttaactttaaaaaattatcccttggtatttgtgaacaagaaagaaagaagcaggggcatatagaagtgtgctagtaggagctgacatctggtagttgacaccaaagatctacaaattagtaggtgtctgctttgttgacttttctattcttaacttaatagtttatttaactgcatcccttagaggctgttaaacacagcaaagggaaatttgtaagcaaactttgggaggagaaacagaaatgttgagcaacagaaactaaaaggacacaaaagaggcagcccattagctaaattaacaaacaagttactgaagcagtgtcagctgagcctgagtccattagcctggtgtaacagatcatgcaataaatggaagaggcaaatcaaaaacacacagaggagatgaaaaataattttaaataacatatgccaaataacacagtaagactgaaaataactctatgtatagcgccgtcaccttagtagtagctttgcattaagcctatggggttgttggggagaaatttcaggtgtctgcgtgccattcttgcagggaataggacaaatactagaatgcagattctctatcaaaggtagcaacatttgacgttttaactaaagatttatcctttaagctgttgtttaattttgagtgctaattcctcaatggcccagggcccagatttgcttaattcagcccccgagggaactattacaaaaccagggtcacaaggctagtgaagtgtgcaatacgcaataatcaggcacacgtacaggtgtctgcactccacactcgcactgactcttggaaagaagaggggggcctgggagatccaggttggaaggatcttgtttcgctctcccattggcccccaacactggcctcatggcccccttactggctccaggcatccccctcacccccaccaacgagccagctgggcctgttcccctctccactcccctctactccctccctgtaacctccggtctcccgcagaaagaaagaaaaaaaaaaaagcttggattaagtgatgagctgcccgcctctaaaaggaccaggaggcgtatcaagcctgagtgccggaaaacccacggcaatcttcagcagccaccacgtggggcagagaacgcgagcagtacctgcaggacccacagccggtcgggctctggcgccagcctcgacggcggccccgccatctccgcccggctgcccgcggcctcacctcctccgggggctcggttagcctcctggcgctgcaaggctgcctgcgcgcggttcgctccgggggagggaggaggagggaggcggcgaggagccgacggctccacctgatggagaagcgcggagagtccctagacctcggagtgcgctgcaagaggggagaggagagagaccgccgcccctgctggaagccttcgcgtccgggggcggcgcgcgggggaaggggtctctggacagtcggtggaggcggcagccctacagagacagccgaaagccagcaacttggaaaaccgcccgaattctgggtttctgcacatccaggctggctccaggtctcttgtgcccaccgtgcaagccggcgggatgccagcaggtggcatcctctccagcgtttcttcgccaggcgtggagtccggaggccgaatccatcagtccccagccccctccccaagcctccggtgccaagtgctgggtcctgtgagcccctggcccgccccccacctccgccagcggggcgagccggagctgggtgacccagaccctcgcggaggcgggagcctacagaggatgccggccggccccaggttctgctgctggctggccaagaagtgacaggagggcaaggctcccccggaaagcgtccaagccctgctctcctgctcttccaagccttgctgcgtgttgcccccagggttttctgagatctgggacgaagagagtgatgtgcaaggttctgggtcccggtgcaggagtgaggggtacggctgtcgagtgctcggagcaggctggcgtttgggcacactgcagacctcagctcaccgccactttctcctgaccttcctcgtggctgtcagcccaatgtctatcatgtgttattccctcggtttgttcaaaggcctgttttggatacttaaagacatgtggaataactatgagaattcctgttcctggaaagtttgtcctctagttggaaagaggtatatacaggtctgtatgtgggaaaatattataaaacatctcactgacattttaataagagaaattgccctggatggcatctgtctgggctcttcctttccattagagatgcatccttctaggttagcttgcttggggccctgcaggaaagctgcaggatgaggcaacagtctagggcccccacctgggcccaggcaacagtctagggctcccacctgggcccagtgtccccactgtcctatccttctccatcttccccactgccatgctggccaggctcacagtcacagctattctgtgttcatgagacaccattatcaccaagaagagggagcggctcttttaagagatgggcagtcatcatgtacagagaattgcctgtttaatgcctcttcacagtatttgttgcagagatacattagaaaccgcattccctttttgtttttcatatatcctgccagtactggttaaacctcttttgtccagggatttaacacattttgaacagcctcctactgggagttcagggtaacctgactctccagtcgtaggtaagttaataaggactccaagctacgtacacttccagagaccagatggtcgtcagaggtcctcgctgggtggcagcctttatgacctgggcagtcacagtcttctagcctatttctttttcatttatctgaaccagatttcttgcttacttctgtgtaggtggattacgagaccttaaccctgctccctgcagttggtctttccattgcagagggaaagggctcagagaaccagatattcaactttcagaagcatcccctgaagggcaggttgtctgctcccctgattcattgaggatcaggcctcatggagggagtctggtgagccttttgatgtggcgctggcctggccactgctaaccaatgtggccccttaatgaacctgggcacacctttcttcatctattaaatgatgtgtttgagccagtggatctccaggattcttcagaatcctaaaatcacattgtcttctgttccagaggccacacctttcatcatggagtcaaatggaaatgctctttaatgccatcagtgttagggcagattatttcgagtggtgggtcactatccccaaaaaaacaagtgagcaagtgacaaccctgagatctgtgtgggcctctccactgtcattggttctgacctttcctcaaactgctttgtgttcattctactcagtctgagtgccctcagtctttccccaacttactgaactcattgtctttcccttatctccttgtttccccagaaccagaccccacatccagccttggttctgggttctagaacagacttccttcaacatgcatctacaaccatgttggatgcaaaatgcaaacattttattaaagtaagggagtggtgatgccggagtggctaactggaaaagacttcctttaaagggagcgaggacaaggatgccttgtacgtcttctgtcttaatgtgaatcacactttacagtaaaaattgtttaatcctgtattttctctgataccctggcagccctatgaaggtggggacagcgcccctctagttcacagccgtctccacagctcttacccaggtaggcagtaggctctcactacgtactgctgaatgaatggtaaagttttacctagtgccccacattctatttcctgttttctgaatccaatttaacttattcttccctctgttattaaaccattgtcaaacatctggcatgtgcctgccactgctctggctgtattttatgaggatgggtaatgaattgagcctatatatagtttgcaaaatgtggaaacacactttaagaggcatggcactaaagaaatgaaagatatttttatctcttcagcatcattctgcacaaggatacaattctccagcagcgctgtttaagaacaatagacctgtttagccttgacacgctcatgcatgcagggcactggatactcaattcacatgggagctgcattctctatctcagcaaagacctgaagaatgtgtaatttacagggaagaaaagatataagaaatattatgaaaggagatggcagtgctccatgccttgtgtcattgctggctgggtgcgtaggccaggaccttccgacaagctctggggatggcaccaaaggcaagcttcagcttcattcttcagggtttgaaacaggttgtgtgtcattttggaatataccatgtgctctttttgtggatatgaataggctaattatgtggaaattattggaagacaaagtgaaattccagttacatgactcatttgtgatattcaaagtcttagaaattatactgcatttattcttttcctccattcttctttttcatgcccctcccctgagccatcccccataccccctacctatgttataaattagtaaacttttatagcagccaagggagtgaaagatctcactcaatgttcctttaggctttcttcttagatgacgagttttacttttctttttatttattacatacagtattcctttttccttcccatctttatataataaaattatatataagcatattagatttaagtaatatatgtaacatgcaaagttatataagttcatatatatacaaaactttacatacacacccaaaaaacttttctattaccatgctagcaatcaatgtgcctcctacccaaatattccaaattactcagccctagaccagattttcatcatctctacctgaacttacagcatcctcaactcactgcctagtctgcagactaacaaagaccctctccactgcctaacctactgttctaccacataagtgcattccaaatgcagttctgtaatatcatgcccttgcttaaaaatgtggatggtttctgccctgatctgctcatactgccataacagaatatcataggcggatggcttaaataacagaaattcatgttctcacagttctggaggctgggagtctaagatcaggatgccagcatggccaggttttagtgaaggttctcttcctggcttgtggatggctgctttctcgctgtgtcctcacatggcctgtcctcaaatgtgagacatctgtctgtcctcctcttctcataagcagaccagtcctattggattaggaccccccccccccatatgaccacatttaaccttaatcgcctcctaaaagccctagctccaaatacagtcacattggaggttagggctttaacctatgacttttaggaggatacgattcagttcatagtagtcaccaagatagagcataaacttgttatcatgatatatagggagtgtcaaagcaacatagctttcctgtcctattgccagttccctccttcatagcctgaacctcggtcttgccaaattcctctttattgattagagacagcagacactgttactcttccatacctttcttatacttgtttcctcatcctggtgtgtctttctcctttcctgtgtctttttgcctagtaaataggtactaattgctcgagaatcagctggaatgtcatccatgagaagttcacttcacctcttcctccgctcagtcaaaaatgaattgcctattcatctaggtttccacagtattcttataaactcttattatagaactgtcaatatgctaactatttatttacatgtttaccttccaaactagagatgagatttttaaggccaaggaccacctttcagaatttatttttgcctgttttagagtatatatgggccaatgcctggcgtatggtaattgcttgctaatggtgtttaaataaagaaaaattcagcaaaaactcctgatgtccttcctgtgaccatccaatcccaagcttgaacttttctttcttcatcagctgatgcctttagatcaaactagatctaggaaatttcatatccatcttctggatatgcagctgaaggactggagagaaagatttctgactatacattttgaacctgacccacgttcaggcaaatgtgggtagtggtgccatcagtgtgtataaatcacaagatttatacaagagcctaactctagctcttgcattaaaacaacaacaacaaacaaacaagaaacccggcttattcatatttcttaatggcacaatcccaaatcagttgagaagctatcatactgtataacaagtatgcagacataggttcaaagtaaatgaggaaagccaacattaattttttccacactgagtccaatttgaattgagttgatggttcagtgtttttctgaggtctgcgtctcttctttgtcttcttcagctgctgtctgcctgagattgggagcaggcagaggcagagactcctccttcattttgttttgttgtgctagctcttactggcacaacaaaattggttttttatcgtataaaaatagaggatatagaataatacagtggttcccaacaaggggtccctgggccaacagcatcacatcccctgagaattgcaaatttttaggcaccaccctgggacctcctgaatcaaaacctctgaggtggggcccagatacctgttttctaacaaaactcctagataattctgatgcatattacatttgagaatcaatgttattagaaccaccatgggccatcacttgacaccaacaataaccaagctatggcaaatactgttctatctatcttccctgcttccttctgtctcactggattattctgaagcaaactcagatatcatatcctttcattcgtaatatttccacatgcgataagggctttaatatggatggaaataatacttcatagtatacggttgtcagatatctgatttatccttagaccattcatccttagaatactcaacagccttaatatggtagttttgggtcaaaaaagacagttcaactggataatagtgaaaaaggacctcttttttggaggattaagaatttattattttaaaaatgatgagtttgatcattattaaaagatgaatctgagagtcttagtctgttcaggctgctacaatggaatatcatggactgggtggcttaaacaacagaaatttatttcttagtgtgctggaggctggaagtccgagatcaaagtgcctgcagatccactgtctggtgagggcttcctggtttgcaggtggccatctgtatcctcatgctgcagagagaagagagaggaagctctcctgtctgttctcataagggcactaatcctatttgtaaggctctgcccttatgacctatttacctcccaaaggctccacttcctaataccatcccactggggtttaggatttcaacacatgcaattggggggaacacaaacatccagtccataacaatggggaagaaaaatgaacccacaagaagcaagtcctcaactgagaccctggcaaaataatgtatgccttcaccttgaacgagactgactccttaccatttataaaagtattgcactatctgctacgcatagagtatgtgatctgattgtttccccagaactgtgatagattcacaatctttatctatactcttctgcctgatcttcattctgatccatttgcatttgtataaaaagtggttaaaggtaaaatgcaacccatgaccttgacctaatcttacctgaagaacccaggggtaaaccagtgaccctcttctcataagctgagtgtgcagagattacaaggtagccagttaggctcatcacaggcatatgtcactccctggtctgctcatgtcctattatactccacaagtacttactacactctgagaaactcaagagaatatttgttctcttcttcagatgtctgtggcaaaaactgacacttgcacggagcatgatttgatagcaatatctgcgaagtgtcagaaaggggaggggatcaatacccttaatttacttggaataattcattgcctaactggagttttcagtgagggcagacaaattccacactaaactaactcacccacctggatcgggaggagggcagtgaatccatcttttgaatgagatgtaaagctgagtttcttgctttcattaatgactcccttggtccttcctttcttgagaagaggtgttcatccagtcagccatgtttgaaaatgggagatggatgctactgaccgacagctcccttgcttttcccctgagctgattgcttttgcaatctgccctgatatttgggtatgttgcttgctcagaggctgtcagtttggagctacattccacctcaagaggaaggaaaaatgtagaaaga

SEQ ID NO: 1273 - DNA, 105086 bp, Homo sapiens
acctctcatcctccttgcacttaaaaacttttcatatgaacggatggaataaacgcattaactttaaggtccatatgatagatagggcataaagaatgatgtgttcctgattagttgtaatttaaaaataaggaaactcttaggctaaaacaataaacatttaatagtagaatatcaagtgtttgggagctggttggaaaaatattttgggggctgagttgtgtgttcatgtgcatgtataggcagtggcctgggcatctcagaactgtgccacgaaggtgagcacattttgaagctgtgcctcacagcatgcattagtttctgggcattgactgttgattgggaaacctggggaaaggcacagtcaagatctaatgctcagggctccaaccccagaacaatggcaggacgtggccacgagcccacccaccgaaagcgcctgtacctgagggaatgggtgttccaagcaggggaaaacgaggcagagtatgtgcgttcactccactcacaggccacattatctttttcctcttaggggatctctgcatccttaagtaacttcccagtcatcaaatcagtctttattaaattttcacatgcacttagttttcgattcaatttgaaatgtgctccgaggagcatcatatggactaaataattagctaaagagaaatggtacagcatagattttagagaatggcacagaacagtgcctcttaaataccaccagtagtaactgagggcttttatgtaacacaaagatgtgtacttttattttgagttatttattttcatttttatttaaaggaaaaaatggcttatcagaccagtagttttggggatatttttgctgagaacaaagctaaaacaggtatttgggttttaaaaagtgtgtcaatttaaaaaacgattgaagaagtaataaatagtgcaaggataataaaagaatcttgaaggctgtgctcaagtaactgcagtttaagaaacactgccaagtccaggagagcatcaccgcatatcaatagccctggatttactcctgttgtgcaaaggacgtactatatgaccctggacaagttggaacctctctgaacctcagttgactgaagtagaacggtgacattgaaggagattgccaagatcgcctcccatggtagcatgtggtgatgctattgatattacaggttaccttctgtgtctagtgaggtggaaatggggaaatgatgtcaatcgtgatactatgtctggagacatcatgtacataagcatcaagttgactcctcctcaccctgaagcagtgaggtatagagaaaagtctgccacttactgtgttccctgggccttgatcaagtcacttactctctttgaagcccagtttctctacttgttttttgaattatgtttttaattgacaaataaaaatcatatatatttattgtaaacaacctgttttaaaatgtgtatacattgtggaatggctcagtcaagccataattaacatatgcattacctcatatacttaccatttttgtggtgagaacatttaaaatttattctcttagtgatttttgcacaaatacatttccagtgattatagtgaccatgtagtacaatagatccttgtattcctcctgtagaactgaaattttacatcctttgaccaacatctccccaacccctcctcacttcaaagcccctggtaaccacgattctactctctatgagttcaacttttttagattctgcatataagtgagataatgcaatatttgtctttctgtgcccccagttttaccatttgtgagagcaaatggtcatggtgatgaataatacctattcagtgtatgcagtcttattggactactcaaatgcagtgtacgtaaaatgaaaaatttcagaaacataagtaaatgtttataaaacaaacataaattttgttcttccaccctcctgtaactttgtcatcacttcctcatttttaaatatagtgttgttgtatgtatagctatatcatgatcaggcaaaaaagttaataggttaagttcaagccagtaactgttgatagtttttaaactctcagataaaatatttaatgttggagaaggaattaggaattggctcatggataaaacagaaaaccatcacctgccagtgacctcaaaatcttattttagctaaaagttttaaccatctcctcttctaaacctgtaagtggaaaatgagctacaaataataaattatttatcaattccactgaactctgctttttatgagacttctttccattaccccagcattcccaactccatatacaaccacagattatagctggtacgcaccttcttccccctaggacatgcaggttacactttcagactactgcctgttggattcaaattatagttgtttttgcacttaagaattcttgttaccaagcttgcctagttgatcgtctagttgactaggagataaatatttctagaagatgacacacaaagaacttgcaacttctaaatagggagaacacagaagagaaagtagaatcacccaatataaagtatagagtcattttgtgccagggcaagcaacccggcagtctggagtcatccctgaatttatattatattgtaaaaatggatgctcaaaaaggttgtaaagtgggcaatatatatatttagaccagtcttaagcaaaaatttcatttctaaatatgtaagcttaagtcttttagcatattcacttatgtaaaccatctcatttccttatggcagatagattagacttaccaccctcttgtctgaacatttcagtacagtgcaatttgtccttcacctaaaatgttcaatgtgatatctttttgtaagtcagggagtggaataatgagccttcttctaggtaatattgccaagctatcttatccttcctcactcagagaaatttccaggtaaatgattttggttatcagaatgaaattactcatctagtcccagagctactgaagacacagggagtaggaggcaggtcttcagactccaggggctgtgttttccccactacacatgtggtttcttctcagtcagctttgagctgccgtgttgcccagctcacttgcctgttcgggagatgtggcagctgatgcttaacacttcaaaaccattttcccggcccctgcagcacctactgttctcttcaccttgagttttatgagagcaagaacttgatcactcagcttcccttccaaacccgctgttacactcctgacacctgtttcctgttcagggacatgagaaatgtctgtgtccatgcagcaaattcagtcacactagccacggtttctaaagtaaacatttattggaaagtttcttgtcagattcatttgattagggatagaggttattcaccaccgtatccacttctgtaagtccaaagaatgcaaagaaagcttgactactgctgtgtcccatgtgacaaatgtgttttactgctgtttcctgtgaatgacaccacttctctcggggaatcgctgagctcgggatgctgaggcgacaccaccagctgggttctctaccttcctccttactggtgatgctctttcctggaagtcgtgtgtggcagagattttagtacttttcttttcagttctgagaattttccctggggctttcatctccctctcttctctgggtctgaagctgcttgtatttccatctagttttttgtactctccacagccagctggatttcctggcttccggttacccatttcctccccactccaaccacctcctgtcattttactgccccctacccctcacctaaattattccctctgatctttacccttcctccttcacagactgcttcaaagatcctttcccaataggttcctattaaacaccatcccagaacaaactgcctccttctctcgccaaataaaccgctttcaataagcctctcccaaccccctaaacaaataacatcttgtaatctctatcattctaaaatattgcttttcataatctccaacaattggctccctttttccccttgaagaaataaactcagtgacccttatttgggcattgagctgcctcaatgaaactataaaatacacacatacgcacacacacacacaacttcccaaacgaagataacctaatacaaccttttgctttccctttctccaagaaagaaaactttcacgaagtatgtaagtacccacttgcgtctttcgaagatttttttccccagtgaaacaagctaaggagaaatacagtaaagtattccaaggccaaacacattctactgtttattacacatattacattcttaaataaaaatgcgtcacataacattttttgcatagatatcttacaatataccaatttaaaaaagaattatgaaacagaccagtaacaaaaataaattttttcttcattaataattttgtaacattaacataccaccatcatataatacaaataatagttttaaatcttaagacttttgtacagcaaaaaaacttgacaaagtaatatatttatatatatatatatataaaaagcttaaaaaaaataaaatgtcaaaaaaaggcataaccgagggctataagactgggtacttctgtgatatattataaataccagagaaggcctgagagaatgtgacggggggaggcggggaaggagacggggctgggagtaggtctctccaaacacacttgttagacacatctggcaaaaagaaaatgtatagtgcaaaaataaatttattcaagcaactgttaagaggataatagagatttgaaagaaaagtttcagtggctgggaagttgtgtgggagtaggaagtgggagaaggagcttgacgcgggggcgggtgggggcttgtggaaaggaaggggaggcttcaaaaacattagacatttatttttgcctctgtgttagcaaggagatcttggccattaacaggtgtatttttcctccctggaatgaagcagaagtgaaagataaggaaattaaactaagtctgggtttagataggaaatgcatgctgggaagaaaaaacaaaaaggttgagaaccagccaataagccccaaagccttcaggacctaggtttgcagaaatcgttctgcctccagtccaaaggcctaggtttaaaatgtcccctctgcccacccccaacccctccccgctatgtggaactcccagtgtggtttcgatatactggcaattataagcatccatcccccccaaaagatattaggcactggtggctactcctccgaaacgtcagtagcctgttttccttccgtgaaggtacgacaggtacatatgcgcatgtctaggtgcgagcatatataccaccctcattatgctgacgtggggtccatcttatggcagtagacagaagctggactcacagcaagttacgattccaaagctcacagttgaaaaaaaattgtataaacagtccccaacaaagaacattatcaaccttccctcatgaccactgagagggagccctgtttgaaaagaatatcttgtttgggatatttgtgaagtgatggcccaggatttctctctctgtttttgacacctgtttcccgaggacttttatgttaaatgcaaaacacctgaaaaatacagtactctattggaaggatgcacataagaaagttaactgcagctttatttttcccttttctgggatctattaggaaccaacagaggagatttaagagtgttaaaagcaagaaaaaaccctgaagcctcaggcagttcgtcgtgggaggtcacgttatttacaagaagtttctgcttcctttcacacatttctgttgttccatctcaagtattcccaaagatcctcactgaggaaagtaggccatcaaagagacattgatgtatactcaggataggccctctagttttcaaactgagatatcaccatgttcaccgaaatttaatccagacaccctgaatttgagtcctcccctcctgccccccaactcttgcgcttggcaggtggccacttcccgaaaatgcaaaggaaagcttccaggagtaaatttcaatcaggttctatttactgaatgttcattttggcaatgttctgggtgcaaaattgtagccagaaatgctggccctcttaagatttcaaaaaaattctaataaactaaaaaatgaacctgatttttgtagttaaatgtgttgcatctttatcttactttgcctaccttcttcctgctcctaaaagcaactcatgcaaaagagaagacagaagcacttcccactttttacttaacattttatgaagtgacttccataaaggaaaccattttgaaccatcaaaacgagtcactgggttttgttcttgcaacttgagtttcttttggctttgccataaaatgcaggaataaaggcaagaggcaatgttccgaatgcactggaagagccatccaaaagccccatttctttcccctttgatgcaaatagacatggataatctggaaagcttatcccaaacaaaagtccttataaaatcttctctgaagccagagaagattttttaaaactaggattcagttctgctaatcaggcatgaggttggctgtccttttaccctgttatcatcaggcaatcaaagatgtacaaagggcacaagaggtgcaggtggagaggagatggcgtcgagagaagaggatatttgaagggctttgcaagggaaagcacacagagaggaggaaatggtcagcatgaagttcattttggggtctccaatatttttacaaaaatgcagctttgtcatggaatctgaacatctctttttctggacataatactcattaccaccaggcattgagctgagccattaaccatgggtggggcaggaggccagtagctaggagcagcattataatttcaggtttccatgtctatgacttacagtcatgtggcaggagaaagaagtataatttgaaattacaaaaaaaaaaaattgtcagtggcttagaaactctttttctacatgaacaaatctgaaccctggataaaagcgtgcttgttaggacaccaccagaaacaccaggccgggtttttcctttcaaatttgggatcccctggagggttaggaggtaacaactgaaatgagaaaggggtttaatgtgtttcaaatgtccattaatgcactgttttaaataaccagtcctcttgggagcaaaatgtcttcaggttacttcttggaaaacctgctcgctctagcggctcttagtaaccatctctgccactgcagaggtgatggacgttttattacaaatccatttccaaaatgatcaggactggtcatcattcacaggtgtcaactcggctaaagaagaacagtttcaaagccatccacttagcacccaccaaattcttaggccaattctcacagtcaacaaatgactctgaagcaagcaagcaccaccattgagtttcaatgcaccctgctccaagaaaggtcaggagcagattacaaaggacctcactgatacaaaagagagagaaattactgaacatttcagacactgatgaggaccaaagggcctttgttctgccacattcaaatgagaccacagatgaaaatagggagcaaacaagcaatgattactcttttgcattttttaaactttctttttaatagagccttgcattggtcagttcgaaaattaaattaagtattataaacccttaataatagcattcgagaggcaagagcagctccagcttgggagagaacatttgcaaatcgtggtggccatggcttaatgccatcactggcgtgtgcgtgcattcatgctggaggctgctacataaaggaaaagaaaggaaccaacagaattcagggtgtctaaaagtttcatctagtgcactgactggaggcgctacagtttaatacagctgaggttcaaggtccctcacacatccttcatccaggaaggatgcaccacacattcaaatataatcccatggtacgccctgatggactggccacaaaatgcactcaaatgcagcagagaactacgagattgtcagcaagcagtgctccagaaattgtttttaagtcatgtctagttttaaatctttggaataaaactgatttttaataccctccaactaacatacatacaattgcctccggcaaatggacagattttgtgtgtgtgtgcgcgtgtgtgttaacgggtgttctttctttttttttcgttttgtattattttgtttttttttttgtttttgtttttgttttttttggtctaaatagaaaaaaggaaaaggagaaagtaaattcttagggccagacctcgaaatgccccaagtgtccaattggcagctatagcatttgtgaggaggttcctttgccctcagacgagtagtttcaacatttcagtgaaaacaaaggttgcagaaagctgaaaacccagatcttgaaggttgctgtcatatatgtgtttgtgtttcttatattatttccttttgacttcagttttgcatcccaaatatgtatggggtggcattttaacagtcaatgagtcaaacagtcaaaggaggacaggaggggagccagctggtaggagggagcagcaaccgtgtgtggaccaagcgccatttttgttttatagacgtgtcttgaagggatggtcccagaatatacaaaatatacaatctgtcctaataaccaccccgcttgcttgcataggccatttgatggtcctaaaggcagtctttggagttgaggccagtgccagctagctaggaatgcgggtagatagagaccactactggatgtgtgagtgtggcatgacaagtaaggactgtagactcctttggagtcagcttgcagagtaaatgtgaggcctctgttaatcctgggggttctaggtcacaagtcatggtgggcctagccaaaaaaaaaaggaaagaaagaaacgtgtctctccttttagacagcccatgagagaaacacctcaaccttttccttaaatgtcaacccttcactcccacaatggcgttttaaattgtgtattgtaacacgtaggggaataggagctcagtgggcatgacagagaagacaggatgatcttttgtgaagccactagacttgggaggcatcctcagttttccccactcctggaaagagtgatatttttggctttttgtcaggtcataaaccagagttaaattaaatacgcagctgccctctgagactagcgacatctatgctgtaactggttatggggtagcaatgacacacagcacaacggttgatcactatgagctgaggtcatcatgcctcaaggaggatgagagaactgtgatgtcccatctgactggctgcttcgagagctggacatccaggtgccgagagagtcctggagaggtttagtccatggagaaaagataaaacatttaagcttccaaataagcttttcaagttttcgttagcaaaaacggagagattaaaaagaaaaaatctagcactggcaataaggtgaggctcaagggatatactgtgatttatcatcaaggactttattctcttggccactttgcagtcatgctagaagtttccagaatccctagtgcatatggtgtgcaaaagtcaaaacgtaagaaaagaaaactcctcccttgagagtgaagtctacagaaatgcaggccagaaaggtgtaaggtgttattccagtctgccgccgctaaggccgttgggatcgacgcgaaagatctcaatagtactaagaaccaaaaccagtcaacagttctgtgaggaagtctgacgcacggaatagtaggacttttcacacacaaaggacaaataaaccaagagttaattttggctaccaaactgcaatttggttttctaggtcattttcccccaactatttaaaaagaaacattagtgctacacatatgcaactttaagatgctggattctcctatcaagttgcactgagaagcaagtgaaataagcccctcggactgccgtccacctgcacagacgtcacatccattttctttgatttccattggcaacagcgggaaataattccaatagtgctgaagtaagcagccagtctgccttgctgagttcacctggtttccttcttcatcttcttccatctggctagggcaaggcataaagaatagacgtatatattttaaatatagttgagtgcatgacagtgtgtatgtgtgtgggtctgtgagtgtgtgtatatgtgtgtgtgtgtgtgtgtgtgtacagaggtttataagtgagaactttcttctgcgaggcaatgggtccccgcctgaagtccagccccctgcctcatggcgtttcctttagacactagccgatgccatggcaactctggcctttcggttttttagatatgtctcttcatgtggagggcaagatggtcagacctggaaaaacacctaggagatataaacaacaaggatattagagaactcccagcaaacagcttgacttgcatcactccttaggaaatgatttcccttactttaaacagagacagtgcacatgcattgagaaacagggccatgtgttgggaaggtaagtttaagggacaaaatgtttgggtttaaatcctatctcttccaatagctgtgtgactcggagcacattaacctgtctgtactttaattcctcctcagtagagtggggataattatagcatttacctcataggtgggttgtgaggattaaatgagatgatctatgcaaggtacttagaatacggactggcacatcgtaggatctcagtgcatgttaactgttatgatcataattgtgattattaaagaagaatgggaaagtgcttttgaaacctgtgtcatgcctgcatactgtaaatataataaagaataattagtctatatcatcaaagggtggaactttgaaatttcaacacccagatttcaaccctaaactttacaatgaaagcctagaaatactgcttgtgatactacttacaggcttatcagacactctatattcaagtcaaaaaaaaaaaaaaaaaaggatgaagaagggtgctcacagttattgagtatgttacgatatgtaggcactatgctaagggttttcccaatatcacgccatcctcaccaaccctccatggtaagtattctcacgctttgtgtgtgtgtgtgttgggggcagaaaggaggggggtgaaggaaactgaggctaaggtgtttcttggaacctaaggcccataactgagtgccttcttcatgtcagagtggatccagtggtcatcttctttcctctttcctctaacaccagctatttgatattctcttgggtaccaacccttctgcattctcatttgtgtgaggctgaagttgtggccacagtactctgctaaacaacagccatgtgacctgtaaaggccaatgagaaccagccctgggacatctgctgaaattattggaagagagaagctctctttccactgggatcctggagtgactggtgtctatactgcccttgtggtaaagagttggctggagaatgaagtcaacagagaaaaaggggttctgggggatagaaagagtccagatgataatatcagagaagctggatccaacgaagcctaaagacaaatctaattctgttcttcttagttacctgagcgcataaatacccttggaggctaactgcagtctataacatacagaaacctgacagtatgggtgtttccaaatccctgcaggcttcaatctcaggttctgaatgaaatcccagtgaagtcagcctacatgacagcagtcattctgagctctgagtgtatgctctccccctggatcattcgcctgaaactagctgctttctaacctatgagaaagttcccaggctccctgaagcctgagacacccctacagtccaaaactcctgtcagaatgttagcaagctacactgttcaggttagcagggtttcctgttcagggcaggatttccctatgtttgttcattcttaaaacaaacaaaaaatatccaccctttcccttgaccgcaacattctccacaccccctgtttgtgtccattccttaaataggcacatgtgtaggatagaactccaagggaatgaagtgaaatgggacaagagtaaaacgaaaaccacataaaaatgcgaaaagtacaactgaaaacaatctaatccaataacatgctgcataataacaattccaattatacccacttacttccagccctgactttgtatgaggaagatatttagataatcccttagcgatgcctctaaagggggtttggtttgcaataaaacagtgtcactaagttttctttaaaaactagtactccatgtcactggtacacagaaaaatcaatacagcccgcagggaatttagcgtctaactggcataattcatgtcctgagggtacaactcagtattgcccactgcctgttctctttccctctctccctctctttctccctgccttctttcttccttctttttctctctttccctccttcttttatcccaacaacctggagaaagaagatccaagttgggacattctgtttgtaggtatttcttttttaaatgtaacatccttataagatccctataaagaaggtaccattcttattcccactaccagatgaaacattcatcagaaagaggatttgaacacaggcagtctgacgccagagcccacactcttagtcacatctgcttaaccacattgaggagaagagagaactgggctgtcaatttaaggagcttctggtaggcagaataatgctccctccaaaatgtctacacttcatgcccagacactaggactatgtttggttacatgataaagaattaaagttgtggatggaattaacttatgaatcagctgacattaaacagggagattattctggattgtctggttgggctcaatgccatcacaacggttcttaaaagtgggagaaggaattgatagaaccagagagatgtcagcatgagaaggactcaacagctttaatgatggaggaatagcatcatgagccaaggaatgtgggcagcttctagaagctggaaaaggaaaggaaatggatattcccctagagcctccagaacaaaaatgcagctctgccaaaaccttgagtttagcccagtgagacttgtgttggacttctaacctagaagtttctaacctacagaactgtaagaccataaacttgaaaagtatataaacatgatactaaatttgtggcaagtggtcaaggcagcaactagaaaattaatcctgaggttaggctggtcaggcctgaggaggatgtacctgtgagaagcaacaacgcagacacccagaagcctgcctgtccaagaggaatgctgggatttgagatggtaaggagtgaagagagggcctggcagtgggaaacccctttcctttcctttctatatcctgggaactctcgggaaatgagtattcttgatacagaactttatttgaaagaaccattcagtaatatatgtgttcggctttatatctgcctttaccaattactgggtatttagcaatatatgtataagcatctccctttatccttcaaattcagggaaaaaaaagtggaaaaaagtaaaccaaacctttaacatggtaggaaatgtaactgcacccctactgaatcaaatgagcatcattatttgttcaaattccaaaaaaaaaatgtatgatgctcaggattagaccaggtcccttactattgaggtttttatttaaattcaataccccagcaaggtacttagtcatgattaacttatacttattaatttatacttactgaattccacataggaatagtaaaaggtaatagataaacttggcatctagaagtgcagaatcaaataattttaagagtaatatacccctagagggtatttataactttacagcagccaggtgaccttaaataagaaggtccttaattactgaaatttgtacataatggagaactagtcaaccccacagtcatttctctcgtttatgaaaaaggcacactaggccaggcgtcgtggctcgcgcctgtaatcccagcactttgggaggctgaggtgggtggatcacttgaggtcaggagttcaagaccagcctgaccaacatggcaaaactctgtctttactaaaactacaaaattagccaggcatggtggcaggtacctgtaatcccagcttcttaggaggctgaggcaggagaatcgcctgaaccccggaggcagaggttgcagtgagccgagatcgcaccactgcactccagcctgggcaacaaagccagactgtctcaaatgaaaaaaaaaaaaaaaaaaaaaaaaaaaaaggcacactaacgtcacatagggattaagtcaacagcaatctcctaggtgaccaagaggctaagatacgggctggtatttcttaccacttataagtgggctgacataaagatcaaaatgcaccctctaaactgcccaagaactggaatgtactatgctagtagctgtctccctggattataactgcactgagtcagtcggtagaatgagggcctgcatgttaccactgatggaaactgagccctatctaccaccatcagcagcctccaactctgtgggttgaaaaaccacttatccctctagccactggtcactcaggggggctgcactgtccagtcagatggtgaagaaatggcactactactgtgctttctttcctaacccaaacatgaagccagaagtcacaaaacccagtgtctgcaaggccaggcagataaagtatgtgccgtgggtcaagtgtaagaaacacagcactcttgggctatctgtttccacttccgataaggcatggatacaaagaagtatagctcttcttgtaagaagaaacaacagaaagcgggacaatacttggcaaccaatggcttgcctttgagttgtggagccacagggagtgatgggaacagtggaaacatagtcatcacatggctatggcaaatgggtaatgattgctcttcagctacatccaattacagccacatgggaatgtgagcccactgtggccagatctgatttttccagacaaagccagaaatacaaacttttttgtgtgacatttaacgattttaaatgttggccaaaaaaaaaaaaaaaaccaaaccaaaaacgtcatgaattttttaaaactaccctataggcaaaataaaagcatacgttagacttggtacatgcttaaggaaaggaagtctaaaccctacttaacttctaaatagggcagtgtaattgttcaaattttaagagacaagaggtggtgcactcatatatactgcggtaccaacaggatgccatgtcctgccaagggctacagatgccctctgtttctgaaggtaaacatcttctaaggaatgccaactcccggtcactccaggctttcctttcatctgctttgggaccactccagttccccatgttgcctcccaggcctggctattcttagcacagtcaccgtaattgaaacgccaaggtgctgcctgtcatgagacactaatgggaatacaaactctcatttatgatgctgtcgaaaatgcactattggcctgtgtcgcgggacgctgatctactcaatctcccacaaataccatgttgcagaatttgtaccatctgctcagcaaatttctagctccagaaactgtagtgtattttaaagaagaaaacaaagcaaaagactaaccaaatcacccatctctgacatctctttcagtgaaataaccaatcggtttggaacatttctccacgtaaatcatacaaaagaccagattaaatccaaatacatcaactgctggaaggttgtaaatcaataagtcagttgatttgaagagtggaatactaactttggcaatttccccataagaactctttgtccacatccaataattacggctacccataatgctcacaatctccaagtaacagcctccacacccttcagagctgggcaacttgtgtgtacacgctaccatcacactctgaccactcacaaagaattcaccttggtcccagttgatgtaacagaacactctccttcaaaagactatggacagagagtcaccatctgcagggcttctttattagccagagtgagagaggcacaaagcagagaaacttgagatggaaatagaaggaagatggggaataaggagaaactctcctggagcatactctgtagaagacagctgctgattcatgtaaatacaggaggacttctaggtaatggatggaaatgtaataataacttgtattcttgggtagcagaacagagttccaagggaatgggagacaataactgcataaagtacacttcctcagccctggagtgggaggttatctctgggctccaggacgcatggggtctttatttagtacttagagaatgaagataagaggaaaatagcttcccaggaagaaggaaaaaaaaaggaagaaaaacataactgctcctttataagcatcctaagggagcactaagccaacgtgaccagtctggacaccccttccctattcaccaaacactactacagaggaagccctggtgagggggaggtgtgggacacagggactgggggagacaggatgcaaaagcgatcccatttcctcccaagaaaagccaggcccctgctgccatcctgcaagctggggaaccctgaggctttcaggggcttttatcgtattagaagcatttttctcatcataaccgagacctttagtattgcattaaaaagatggttaattttcttaagcttccttttaaacacagaaataggattagaaggataacacgctcagatgcaagcccattatttgattatgtctaaacctaatcctgccttcaccttggcctgcagagtctccattttggggtttattggttgataatgccagggctgtcagatactattacttgggtagtatctgttgctacgtgctctttcttctactattgaatgcagaaggcttaaaattgaattacaggaggagttctcaaaaccttgtcattttttgcacccttgtacctattttcaaggaagaaagaatgatctgggcccccaaagaatgggaactctgttcagtacaattcatttccaataatgggttcagagaaaagccttatagtgataggaaccctaaccttccttccattaagcaagctttctactctttcttattactatagatgagggaaagtggtactgacattgatacaaagatcagaagtccctacagatgaccattctctgtctcactacttttcatattatactaaagttatctgtcacatcttgttgataccgagtgattaacaccatttctggctcaaagctagtgttctgtaaatgcttgtgtaactgaaccaagaattcacaccacctcttgatttcatgcaagagggcaccccctcttctcactggtcctctccatggagaaaaggcattcccaggtccaagtgtctgtgagtcagacctgtgataagtccaagcacacgggtgctgctcaccctccaacccacttccccatctctcctccctagcccatcaacttctacttctctttacctgtcgcagtggttgcatttgaagggctttgcacctgtgtgtttcctgtagtgcctcgtgagctcatcgcttcgtgcaaaacgccactcacatccctcccatgagcacttataaggcttctcacctgcaagaagagatggaaggaccgtggtcagcagcaggaacaaaagggattacacccaaccagcctgtgctgcctgctggtcaggcttgggaaagggctgtttaactcattcctgaaagactagatttcctaacatagtataccactgtcttttgggttttttttccaaatctcctggtgttttgttttttgttttcttttttgttaaccttcaaaagtggtttcaccagatcctcaaatctggagctgtcattttagttcccagagtcagagcatttcctctgactggtgaaggatcaatttttatttattttcgattccccggagcactttcacccccacagtccaggcagaaaggaaatgtgctattttcatctgaaccacaaatgcttctaattctatttttctccagaacctacactcatttgccatttcaggctttttagtcttctccctccccttccctcctaccacaagctgcagccaggtagctgactgacaaagcaaacagcttaggtctcccagagccaccgttccttccagtaaatgtgatggatggacaatgaggagaaaggtctacaatttcagagtaaaacaaaaatcacttgacaatccctggcatttatggaaaatactatcacaaaagtctgagttaggaagctcatagcttaacaactgcagagtgttcttattagagaataatatacattattgtaaaatattttcaaaatcaatttggagagcaaggttttagccacagggaagctgcttataagcatgaaattcaaacacttgtgctcaagtgaccttttcacacagtaaatacagatggaaggatatgtaagagcaagtacatgactttgccttagaccttttttttaactcatcatgtctgtcaccaaacatgacaaatatttacccttccaactgtatggtggactggttctaattaaaaagaaaaataatctttggaaacctgtgaaatcatgaagctgagttactgagccccgtcactgagaggcaggttagtatgtggttaagagctttgaagccaaacttcttgggatcagcttctagttctgtccttaattgtctgaccttgggcaggttaacaaacctctgtgtgtctctgttttcttagagataataataataggtacctcaaagggtttagagaagataaatcaatacacatgcatattatatattaattagaacaatgcctggcatatgtaagagtcacataactaataaacattaaaaaccgccaaactcaaagtttcaggatacctaggtgccaaagtactatggcatcccattatttccccagttttaaaagctaaatctttactaggcagccctgaaggagacattacccaggtactatacttgacctactttcttctttccacctttccccttccctttaaacctgactacaaagcattcacaattctttatttgtatcacctagaatcaaaccaaacatgcttgaaaattttatttcattaaattggtgccctagtgagccactgctctgtaagacccacagagaaggggaacgagaaacacgggcatttcttttaaagggaaccaagaggacatgaaggagggctggaggcacaggaggaaacccattcagttttggaaaccaggaaaaaaagaggatgaatcactgagcagtgttaaaagttcaccttctggctcctttaagccaaaagtttagaaaagatgtgctggctgaagaaaaggtagccaagtggaggtgccacataacctttggagtcagcctacttgggatcttgctgcgttcattccagactctagaactcagtgtatttgtctgttaaacgagggtgagcttattaataaatccatgtttatagtgaggtttcaatcagttgtgcgtaagaaacgtttgttcagccttgcatgcagtcagtattcagttcctgtctcaactccctttcctctgcctgtgttcacagaggttactaggaagacaggccctgaaatcgctgtcaataaaatccttcagagctcatggctccagaaagccaagtctacagacatgctgggtatctgaaatattagaaacagagagtcttttaagtattttctcagcatattgatggagaatgaatccaaaacagggagtgttctttaggactgctctgaatgagtaggacacacaaagggaagtaagagatcccagcaccctgcaggagagacatgttagcatcatgtatttaatgctgctgatcacccactaggctctgttatctcaaggggaaatctggcacaaacaaaaaaaggagaatgaggcacctaagactttggaaattcaaaacgccctccacccatgaaggccttcgaatgtagttaaaactggaggttcctggaaccttggggaccaaacacacttccaatgcaatgaggcacctaggaaattccatgaaattctacagcaacaagcagagacatctagttcccagaatcaatcccaaaatcgaactgacttgtctatcacaggcaaccacattctgaaggacacaggaagggcagataaaatgaagaagactgaagtggacgtctttggatattttttcccatttcaaactgtttgcttttccccttgctgaattcctttaactagtttcattttgacaaataatatcaaggatatagttcttttccagaaaatgataagactcttagttacttcccagtacaaaccaactctccaacccaggagctatttcagtgtcctcgtggctgtgtccactattgagaaactgcagatagcttgacttagctctgaatcttatcacctgacattgtttcctgcttgcggcaaacactactcagaataatactgaggacaggctcctttgtgccctgatattttagccatgttactattatagtgatttatcaagctatttttccaccatctggctagtttactgacaagttgccattcctgcaaatactaataaaaaatttaaaataatcaagaatgcccaatgaaggagcagtgcctgaaggcagaactcagaaatcagagaagcagaaaaaatatatataaagaattgggaatatgactttatatttagggcacaggaattgtggagttagactggccttgtttccaggttctatacccacctctataaaccaattcctactggaaaggcaggtcagggaaattcttctgtcagtattttcagcatggccaagactgcatctccctaaacaccaacagccacagcttgatcttggagggtggacatatctgtagccatgatacatttgttttcatccttaaaagcctacctgaagatttctgctcatttcatcaaaggctgaatttctttctttataaaagaaaaaaagaaaggctttctttatgagagagaggaaaactgcacgtcagtggtaccagagcaggtttcatgcaaaatcagctcttctctttcactctcccttctttcactttcccttctctccttcctccactccagatacttctcctgggtataaaacagaaactgtcatggccttgcacaacactatgctgtatcgcacttggaatgatgcacactgttcagctcactgcacctctagagtgaacaaaaatgctcaagagtggtctatgtgagacaggtagatggaagagagacttaaaaacccaggactccagtccaggaagggcatgtgagtgaaggcaaggacaccacccagagggtgggtgaggcagtgaggctgtgcccccacagctcacaatgctggaggcagaggacaccctcaggacctcctaaatgtcagggtgaatatcaagaaccactttctctgtctggcaacaaccctaggatacttgtttccctgggggagtagtatatgccacctcagaagtgagagtaagtctcatgaggtgaaaacagacttatagccagatgagggctcgtaaggagaggtaagggtgcttgagaaacaggactgacatttagagaggttaaatcacgtcaagaactcgcgttctcccacaaaattcatctgaaatgaaatgtggtctaaaccagtgtggcattttgttagtttcttacagggtcactctccctatatcgtgatcatcagaattgactgatcaaaaaacactgccataaatactttttgagcatgcatctatgatatatgtaggcttattcatgaaccatacagatgtactaatgttctattaggatattataaaatatatattcaatagaccaattaaaaatgagaataaattaaatataaatagaagtcatacatatttcttcttgccttcaaaaagactgtgttgcacaaccctacttctggccactgccctgtaggataaataaaaatagctttgctctcagccccaccatctcactggtcttaggccttccattcatggctcctacagtctattctacttataacagtcaaagcaatcctttgaaaatgtaaatcagagcataagtgactcttacagggggccttagtctatatatttccatataaatggtctctttgacatccactggattttatgcatttaaaaacattattctgcaaagggttccacaggttttgccagactgccaaagacattcacccaaaaaaaggttaagatgaaattaaagtgtaaaagttccaatggttttctatcgttctcagaaaaaaagtcaaaagccaggcaaggctctacagtacagcctgcatgatctggctcctggctacctctccaatatcatctcctacgctcccctccccgattcaccacattgctgccctgcctgcaggctcccacctcgaggcctttgcactggctcctcgctctgcctggaacactcttgctccctcacttcattccggtctctgcctgaatgtctcctcctcttagagaacttccttcactatcctctgtaaaacagcagattctgtcactttctccatagcacttaattactttgaaatgcagttgcacattgtttgagtgtattatagtctgtttccctcaccagagcataagcttcatgcagacatccattttgttcactgtgataccaacagcactaaagcagtgcttggctcaatcccgtccgatacattaggtgaatttaacaaagcatcctgatttgcaacaaaaacctgaatacacctagaggggcagaacagcctgtgtgatttccagtccctcactttctaggtattaaactggtttacgaggggaaatgtttgcttggttgcttaaatctgatatccttctttgacaaggactaaaatgtggtaagttttcctttaccattaaatatcacttctacttcttccctatcttccacagcctaaaagacgaggatcctgaaaacttcctgtaacttaatctcacacataggaacctatcctcctgagcaatatcccctctgggaagcaaagtgcgtcattttatgaaactcatttgtaatgtttatctctgaagatgtatttgagacagcataagtgatatgtcaaatgtactgtgctataaatttgcctttaagatagagagtgtagcataaaatatgaacacgtggcagaatcttgcactcaaggtttaaaatctgttgaaaataaactcactaatacaaatgttctgcattcatttcctgatctgcaaaatttcaaattcttaatgcaagttctaaagagattaggattttgacctgcctagatttctgttaagactaattttacctgtttccttttatttatttatttttttaatgtggttctagacatttaggtatgtcaaggtcctagtctcttgaggacttggattaagaatttggaaactctgcagatcaggaaatggaaaagaaaactggaaaagaggaatactttgcaatgagttaatactgctgcctaatacatctcgaagaaatcagcaaagacccatcaattgctttcacatcacactcagtcgcactagagaatttaagcaagctggagaataaagacattgtagagaaagtgtcactaagctttctcagcaatggaaacagagtaaccggtgaatttcactccatagcttgtcaatgtcttctcaacctgtaggtgatgcaactaaaaaatacctatgctaagtcactgtatctgctttggaaaattgtctcagagcccctcttagattccagctgggtcttaaatattttttttcaaggttttttgcgtatctgattgatggaaaataaaaattcttttatagaattcccaaaacatttataataactactacataaattaaaatgtactcattgatgatccatgtggctttttcattcatccattacttgcttactcaaacgaggtccaagtacctgagtttacacagtgcaccagtcactttacagagcatgcaaacatttgccctatttgtttttattctttttttttttttttttttttttttctgagacggagtctcgctctgttgcccaggctggagtgcagtggcgcgatctcggctcactgcaagctccgcctcctgggttcacgccattctcctgcctcagcctcccaagtaccgagtagctgggactacaggctccagccaccacgtccagctaatttttttgtaattttagtggagacagggtttcaccgtggtagccaggatggtcttgatctcctgacctcgtgatccgcccgcctcggcctcccaaagtgctgggattacaggcgtgagccaccacgcccggcctgtttttgttcttaaaacaactaaaaaacaataactggtcctgggttaggtttactcctcaccaccttaaaatgtttgttcaaaaatctgtaatccaaaatttaaaccatatcctcaatgaggtacagctcctacttcagaatacggagagaggtgagaaaagattttgactgaatactgcaactgctgacaacaattgtgtttgtgttcaatatagtagccagtagccacacatagcaacgagcgcttgaaatgttgctgaggtaactaaaaaactgaacttttaatttaaccttgattaaaattcagattaaaaaattgaagcagtgtaaaaatatttcacactcttattttggtagaactgcatttaactttcaccattgaaaatttagcatgagataccctggaaacatacaatacacactggatctcaaggaattagtattaaaaaagaatgtaaaatatttctcactaataactgtttaaatattgattttatgttgaaatgattatattttagatatattaatttaggtaaaacatattaaaattaattttaccttttatttaacttttttaaaaatgagattactagaaaatttaaagttacatatgtggtttgcatatatttctattttggacagcactggcttaaaatatattttctacgtagaaaccccatcgactcaagcttaaaagctcatccttcccgtatttttctccatgtccagcccatagcctagaatcccagtgttcccatttttacattccaacccgtggtagaagcactctcccaggctcaaaatcttagagttatttttaactgtgagaaagctaggggaggaaggactcagtaaacaagtccaagtactccacctttgtggaatctctcctccccacccctggcttttattctcattactaccaaccttgtcgtgtacaagaccctgaatgcttcaccaaatgcaaccaacagcagcccttctctgtttcgagggatctcctccctgttgctgcatcgcatcaggatcacctgaggcacttattaaaaatgcagattccgagttcccatctcagaccttgcgtatcagaatctgtttttagcatctctgtttatgggttcaggaatctgaagaaatgacatttaagctgagatacgaaggaggagttaaccaggtgcagtgggaagaaagctctgcagatttaaaaagcagcacataccaaggccctgggagcagaagcagcttggtgcttttcagaaacagtcataaaaccaaaaggctcaaagaagccttcttctctgatccccaccccacccccaaacttaatagaacgtttggagcctctctcactggccaggatgtgaattttgtgagggcaggggccacatttgacttgttcgccactttatccacagtggctagcacaaacgttatacacagtagatgctcagataatacacttatttacatataggacccataaaagtgccattaagaaacacaaaataatatttctctttaaattgttctcatcccctatatccatctctctttccataagcagtcctctagcaacagtggttctcaaacttattagaattccctaaagggcttgtttaaaacacaggttagtgaaccccaccctgagaagttctgattcagtaggtctgattcacaaggggagggcccaagaatctgcatttctaacaaattcccagctgatgctgatgctgctgctccagagaccatacctcaagaaccattgctgtagtggggaaataaaatgaactcagcatcaaaaaatagattattctagttctggctctgccacataatagcaatgtggccttgtaaaggtatttaataacttctttggggacttatggctcttaactgtgtggggaaggaattaaaaaaaaaaaactgtcccacttccctatactcatgaagattcgatggaacctagtacctgaaagtgactggtcagttacaaagtcccaaatgaataaaaagtgttattaacggtgtttgttattaaagttgctattcatagtggtgatatcaacagggagtttacagacacacaggaagccagagagagatgtggaaacagagaactttgtcacctgtatgtccagggcaaaggcacagggcttctctataagactcaaactggagcccagcctgccccgtggagcacagccatggaaatacacgggactaaagaaatcctttggggtcatgtgccatttttaacaactgttaactttttctaaaatgtttcttttgagacaaagtgttagattcttggtgaatttgtttgaaatgttggaggaagactgtgttggtcatgaaaattacttaccaacccagatgctgaaacaaatttagctgttgaaaattaaagaatttttgtaatgtgtaatttgttattccaatacatgtgttttcaaatactgtaccatgtttctcataacccaaggaatgccataaaattattttttatttaattaaaaatgtatgcagtcttctagtagtttctagtgggctgagtgaggtttagccaacaaacaccactgctccccaccaccccgacacaaggcaaaacaaaaactcataactgtttaggtattactataattttcaaaagactgtaaactcacttaagaatttagacctcaacaacacttatacctgaagctgtatgttctcaagttttgaaacaggtaagcatgatcatttggggaaactatatttattattttttttaagcaacaagtttaatttgcttgccttttttgtccattttactttgtttttgttctttttgtttttcaaggttaacttcaaaaattatttttatcagcttttttggagttaaatccaaataaaacttaatgtcatcttggaaatttaaatatattttggtgattaccagttacaataaagttaaaagctaggtatatactaaatttgaagaaaaatgttattaaaacattaatctttccctttcaagatgacaactacaccaagtgaatctgtttgaaactcatttgtagaacattttctttccatttagcagcaatgttatcactctgtaagtcaagttctcacaattcaatttgatgtattaaatagaaatttgattattaaaaaacgtcaattttaaactcacctttggtcaacctttgctttttgttttcaaatgtaaagatcaccatacagcagagaacgtatacaggaacagactcttactacaatgaccaagctattattattattattattttccttagagacagagtctcactctgttgcccagactggagtgcaggggtgcaatcacaactcactgcaactttgaactcctgagttcagcctcccaaagtagctgggactacaggctctggtgccaccacacttggctaattttttttttttttttttttttgtagagacgatgcctcccaatgctgcacaggccggtcttgaactcctggcctgaagtgatcccccgacctcagcctcccaaagcactaagattacagatatgagccactgtgtctattcccaaactattaatttttgaatcaccttaaaagattttcagaatgaagagaaaaaaaatcacttttactccaaacaacacgttccaagcatgggtaatatcaaggcatcactctgaaagtgataccactaaatcagaagtataccctgtagaagtaaaccaacagagaaaaggaaacttcccctaaaaatgcagtcaattccagaggttggcaaaaggtgtacaactcctagtgagtatagccaaggaattcatttttcttgcaaggagggtggtactaagaaaaagataatcagagagcacacagctttgagggagggtaggtctgcatgacaccctactggggaggcttttggaaagcctgagggcaggtgagaggactgtgtgtctgtgaaccacagaaaatgcagagacatggagggccaggacaggtggggaggggagactaaactaggccttatcagatcagggacccatggtggtcacccattggtacgtatcacattagttgacaatgtctaatttactttcctggatacactaaattttgcttttttgctaaccaaaaatttagaaaatatacacctaaaccatttattatttggataaaagttaactttctgctacatatgcgatatatatatatatatatatatgaaaagagatagatcaatggtattaaaaaaaaaaccataagaaaggataatccaaaaaccacctaagatctgcttctggaagctataaagtaagtggcttcagcatcctaaatttgttttaattaagctaatgataacaaaaattgatattccttgatgatataaatacagatggtagagaagtagcttaagcatatcactagttcatatggtaattttctctaaacttaaaaaaataaaggcaatgttatcaatcttcaagaagcccaaatgagatcagatgtggtggctcacacctgtaatcccagcactttgggaggccatagcaggcagatcacctgagcccaggagtttgagaccagcccaggcaatgtggtaggtccctgtctctacaaaaaattaaaaaattagctgggcatggtggtgcacgcctgtagtcccagctacttgggagactgaggtgagaggatcacttgagcaggggaggctgaggctgcagtaagcagtaagctgtggttgcaccactgcactctagcctgggtgacagagcgagaccatgtctcaaaaaaaagaagagcccaaattagataatttatatccagatcatggagagaagggccctccctgggccagctaccattcatgttgaatagatattaatccgttttttagagctttttagaggcaaatttcaaatcagtgaagatttaaaacatcaatatgtctacataattctcttccaagatgattaaacatttttttagagactaaatttccccattagctaaagcaacccaaatatgtaccttactcaaatataaagtctaagagtaaccccaaaagaaaattttcatttgtttgttgttttgacacataataatctaggatagacgctcttcacataccactgcctatgtactcaggaaaagatgtacacaaagccatgtcacttatttttctaccttatcacccatcacttcttacataaccctctagtctccaacatccctagacagcccccgctccccaactcccgcccaagcctttctcactcgctgggatgtcccctgctcagaatgtgcctattctccacatgtcaccccatccgcaaggatttctcctcctcagaaaactatacccttatctaagttttcactctttggccagttatttactatttcctgtagatatttatctttttatgccttgatcccttgccctgcttctccccacacacattaaatgaaaagtgcttttaaaacaaggacaccttatacccccagtggaataaatgctgattaaatatctagtgtatgtccaggcactgggctagatgctttctcattggcctctttgtaatcacgcacaaagtctagcacaggctcagacacactgtaacatgcactgaatacaatgtttgctaactgagacatcagaccatcaaaatccaacagcacgaaaagttttgttaccaccttaccttccagattcataaaccctaacatgcattatctccgaaacacttcatctctgtccatgggtaaacaggaaaagtcaaatgcttagacttctggtctaactcaccggcaatgaaagaaatagtctcttcagtgtgacaagttagattcaaccagcattaattgttggttcaaatatatgccaaccaatgacactgctagagattaaagctaaatggaaaggctcttcacgttagagctcagctcccagttaggaaagcaccatgcatacatacaaagaacatgagactcaatatgtttgatagatgtgtgtaatgtggacatgtgaaacagaaaatccctaagacttggtaagactattagagcaggtgtcccagagatgatcagcccccctgaaacttgaaggacactaaggacaagggcaagaagtatttcctggagaaggaacagcatgcacaaaggcccagagataagagacagtggtttatcatcctgaggtcaagggtaagtatgtgaggaggacccttaagaatggactgaagaggtggtaatgccaaaccctgaggaaccttgatgacaaactatcccctcaagagactgactcccttgaggccagaccccacatctgtgcatagttgtgtcctcagggcctggcacaatgtgtggtcctagtacttccaaagcatgtcctgtgggaagtggctctagatggactctgatagagttgggcactcctttcttctgctcgcctaacttcctctagaagagactatcatattgtttgagtaaattgtttacattctatgtagctccacaaaaccaaatggtccctttaagggcagaggccaggcttattcaccttagtattcccaagacttagaatgctggacacatgtcaaagaccctcaattaacctggctgaatgaacatacccatatactattggtccatctccataccttcctttaagcagttacctagatcttcctacatcttctttctgctgctccctaataggaatcattgggaagaaaacacaatgactgaaaccacccgtgaaagctacattcacattcacacacacacacacacacacacacacacacaccctgccctcccccccaatctgcaaacaactcagcacaaacatattgacacccacatatgtagaaacacccccacacaatctgtcatcctatatacctctaacctcaaacagccttaatttttgtctgtactgaactcacagctacaaaataatttctcttcattcttctactgaagaatgaaggcattctgggaggaaaatgtcaatgtaatgtgactttatactttggaagggggaaaaagaggtgcaagaaatattaagatgcagttaatttgactccatatgcttttgtgcttaagttattaatttcccagtcacttcatattactccagtaatgtaatgttctcatgaaatgcaaaatgtaaattatgtttccattcagaacttaagccattccacagaaacctagttttcatgcaattattttgatcttgcaatatgccacaaactacaatgtactaggatgttacccttaccatttcatacatttagaatttcagaactcaagttttctgttaaaatgtctgcattaaaggctttttaaaaagaattattaagactaaaagcatagcagcaaccgccagttgtcctctatattcattctccccttatccctaggtaagagtatcccttggtttttgttgagcttatggccacccagaacaaagactgtatttccaatctcctttgcaattgcttgttgacatatgaccaagttctggctgatgagacgtaagtggcagtggcaagtgcaatgtcaagctgtacttttatttatttatttttgagacagagtctcgctctgtcacccaggttggagtgcagtggcgtgatcttagctcaccgcaacctcccctccctggttcaagtgattctcctgcctcagcctcctgagtagctgggattacaggtgcccgccaccacacccagctaatttttgtatttttagtagagacagggtttcactatgttgaccaggctggtctcaaactcctgacctcaggtgatccacctgtcttggcctcccaaactgctgggattacaggtgtgagccatcacggccaatcaagctgtacttttaaaggtagggacatcccctccccttttcactttcgaaatatctgcatgaaaactagattcctggaaagcaggcctggtggcagccatcttgaattgcagggacctgagcaatacctcaggaatggaaatcctagggataggtgaccaacagaacaaaaggagtttgggcttctgacagttctcagtgcagactttatattaaagagaaaaaagaaatcttacatctttaagctcctgttagcttgggtctttgtcacaaaagcttcatttaggatctaattaattcaaagcttaacatacatgaacaaaggaaatctcgcttcttttctccagaaaggttgtcagagttctggagatgttgccccatgtgtacaagtacagtttacgggaaaacagacacacacacacaactcaccatcaggagacctgtgctctagtcctagctgttaccacttatgatgtgccctcaggaaagttacctactctttaagtctcactttcctcctctgcaaaatagagctaatcccttcttcagcacagccctcgcaggattatcgtgaaatgtgaagagagatgctttctgtgcagatgcttcatatgctgcaaagcaccacacaggcagcgtaattattaaaacattttatcccaaaatccttctttatgcaacgtgggtcttattaacacccagtacctgaatatacctttctggtgaataaagagcctgcaatcacctgattctagctaagatggttagagatcagtttgagatgttaggagcagaccacctccagaggctggtgtttcattcaaccatcaaagacgtcaagccccaactcctcaacttaaatgtggcattgattagaaagtcaaagggttttacccaaacagtacaaacccaataccacatggagagaaactgcccagagcccatatactactaaaatatggtgcatatcttactacatctcatatctcatctgctgtgatatatgtggctttttctattagatgtatgaatatacgagtggcagaatcaatctctgatgaaatgtctatattttccttcctcgtgtagatacacatatagcagaaaactaagtgtaggggaaaggtacaaaatgttatacgtaaacaaactagacaatacatgcatctctgtggagaaaacacctcaaatcatcaacatcagccaagacttgtggtccaattccacccaccttcaatgggtgatagggttttttaaatccaagtaaaattagctgttggctagtatttactgggccctcactatatgctgggcactacagaacctaagggctttatgtatattctgtcctctaattctctcaatagccctaatgctattatccctccccattttctagatgaggaaatagagggttggagaaataaagctgttccccaagttcacccaacttatatgtggtacagtcaagattgaaactcaggccatcttaccttcagaattcacatgcttaaccactacctcactctgcctttcatataagcagcaacaattaaagtggaatcaatgctcatattccctttggaaatattttctgataaaacaaatgtttcaactggaaagaatgtcagaactatttagatgcacctatataatagctgttctaactctttaaaaaggaataagcaaaggaatcgaatctactgagacaggaagccaggagtgcgaactacaactcatctaccctcccctagaacccatggtctcattttcagctcacagaatggtactactgactactagaacttagtgtgggtagaaaaattttttttcagagaatacctcatattaacaactttaccagcattttcatttcattccgtcaccttctcaaaaaaatcggtgtcacttaacaagttctacataaaccaaaaatggaaaccccgaaggccaacagcaaagcaaggatttcattcttaacccgcacctcagtgtgagatgagctgaagcttcatttctacctgccgcccctttctgaagggtaggtactgactgggctggagtgaaggagaaacaccaggtgataacatcactgttcctggcatgttctttatgtatcaggcagcccgatggtgctttacctgtgctatttcacagaaggcttgcaaggtaggtggtgatgtttccatcttagggaggggaacatggaagcccagggatagacacccagctaataagtggctgagatgactttttaagtctgggtctgactccaaagcctgttctcctgcagcatcatgctggggttttctagaagccaagaaagggacacagaagcaaaagaccccacccttcttccatcacagtccatcctatttgctgtgccagaaagccctgaagaagggtagaatgtggatggctccatgttgggctgtttcctccaattcattagcaggggtgaggtcctctcatccctctgctacattctctcccacacctcaccaagaagctgatcaaagaggagtatcagtttgtgtgctctgcagggactgagagaacaggcagtggccagactgtgaaaggacttaaacagacctgcacgatccagtctcctagaccctagcacaggtggctactgagtacccaaaatgtgagcactctgaactgaatgtgctctaagtgtaaaatacgcaccagattttgaaggctttccaatagaagaaagagataaggaaatgtaaaacagctcattaataattgtttatcaattatttacatgttgaaatgagaatgttttggatattttgagctaaataaaatacagtattagaactaattagtatgattaattactttttaaatgtgcatgctagaaaatataaaattatatatgtggctcacattacatttctattggaaagtggtcttaagagatcatgttcaagaatttgtactttaagaacaatggcagccattgtgagcttttaaacgggggcataacatgatcagaattgaactttaaaacattactctagctacaaaatggagaatgggctgccaaaggcaatgagccaatgtggggagagttctacaacttctacgaggttctacaactgccaaggagaaagaagatagtgcctgaaacacaaatgactctgcttattgcagcagagatggagaaaagcaaacaaatgtaaaacatatttagaaagcagtgcccatgagatgaaaaaaaattgattgaaaggacatctatcacagatgcctcccagggttttgctatgagctgagtggatgggccattcagcattcatcgtctggtatttatgcatctacgaaaaaaaatggtcaatcaagtatcctagggtcacaacagcctttctccatgaagttcccctgcaagaagcgtgaatcatacatgctctggggactttggaactcgtgcatgctgttccaaagtgctttccttctgaagagctcccagaagaagtgcctcaagattttgccaagtcaagaaacactttggaaagctgtcggaaatgatggtaatggatgctaagacccggaaataggctgaaagcacagagagtgggatggagtggggtggaagaagggtggggtctgctccactgtccctttcttggccttttctctaggaaatgccagcataatgctgcaggggacaggctttggagtcagacccagactcaaaagccagcttggtcacttataagctgggcatgtctactcttgggatcttctaggcttccacgttctcatgcctaagatgggaaaatcaccacctaccttgtaaggatttcacgaaatggctgttatcattcaggctttctcttccactccagccacgtcaatacctgccccgtaggaagggatatcgggtgtaaacaaaacttcagggcatctcacctctcacaggtgaaagcatgacaaatctcaagaaagactaggtgggttgttttggtgttaactgcacagagaaccaaacagcaccccacagctgctgtggcatcggaggcctgctccttccagggcaagcattatcatgaataattaaagccaagctctgcttatcaaaataaatgaacaaaggacgcctctgacacagcagttcccccaccccaatcttttttgttttaggagccactttttctcagctactgctcctaccaatctgatgatcttcagcggcatccctatcaatttgggtaaattagcaagcttctcctccatatggagctgcggccgtaaatcacaaatatgagtgtgtgtaaaattatatagcataggcccagtgtaataataaacacatttatattttataactgctgttttctccaccttcaagccgcatcattgcctgggccccagaggttcctaagcactccccaccggctcctgtgtgcagccgtcttgctttgtgtgcaatttccttccccctcgtcacagaccgctatctgccaaatgccagccggctcttctttgtgctgcggtgggcaaggaaccataccagctcacagttctctctgcagcagaacacagacacaaatgagcaggtgacctctcaaaccgtgtcaaaacggacccttgacccagagacctcaaaacttcagtgggttcgctgtctaaatcacccaactaaaaagacctatgtttgcacaacgtgattgtgtttacacaaagatttaacgcctcaatagagcaaaagctgttcagttaattttaattattgctttactcttctcgcaacagatttttaaaaaaatgcttaacggtgagcttgtggtaattgatcccacaagctttgtacctatggtccttgtagctcatacaatgacaggagtgggaaggatgtatgaaaagttttccctggctgcaaaggattctttctggctttgctcattaactattctttttggataaggtgcacaccaggaaaaccacaaaaacaaaaataaaaacaaaaacaaaaactttaacatctaaccatgagaggggggagaaagatacacaggtggatttgaaagcattctaaatgcttagtagccaattatcagcaaggaaaaggctattatcaaattgggttgggggccccgccaattctaacgacttattaagattatttccacggcaggtagaatgaaataaaaaggggaagtttgaaaatacaaagatgtacaggaacacaggatcacacacaaaaatatctacagacaaacaatcctcaaaagagtggagccctcaggggtaatgtgtgttattccttcagccttccaggaatttgtcttttggtgttaataccttttctttcctcagatctctggatataatataaatgcccatcactctgaggttcctgtagatccttttggcagaatgctagaaagcagctattcttcttcactgtgtgcttttctgaattcagaggagagactgctgcacataacaagcaaaatcataacctgagtttgggatctttgccaatgaatagatttacaattcctgtatttaccaagggtttttattcttacgacttctaacccattataaatatcctcaactgggcaaaaacaaagataaaataaaattatcctgaattccacacttatcatacaaacaaaaataaaggcacataaatcatttcttcaacctcacctagcaaagctctggtgtaactgagaggagcatacaactcatacaccaagatccacccatccatagattcctttgaattctttaaggcatctccatttgggttttccagcttagtaataaagaggattgctaagatgcattctttcaaggggttcagagaaaagtttctatttgctatttctcatcaagaattatctaaaatatgcaaatgcagtagtactgagataccacttcaagaatcaataccttgcgtttgtttgcatcttcaaaaccagctttctttcttaaaataggggaaaaccaactaagatcaaggattcttaagttcaaccaaaatagacagaatgtaggaatatacaagataatcactcagttttcttagctattctgaattagtagttatactgaacaagtaaaataacaacaaatagccatttatttttctgaaccataaacaaaactgaattcatttatattgtttcaacttaggcccccaaaagaaataactgatctctaaaggaaaaacagagtagggcaggctctgtgatggttcagcagtgaaatctttgaaaaatgattctttcagcctcagttcccttatttgtacaatgggtataatgagaagacttacctcatcggtaagtgaaggttaaatggaaggatgtatgtgaaacacttggcaactgtaaagatcaatacaagtgatattattattgcttacttgggtaatgcactaacatagaagcagccattcccaggcttggtacccaattgccttcttactcccaaagctgatctgagtaggaacgcctcagcttaccctttctttagcacatctgctctgggaagctgactaagtaacccactgcatcttcaggccatcaagataatattactaattccctactggatctaaaactaaggtccgataacaactgtgatccaaaacatggcacttagcatgaccccacaaggccagctcactaatggcaatctcttcaagtggcaagggataagctaatacatgtaaaagccacagatgtcacgtgctccctacagccacattcacatgtatgagaggaataaagtcagcagtattatctccaaacagcaaggacaatgccatacgattataatagcatattgtccattgtatctggggatgacacgtctgacaatgttattttctatgcacgtgaatgtagctgaaagggccaatgcataattcacagctcctgacaaaatgcagacataaagtatgtgtccattagataaggcaatttaaatccttttacctgaaatagcacctttctccctaagaactcagaaagcttccagtatgctcctcatggtgctggtgcgaaccagaacagtgaatagtaggaaatgtactgaggcagcaaatgccagcgcaatatacagttttaccaataaaagttttattttcccacggaaagcacgtcactcttatttcttcactaacagttaatcttctttttggtaacgaggaagcaactgttacatttcagcaaggccactgtacccagggggagaatgacaataccatatgatggtgtggctcttcagtgcgtggtcagctaggcccatttcctggcaaagcacctccctcccacgtaccagcctggcagctgatgtgatcagacctctgcctcagcaaaatctcaaattattacaggtcaggagccttctgcaaaaggggagggcatgaggctcaggaagagtcacaatcacgaatcttcaatctagaaggttaagcatttagtggaggtagggagatttctttcttaccataaggggaaaagcggcacatcatctaaatcctgacagaaataataaataatgcaatatttccatttagtcaatattgttaaagatcataaaagggaagaaggcaagacctggtgggtaggtcatcttaaaaggattaggaaacgttttgcaagtggatcagagcaacctacagagaagaagacagctaaggttgcattaggccagggtttctcaaccttggcactgttgacccttgggcccacatgatcctttgctgtggaagttgtcctgggcattgtaggatacttagcagtatccctgccctctacttcccagatgccagtagcatacccccaaccccacatatgaccatgaaaaatgtctccagacattgctaaatgttccctgagggaaaaaatctcccctggttgagaaccaccacattaggcaactaatgatctcacattttgggagagtggctggaccaaaagatttgctgtcacacataatggcctcttcagacattgacaggatgtcccgataccctccttgaaccattgtgtgactctcccattcctgctatgcccttcttagcctcagaagttcttaaaagttcagggaaggcccatctgtgtggaatgctctcccagtgcgcacaggccacataaggttttgagcacagggtgtccagctacaggctgagaggggctgaatctggctctgctcctcaagcacagggaagctgccccacgcaaagggtactttttctaattcacacaaaagcatattgtggcttagcagcagccctgctgggggactagcagccatcagattcgtcctttccaattctgtcaaccggtttgcttgatgtcaaagctagcagttttgtgtggccatgagaattagcaaagcaggttttcaggactgaggagaaccaggggttgaagcaactccatggaatacctcctttcttcattccccaaagcatgcttgcttgtatgcctgcactctcactattgttttaaacatggagacatcaaaagaaaaaagatctgctctccaagaagagtacgatgagaggaagcctcggaagtatgcactgatgttcatttatcactgggttaataaccatgaccaccttcagtcttcaaagacccctgccctgggtttccagggtcttgccagaccacagtgaggccgtataaccacatccaatcaaccggtgaagagggctgggtaagacaaactccccagacttctttgaacttttcaatctgtatcctgcttaagtcaaatagggactatgcataatatacttgcaaagttgttattctgacagtctgctgtcaacaaagatgaaatactcaaacaaaaccacctccctctcaaagtcagaatataaaacttgtcaagtgacaaagggatattctgacttctgatggttcttcataagtaaatggctaattcatttaatgggcaaatgcttttgagtgattaacaactggtccttttaacagagatagcagaaataatattataccctctctgtaagtttttctttgataacaagattttcttttgcaatttgagcactactaacggctagctggtttcctttagacaggtgttaacactgcgatcttctcgcgatcacctagcctggctggaggccttctgcctatgctaagggtactttaagtagaaatgattccataaagcctgaatttatcttatggtggaagggcttgtagctcagcctaggcctcctcctgcttcaattgtgatagggtatggtggatctcattagtatgggaaaccagtaacagccattagtgtcaaataagagttgcctttgctaactatttctgtgcacagtcacacaacatgctctgagttttctcaataaaacagctccttcccaggggaataaagctgcctcttcaaggggccccaatttacatacactttctcaaccatttaaagtgaaatctccttggagcatcacttcacttctaaagaatcttccttgtcgcacttccagtgagaatttcaataatgatgaaacggaaacttctacttcaacaagagaggacaacaatatataaagtaattacctttttacctgttttttaaatcacaaaattgattttagattttgcatcacatttgttcatttgccatgaggaaagcagctatggtgcaaaatgtgttattgccatgtaaatgctatgtcccagtgaaaagcaccagggcatgtgctgtgcacatcaaaggaataaaacccataataggaaagtcaagggtctacaagcctccctttactccttcataataaaacaatcgggaaaatcccataatgcgtttagtccattctatttcctactttatactctgatatcaagaagaatggctacacaataatttggtccatttaagaaataaggtggcactatccttaagatgttaaagatgctgtcttgttataaagtatttttaatatctgcacaaattctattactactcatatcaaaatataggtatgtaatattttgccagtttttttttcctgaagaccaaagctgtcatttgagttatgtcttcaaatgtcttgtttcctttaaactatatttataaagtatgccgagaaagaaagatttgaagactttaatgtgtttccatagctaaaggatttagttgagaaggcaggatgaggggccgcaggtgccagacattgtgtagaatttgcacttatgctccattaattgccagcatatcttcctctcccttttcctcccctccccactgactaaatccctctggaaaacagcagagcagcaggcccagactggtacccagcagcaacaccaggagcagaagtagccaattaccctccagaatacaaagtggaatggggggtgggggggggggggaaatgatgcagttacctagcaaccagaaagagcagaaacagctgtgtagcaggcccaggctggtacccaggaagaaacaggatagccaattagcacactgtatttaatgctgatgtggtttcctagtaacaagatgtacaagtctgtctgttgcattttccccctccccttctcacattttcctcaatcatgcacagtattactatttgccctaattactgtttctccactgcttccagcgaccattattttatccccagagaaattggaggaactcaggaaaaatcttctgtaatgacagtatttagtttcaaattcagtttagttgtaagccttgagacactaaacaacaacaaagaatgaaaaaaacaaaaagccagcaaattgccctctgcctaaatttttaagtagcctatgataccttttctaaacgctaatatttacgtgcaagtgaaacaaaaaaatttaatacataccgtcattttgccacacattacattttcaaatagggtgaatcctctgtgtacttgaatttattcatattgattttctgacattctctcccgaacactaggaacataaaatgtcttattacctatatcaaggaaggaagatgtatcttttgttgctctttttaaaataccaatactagtttcaacaggctcatgaccaattgagaattcaatatgagggatcattatttcctttctgcaacagaagttcagtacaggtgaaggatgttgcatatcccatagtaaggggattccaaacaccatgtgataagttcataaccaagcaacgaattccatgagatgacattaaactacataaacacacgaaatgaagacagaaaccttttaaacaggactactgcacagttattctaaaatatttcctaccatatcttggtgctcttctacactcaaatatgtaccagagtcaagctttttcttggttctattcattaagacacagatagaatcctgcattttttagggcaactgctagactcctagaaccactctcatttaacattggcttcaatattagagcaaactatagtccttattacaaaacatccctgctaggaaaatagcaaggtctccagagaaagatattagataccctaagacacctaactaggcaatactctaccatggaggtcaagttctttctcagctaaggatggcttctggtttcctgcctgcaacaaaatgattgatagcttttatcatttttagctcatctagtgaaacagataaaactatgcagacccaacaaagttgggattaaaacatctttttacattatttgcctgaaaacaatatgtaccactttactgaattccatacatgttatagtaatggaaacggatacattttaaaggcagaaacaacaaaataagcctaagtatatgttttataataccagatgagtagtttagaatataaaaggagttttaatctgtaaatgtattttattttgcaaacaaaataaaaggggtcttacatgaatgcagataacttttgaagggaagaaaaaaaaagatgtcagttgcaaaaaaaaaaagggggggtatgccaaggaagtttggtttaggacaaagctggactgaggctccataaggaaccagcaatggggcattctgatctttcctcccctacaagattatggggtccaatcccgggtcagtccccagctcacctagctccataaacatacatgttgaaggagaaggtagggtgaacagaaatatggaacaaagcatgctaagcttattctcattgcagacatccttaaataattgaagtgctttcacctccattatttcaccacccattggtgactgaacatggggacactgcaggagtgagaagtaactccatcagtggttggctgaataaccagcacattaaaaagtcaccaacttttaattattttaagtgatcttgcctcgaccaacatttagcttaataatgtcatgtcaatacattaacaaattgttgaaaggaagccacttttagaaaatgtagaaaatccagtagcagaggaggggtagatgggatggtgctggagtaaagtgggggaatgccatcccagttcccaacactcccccatcatgtctccctacctgtttacagactactgaaattctattaagtttcccctaattgaaggttaaaaaactaataatagaagattaaagtgttatacactggtggatggacgtataatccactgaccacaacagtctacagtgtaccaaccacaacagtctacagtgtattgctaccagatcctttctgctgtgaaggatagaggaaagctgcagggcagaaagtgacagagtacaggaagggatcagatattaggtacttaggtagggaatgcagaagaaaaaaaccccatattttagaaaacaagtttggccagggctatccagtttgcctccatcagggtgaagacaaatagaaactgcctgcctggaaagggttaggcgttctccattcggtaccggagtcgtgcagcagagcttagtgtcatctgacacattctgcccctggtggaccagattcccaaacagctgcatttactcatcagaactaatttccttatatgaagtttgtttcctgaggatccgttatcaaggtttcaactgtaatttctactacattcaagctgaatatttttcaaagaaagacaggtcaccttacaattatttttcatctgtccttatattttaatttttttaaaaagaggaccattcaaaaccaatttgtttaaaaaaattaacacgtgagtttcttaaactccatttctttctaattcaaacacaatcactacattattatttcaacttcaggaaacatagaaaatccctgcctaccatcaattcttataacgtcatcttagccttcactctttacaaagctccacatagctttccttgaaccttcctatattatatgtacaggataaccatgatcatgacggtaattaacactcatattataatagaaacagcctctgtacattatcaatttattaaaaggaacagtttttctaaaagtttacacttggccttctcaatgtcattttttcatttacacagacttctcatgaccctcttcttttcttctctatcaaacagaactcgcccacccttgaaacctttgaatttataaaattctattactttcactgccttttctgaaatgagattcctcttttctcttctccttcctcccagttcccccacatcccccatccaaactatattctgagatcaagttccaaatataatgattttatgaaaccatatttcaggcttttgtgtcaaaaagcgaggtcctcggcaataaagagggactagtgtatgtacagtgggtgttcgaaaatattgtttatgatgaaatactcattaatttcatgcttttctttctcctcgattcttattttaacatacttatttgctttgtgactatcaattatccattaaaaggacatctggaataggcgtcccacaaagcctatatttattatcatagtataatgataaaataaatgtgcttgctgtgtatatgctgagtttaggccatgcttcccaatatatgtttacattaatttatcttcataaatgttaggagttatcatattgctaaattaccatgtggtaaagttttaagattttactgaatcagaaaattctcccagcgattgtttttcaccacctcatttcataccctttcttttcaaacttctcttaagctcttgaatatgctaaatccaaattatcaaaccctcctattcagctctctccaccttgtgaactgaacatttaacccttattcttgtttccatcccataatcggggtttaatgagtttctgcctcaacacatggataaacttcattagcagccatgtgtctcggcatattaaaggccctttaatgtcttaaaatcgccccatttcagttgctattgtataaattcaaagaattcttatctatggcactagcaggttgaaagtggttgatgaaccccctacagttccacactgaggtattaaattttatcctgctgatatgcctgaccttgaattagggcttctatttatataaattactatactatcacattgacatcatttaaaaagatgaacagcatcaataaacactctgtccagaaggagagaagcgacttgttatctccaaatcttccatgctgcctctgactgctgctgcaagcccctgctttcatttactgccccatcaccacccttcagcactccttcccaaatggaccaccctgttctcctttgctggtcactccatggtacagtgcctgacatctatgggcacttaatacctgttcgcagaaagactgaagaacacatacagtaaataagaagcaaaacaatctactgagtaggatgtaagcctataggtcaggagacatgggtccaatttaatttctaacaacagggacttgcatagcctgaaccaagttacttttttgttgttgtggttcctcagtttctcccatgttgtgataatactgacctttcttatttgatagggacagaatattaacatttgtcattttaatgcgtgaactgagactggcatgtctctctttaacactaacattaaaaaaagtgaaaatagtaacaaccataaaatagtagctttatcagtaacgataataggcctggaaatggaagaccatttctttgtaatttccttgtactgcttctcagtcacctgatgaggcaatatgtttaaggaccctcctaattctcacctatttagagaggatatttagttttcatcgtccatttgcatttaaactatacgtctttaatttcctcttaataacaggttacttttaaaaaattcatttgacttgtttcccctttattagtaagcttggaagttaagagagctcccactggagcaatactgtttggtgcaaatccttgcccaaccatctatgatgagctgtgtgacgccaggcaaattacttgacttctctgggtctcattttcctcatctataaaataagatggtacctatgtcattgggttagtataaggattaaaagggttaatatttgtaaaacatttagaacaatgtctgggacatagcaagtgctttatatgtatttgttgaataagtaaaataaactgtatttcaaactttaaaggcctttcattacatgtgtgacataacacttctgtttgccttttgaatgctacactggtctttttgtttgtagtatttttagccaccttttcatttgaaaataaactatttccctaaattctgattaaacttacagattgtgccactttctgattcaataagatgggccccaaagaaaatgtaaaatgctaagcaaattgcacacttgtattacttttccacctgaaacgtatcctgttatattgttcgggacaaaatctagagaatgcttatcaccacccatggtttaggtgacagcaacttcagtctatagagagagtcctccaagcagcacgttcagagaacatggcttcttcacatctcccttcactgcaaacaagaatcaaagatctaatgacaggccattgtcctgacttcaccaatatgactcactcataataacataaatgtggacgtacctttatatggattttcaaatttgaaaagtctgtttacttagcacaaagcaccatttcaatgaaaggttttttatctcttctcagaagtaattaagaagaaatgtagaaaatccttctttttttacatagaaactattaagatttttaaaaattgatttttgctgagaatgagcatagttttttttttaatattggaagtgaaggttacttttcatcaaaatataaggattatttagctgactcaagaagatgaatacaactatgatcataatggtagaatttgtgagaaagaaaaatatatgaagaccagaacacagagtaggagagaaaggtctgcaatgacttggctgctaagaacatttttacactcatgccaacactaggtgctcttcccaatgaataaaccatatgtccattttttttaatttttattgtttttgagacggtgtctcactctgtcacccaggctggagtgcagtgacgcaatctcggcgcactgcaacctccgcctcctggggtcaagcgattctcctgcctcagcctcctgagtagctgggactacaggcacgcgccacacgcccagctaatttttgtacttttagtagagacgggtgttggtcaggctggtctcgaactcctgacctcaggtgatccacctgcctaggcctcccaaagtgctaggattaggggcgtgagccaccgcacctggcccttatgtccatttttatatgcttcctttcactaaatcctgctacttcataatattccctttgtcccattcctcgcctcgttatcctgcacctccagctcagtacccccatctctaactttacttccttgggcaacctgcgtttgtgccctagctaccaatgtgaacatctgctaccttaaaaaataataaataaaaaatcacctcattgcctaatatcctccagggcaaaaattttgaaggattcagcatcctcaaaaaacagccacagaaggaaaaaaatgcatatctttttcagctcagtaaattctgtctatataaagattaaatgaataacaccttaaaaattcttcaatgcaagcaaatccatgttaccaacatgtattgtcttcctttatgcatatgagaggaagacacacacattttattttacttcatttcttcactgtatctcctttgcaatgtattaccatatagaagagatacagcatatatctgcaactctagagaacaaaatgcaaatacttctcttctttctctgggatggtattcttatctccctttttttcctgtcccaaaacacctccccaactggaagataagaaatattttgactgaattaaagtgagtcctgggttaaaatagcttgcctgaatccaaccagcgcccatttttaaaaaatcttcatttccacatttggtcagcagctctcccaactccagtccttgtatcagcagcctctttccaacctgaattcccatctccatacacctttgccctcgagcttttaccagtccatttcctttatatgtttgcacttaatttgattccatccttcatgctgttttcattattcttagttcatctacaccacataaattatcacctttgttttcagttccccatgtgctccaattcacaccaattccaaataaatacttctgattctcatccatttaatccaaattaattcatattctccccaccctccatccctgtctctacctccccttttatctgtttctctttcttgtagcacctactttccgtgcatgtctctgaggaaggttttacaggcaaaatgcttctgtggatgcaaggtaactgctttctatgttgtgggaggaaagccatgatctttctgccttattgccaacttctatgggctaatgcttgcatgtctggtttatcctccacaacttgtatccacaggtgtcatcaccccacatcccattgatcaaccactgggagcgagagggaaaaagcttcttgctgttttgtggtagttaactttggctaactggcttgtttctggtttacaaagctgttttatcactcagtcatcactaatatcaacaacaacagtaatagctacaatcaaccccactactatcggtaatgagttcttactatctatcaggtatttgttttatcttttttacaagtattttacaagtatctgctcatttaatattcaaaacaatctaggaggtagacacaattgtctctactttagaaatgaggaaactgaggtcataaatctaggaagcgacagtgcgaggacataaacccaagtccacccgatcacaaggctcagctcttaagtgctctgcgatactgcttttctaacaatgcctggtgcctccctgagtgaattcccaataggagtctttccactttagtccaacatgaggcaagtagttgcaggtgccaggtaacataatgagctccaccttggtaatcactctgagtagacaatgctcaaaaaaacagagcaccacataatgtatcaaccctaacagtcacccttctgacatctctattggaaagaggggataagaaagaagaaaaaaatgctctggactccctaaaaagaatctctgctttcccagagctgtccagcctccatgctaagcaggatgtgcccttagtgccaataattcagaaagtgtccataatcatgaactccacagcccaaagacaacacaacattcttgcccttttctgccttctccggtttcctggaggggccaggagatgagtcatgcactccagcctgggagcactgcaatgtctttccaatgtcttgccataactttactcattgactttagaaagaaagaagtatcaataaaaactaccttcagaacaatatcaaagaagcaaaaactgacaatagcatgaatcattagccttggtgtgtgtatgtggagtggtgaactggaacccaaattctgatgggaaaccatgagtgggtctctatgcctgagccacgggatataaacattatgttaggagaccgtcccatgaaccaagcaagagccacacaggaaattaagttcagaattagagcagtacaggcccaagtcctggtgtgcaaggaagcaatgtcagtcttcatcctcccatgggaataactctaaggttcataacagtgatttcctctgtcatatattatatattcgaacttcaggaaagttcttctctactacacaaaaacagttcatggacctccagaacactagaattgaaaggggccctaagagccagattgttcaacagatgtggaaaatgaggcctggtgaggtaaaggaacaggctcaaggtcacagagctggatagtggcagagttagaactaaagcccaggttgttctgattttccagccagcaatctctcccctgcacacttctttggaggcacagcccagaaggccccccagagcaccaaacacttttcctagctcatatgctatcactgatttctctccaagaatgcttttatacttccacttacacctttggggattttccctattcagctcgcagtgtgcaaacagtatgcaaaaaccatacaggtagcacactgttggagactcacttaaaaaccaccaatcacagtaattgctactagcatcctagtagcccaggaagagacaccacccctaagctccaatctcaaagcagagaacaaagaccagttccaagaaaaataagagtttcacgcttttctgtgtaaaccccacttttccaaattatcccattgctcaaaagatcagtatgactggaacttagggatggtgtctcttcctgggctactaggatgccctgagtaaaatacacaatccccatccctcccccacccgctcttgccacacacatagcaatgtaatcactttagcaacttctcagtaacaagctcattaaaaagcaattctgccatctctccataaagcacgcgccagagaacaatgcaaaagaggagatgccaattaattatagaatgatcacatctaatgaactctgaaaccctcctgctgttggtgactttgatgaaaaatcaggatgctgggaaaagagtgaatagggacaccctagctaccttgtttaactgtgaatgctttcaaatgcatcctcagctcccagtgttgatcaaaactgtggagctacactcataaaacaatgcaaagtgtcaggaaagcgacaagtgtctgtgtcacaaacagctatgagtcactgccagggcccccttcagccatcctcagaattgtatgattctatgctgtggttggcactgtagggacaaacccgtctgtgcttgggacatcttgagatcttaaggtaacaagtgagtcattctttgtccctacctggggcctcccgcctgtctatcacctcctcatcagcaggggtgccactcctcagaacaaagaggagccctcccacatgacgaggctacaggaggggaaagaagaaaccacgtgcggccaacttgtaccactacctgtgtgagtcctctggtgggcctttaagtgggagctttttgtataaactttccggcacccgttaaactgacagcggtgaaccctcttcttgttttcgggacatgcttcagcccccagccctccttggtcactgtcgctctgtccactcttaacggcccccgcagccgtcacggctgctgcagctgttgcgacccctcccacctttacggagctgagagcagccttcttggccaccagtttcaacgtcaccgtgccatccacggcagagagagtttgtgaggttttgaccagatggcggctgagctcaggggacgatgggggcgttaatgaggtcactgcgttgagctgggcctggttgacggctgtgtagctgtctagagaagagctggccggctggaggctgaggcaggtctcagatagcaacttgtcccgagagagcaagatgtccactgccgagctcttctcacagatggccgcttccacggggagcagcagggggtctaagcgacggaagctttcctcaatgcacgggggaggggaagcgtggaggaaacagtccaagtcctcaccaaaggtctctgagatcctccggggctccgtctgtaggtagcgttccaattcaaggcatgtctgcaagaggaagaaggagggagagaaacagccatcagaggcacagaacaccatgaggccacacgttgacaggcagagggggaaggtgcagagagaatggtgtcatggcttgtatcagaaatgccttagtagaaggtctgaccttgttatttattctctgaatacctctgaaaggttcataagggtcacatcagatgatttcaattactctagctgaaggagaacaagagccccagaaggactatctcataccttcgagattccagagaacatcaaatgatgatctcttgcccctcaatccaattcagcaggtaagatgctccaatttcccctctagaaattatcatgcaagcaagaagcaaatagaaacagataaggttttcatactaagacaagacttcccagagtccaacttcattattcaaaacagacttgagcacatcacacaagtaagtcagttttcccacttgctctgaagaacaagccatgttcactcaaactaagaggtgacctcagtaacaatcaaacaacagcaagccctgccttggggatggattccataaccagcaggaaagaatactgttctaaagaatgtctaccataaaacttttgaggcacaagacaaaacccttgttgtttatagcaagtcatttaaaatacaatgctatattactttgtggcaaggggcataaatcccatttcaatggtttagcatctctgactacatgataaaaataaattcaaacatagctatttagaccacttaaagataggacccaatatatttcaacataaaattttcacccgataaagaaacaggggagaagaacaaaaaagtttagtttcaacaaatcttcatccatggcactcataagtttttgtaagatgggggagtgcttttatggcaaaagtcgatatttaagaagtttgttctaaagccctcctcactcaaaaatcctacaattccagaatcttgtataaaactatgttgctaacttgcactatcagctcaatttgctctatcttctggattcaacaaagacccactgatggcaaatttaaaatgtgactagttccaaatttactgcccccgtaaagctcctatgttttcaactgatgttctgattctaggcatttattctgttaagaatatattttaatgatatacctagtagtgttgtatctgtcaaggattttattttggtgacatttcaaaagactggtttttaatcacacttctggtaaaactctgcattactgaataagaaaatcagatttttaactatgaatcagctttgggtctcactgttgattttcaatggtaagaactaatgaatggttccagtcttcattcaacactcatgtcacaagtgttcatgcaactactgtgctcacagcaaggtacaaggctttgtatgtggtagatggagaagatatagcagtaggtccacatgatgcaggtatagaataaacaaccacaagctaaaaattacataaactcacatagaaatgtgataccaaaaaatagtataaaatgtgttgataagttcttaggggctgagtggacacctaattctatactctattaatgtagtattaatcaaggaaagcttagtgaaaaagtaagttttgattctgttttacttattgattaaataatagctctgactcagtagcttcccactactctacattagaaaccagtatgatgaccttctcaggtctagaaatatgaattatcctcacttgcttcttttctgaactccacttctcaaaaatttccccttccttattccatctcattgctagaaattatcacttacatctctccaatattgaagccctcagtcttggctccattcaattgatttctgaattataagattctactcctgaaacctcccttaaatttcttcttccctttctgaatcatcacctaccaagcacagtgcctggcacctaacaggtacataatgtctgtcaaagacaaagcccactttatactattactttgatcattctacctcttctactcttcaatagccatctttgaaaccctaccctgtaccatgctgagggggcaattttggaaatgaccactaatacatatctctgggaatacaattgcaatgcttcttgagctttgcccaaagagcagtaccagatctttgagacacagatatgttttaggtaaaaatcagtatgcctgggcaacacaagaccctgtctccacaaaaactaaaagaaaatttgccgggcgcagtggcttgtgcctgttatcccagctactctgatggctgaggcgggagaatcacttaagcccgggagttcaaggttgcagtgagctatggtcgtaccactgcactccagccctctgggcaagacagcgagaccctgtttctaccaaaaaaaaaaaaaaaaatcagctgactcatggggtatcagatgtccttgaggtagttctctgcctcctctacaatgactttcacatactcaatcatcactgcctgtgaatagagtttttgtatgccatttatttacatactatccagcccaaagactgaaaagtcactaagatattgtgattattagaaggctcagatctcttcatattcagaagagatctgaatgcagggctgagatattctaaatacatttacacactcttctgggaggattaagtaacttatgcagtatgccctggtgtgaactgcaggagcacatgagtcatatttatgatctaaagatgagagacatctgatcactaaaatgtggaaaaatctggaccatttcagagtggctataatttgcaatcctaatacagggcatttttactcctcctgaaaattgaagaagcataagtacccatcgggatgtgctgggacagtcctgtcaaatcattatgaaatgattgctgtcttaggaaatacacttcttatatctgctggagatgaagttaaggtagaggagaagattttgtcaattcgaaaccccagtgagggggttaaagacttttctcatcaggagtatggagattaaaatgttaaggatgaggaggattctaatattagattatttccaagccaatgagaacatttacttccaacattgtttgtaaatgattatgagaactctcataagaaatgtccatgacaggccgggtgcagtggctcatgcctgtaatcctaacactttgggaggttgaggcagatggatcaattgaggtcaggagtttgaaaccagcctggccaatatgatgaaaccccatctctactaaaaatacaaaaaattagccaggtgtggtggtgcgcacctgtaatcccagctactcgggaggctgaggcagaagaatcacttgaacccaggaggtggaggttgcagtgagccaagattgcaccactgcactccagcctgggtgacagagcaagattctgtgtcaaaaaaaaaaatccctatgatgtttgatgggaactgaggtattagtatttcctcatggattttaatatacacacacatacatacatagagaaataaatgtgtatatccatgtgtgagtatacatacatatatttcctaactccatccactgaaagaagctacaggcaaagataaccccaggagcaatgagcacacttagcccagggatcttggtttctaaatatcattatccaataaagggaaccaggactccctagagaaatagttgttggaagggctggaacaatgaaaataaaagttgagcctagaatatcattgtggtaccaaaagataaggaagtgctcataaagtgatgaagtcatgtcagaaagactcagaagccaacttaaaggagctgtcaatggccaaatgaataataataggttataattcataaaataaatatccctgaatccatactgatataaataaatgactgaataaattaaaagatggaaggaaagggtcagctcctcattacagtaaaattatgattcaaaaacacagaaggaatgatggaaatagaaaatcaccataggcaaacagcaaagtaataatgattacaagttaagaattaccaatggatgctaaaactagtagaaagatctatgatgagaaacaaggtatctgcctagtttcaaagtatccaccgaacaaaatatttatttgttaattatgaagataaaatataataactctacagtggagaaacctggaagaaaccaccttagccatatgatcaaaattagcagcacaaggaacaagtaatattgatcacatgtacccctgatatgataagctgacaaggatacaatattattctatgatatttctgtcaaaatggttaacctcaatctaatcatgagaaaacagacaaatttaaattgaggactattctacaaagcaaatagccagttattctttaagtgctgggtcacaaagaacaaagaaagactgagaagttgtcacagactggagaagaataaggagatatggcaactaaatgcaatggatcctggcctgggtcctgaaccagtaaaaggactggtggaaaaaaataatgtaattcaaaggaagtgtttagattagttaatggtattatatcaatgataatttcctggttcttataattgaactatggttgcgtaacattaggggaagctggacaaacaatatttggtaactctatgtatggtttttgcaacatttctgtaagtctaaactaacttcaaaaaacagggagagacgaagaccatcagcaggctaaaagtgtccctaaactgtaaatttggatagagagttcaaatgtttttccactagaaccagagattttctctgttcaaatgatactcttgccagcaaactccaaatcggagtcagcgaatgtcagtttaatgacacaaattatgcctgtctggcactcacctcggaggtacaaggcttccctcagcctgacctaaccatacaacttaaggcttgagccactggatcaacccccaacccctaaaaaattcattacagtcagcaatgggaagaaaatattcccgagtgcaaagtgattttcctctatattgatgagtcacagatgagctttgtgaagattctcttgatatctcaactttgaaatgcatggcttctcctagcttcctaataaatatcacctgaaattcatattgaactgctcatcttgaaaccttttttaatactctcttcatgcttttcatagcattctcacttgttgcaacacacttattaaaagtaataatccaagacctagttaaaaaataatagactttaaacctattactgcctactacatctatgataattttcctacaaggaggacctgacttttcctctccatgtttatttattcaatcatttgtttgtatcagtatgaattcatttttattttatcctatggattgtaatccactattatcattattcattttttgttgctcagaggcagaattttccagagacagaagttgaaagaaaacaggataattcaagttttgtggcacatattaagtttatcaaaagctctctgctgctgacaagaggtagttactttcacagccttgagaacaatataagacatttggttatatatgggcatggtgccaaggttaccaaatggcttctgtttaacctgtctttatctcatcaccaattacgtggaacttgccagtcaggattgcacacatctcctgtcacattgactatttcccctacgacccttacctaaagggtttctttccttcacctatttttcttgtccttactttcccatgcccatatgctcgaaacaatcttcctttcgccttccctcccactcatcattctttcattcaaagttcaacataaagtctatccccttcagggagcccaacctagaaaaagatggagtcaagaaaatacgctgactgtcaagtgttgaaagacactcctcttcaaccctggacaattaaacggtatttccaaaatgaatcttagagtccacagattggtgggatgtctggtttattaagatcatgattttaaaagcaatgatatttcttataccatacgttcctaaacagtaaagttaagtgattagagctaaacctgtacctctgttttctcatatggcagatatgtctaagtgtttgaagtgatggagagttggaagagctagaactttctgaaaaaatgagctagaatcgtctcacaactcccatccattgcaaccactataactacaaccatgtttagttggggcagactgtagtccagcctcttcaataccatcacttttcaaacaaatcacctggaacataaaaggttcagtttttatttctgtgtcttttaatttgaacataagacaaaaccattggtgcaatatttttgctactacccaataactatgccactttgggtaattattgggagtctctggatccatgtatactcaagttagtaagtaaaaaaacaaatttaaagaaataaagaaattgcaattttctaatgactttttctggtacagagtcaacgaaataaaaggccaccaactacactcaatgtttctaatcaattttcagtcatttgtggtcctttagccagctgcccttaatctcagtcattccacctatctcgcctaaaagggccaagagttaaaagtacaaagagattaaacaaattggggacagaatgtagatataaaagcatgggaaagtgcagctttccaccatgtggaaacttgcaaagtcatgcttcctctgagatcagatctggatctgaaggatgatgatgatggtggtgagaaggatgatgcttctggcgaggaagggacagactttggttcccagaaagaatgttcacctaagtaattgcacaagcaggtaaactgcacttggctgcccatgggagccctttctgacatttattgtgtggtttttgtcacatgctattaaccatggtgtcacagtccccaaagagtttcaagtaaagaaagagagaaacaaaccccttgcctttctcctgggagggtcccaaagtttaattagcttttttgtgctttgaaatcttcaaacatcccagaatggaaattcagagtgacacaaaacaagctactgttaggagggaaatgtgtggccttctttcttcaagccaccctctaaaatactcattcttttctaacttactagacgtgtttacatatcactttttagcaaaaaaggcagattctctgactccagaaaccaacttgaaaatctggattgcaaagactgatactgatgggaactttgtgactctctttctcttcaaagaataatatgatgtaatgattctgacacattcctaggctttcaaaattaagtcagaattgaaagacaggaaaagatgtgggaagcatggccagggagatctggtacatttttgacaggagttggaggaggaggaaaaagatgtactatgcttaataaactcaggaagtccatgagacaatctcagatgccaagcatctgaaccttgttgcctgccttcctgggtttcaacattataaataggcttgaggaagaagacggtaacactgaatctacctcgtggcagaaaggatgcatgaaccagtgcaagcatccaccttgggagacctagagagtgattcctaacaagatattaagcatatgttcactttttcttgcctttcatgaccaggaaatattaggagagaaagaatttcatctagaaaatgtggataatcaagtagacagtatgagtgaaaatcttactgcattttttttaagctattaggttaaaagaaaacccacaacaatagcacaccccagaggtacaatagcattacacattactgtcaggattgctgaactccatgaaataaccaggggactacaacaaatgttaagactgcattgctttccactgtttctcacatctactggttgctagagctgaaaccaagttatatatttccctctggtaatttgtaaattttgagagacaatgctgtgaaaactaatttaaatctaaacaaacatgaaagctgaaaaatttctatcaaaacctcttccatgtttctcttctcctattttcaacaaacaaagaaaatatttgtttgcatatgtttccttggggaggtgggtggtgaggatgttggagggggagaaaggagacaagattaaaggcctggggagagggtgatgtctttgaaattactttccccaggcacatgatgcaaagcagcctcaaatacccctttcatcttccaaggattccttagttgcagtgcataaaagaaattcccaaaacaactcaaatctaaattaaccatcaaagtgagctttaaagtcacataacctgggcagagctggtagctatggcccaggcctcacaccgcttgaaggaaggcactgggttcccctacacttccaacaacttggaaatgcattttcctcattcattatgtctgtgatcctcaaaattcaatgcgaccattagggacatgatggcccatgcacagagaggcttctctaacttggtttagagttgtttttccagatgttactctgcaggacatactgactgggagtctgttggcctggcctctacccacagttgcagagagcccttaagaagaattgctcactattacttggccactggactataactaaattacagcttctgaatagtcaagagacaacactgcttatgcagagctggggcctagaagatgctcctgtatgctatcccctcatctcctatgccctcatctcccaaccaggcccctattcaggttggcactcactggtggaaatcccacttgttacatacagattgaaagcaagttccattagatggccctgctttggtcattacacttccacggacaaaatgaaattcacatcttaaagagtcaataaaaataatcctacccatactactgggaagtgcaaagggctggatctgcactgaaagtgagatttaagaatgagaaaatgcaggagagacactccaatgggaaaaacccatcacatcccatgacaatggcaaccagtcggtccctgctccaaaaggagaggactctaagcagttcgtcaagagcccaaggacgtgggaggaggcctcttttcagaggagtgatggcttcctaagaacaacaatggccctgtcgctttttcagcttcccattaattttccataaagagcagttttcttgacgagcgcttgtgtcaggcagggcctgatgcttcagaaacctgtaattattcttggctccccaccccctacagcctctgcacctgtgtcagttcaaggcaccagctggccatgtcttgcctcctgcctcttaagagggggagggggggagccatcattgaaaacccaaactcacattactcgcctcttcttccaaaatgcaacaacaaaacaaaaattttaaactcaccaatctcattcctccccccagtggatcttgccaaaggaaacaaataaacattaattggctagagagccctcattcaaaccaaaattactgaaaaacacagtaacagggaaaggtctgacaaggcattattaatcctgttttacagcccgctcttatgcacccccacccgctcctgttaactttgcacacacactcacacaccctcctcaaactccctgggcccctttacactcactggccaagacgggaacatgccgaaccagttacatcatctccccttcctctcccaaatcacttgcacaggctgactcgggctactgggatttttttttttttttttttttaaagcaaactcatttcattggctccttcctggaacacagtcatctccttctcagttgggttaattaatatacccttcccctacccccataaaaaacacacagacacatacgattacttcttgtactccaaagcacagctgcacacgtgtacaacgttctctctctccctcgcagcttgaatttcccaagaataacaggttcaaagcccattgggccctcggtggcagatgcaatttagtggctggtaatcatagaggatgctttcaaaacggagagctttgaggaacttccactgcggaatgttaaagacaaggtgggggcgctaggaggaatgtttcttctactcagaatgcataaaatggcagccaaaaccataatgaagtcaagccctaagctgtttttcctgatatggattgttgtactgttacttgagatacttggacttgatttcccacaatgtttaaggtggctgtgtgggtgtgccaagtgccactcactccaattaaagaaacagactggccattcgcatactgagaggcagaagaacagggacccaagcattggccctggagccagactgcctgggtccaatatcaggttacactactcactagctcaatccccctgggagaagttaacccctctgtgcctcagtttcctcacctgtaaaatggggtaatagtagtacctacaacgcagaagcattgtgagagttcaatcaattgacatgccaagtacttggaagggctgggcatgcacactctgtatgttgtagctattcaataactagtgttatttttcattacacttccagacagacataaagaaacctatcgagggcatggagatggaaaataaaaaataccaaataagtttccaggggaagtaaacctgttggatataaaagtttaagtaagcaggggactctgagttgggaagatcaaccctgactagctgggtgactttaacttcaatgggctcagttttctcatctaccagctgaacttccaggggcccactaatctggaattctatgaggaagcaaaacagtaataggagagtgaagactgaacagtaagaaaagctcattcagaacaagttcagaggaactgatagatagctctgctgtcattgagtggttaaaaaaaaaaagggtttggagaacctggaagaaagtggtctttgaaccctcctctgacagggacctcaaggcctttattaaaagccctaagacactcaataatccatgtttacaggatgctatgaaggtttaatttcctgcttcaccatggatacaagcctcacaacatctaaaacgtaaacttcacaagaatgtgactcttcaaagataccagacctgtgcctgacttgcagcctgcctcaagcatttgtcaaatgaatgaatgaatgaatgagtaattgaatcaactcccaaacaatcaaagtgaaagtcaacagtgatcacaatcctgggtaggaagagattcaagagtatcatgaaagccagaaattcttccttcttcaccaaaggaacatcagaagcagtgtgcatgtgtttattaccaacatttctggtagaacacgtcagtattttcagatttaactataggtgttatttacttgtctctaacgtttttcatttggaaaaaaaaaaaattaaatgcttactgtctgggacagatccggatttctaaacagagaggccaatttagcttcacggggtagccctgagagtatgcacctgtgttggaagtaaaagctgtctccttgccctggagaatgccctctccctctgccacttcctcttttctcctctggcctccagaaaccaccaggaagagaagcaattaggatgagtgaacaaaacgctattttcaactgtcattttttattggtgaaaagaactctggcctgggaatcaggttcagcgcctgcctttcccacaccaccccttccctttccagcaaactactgaatctgagtagagaattcacttccttccctgaaaaaaatggatgaaccacactctcaaagactctttctggctcaaacttcttgctgataatccttcagtggcctgttgtcactctcagttccttaccacagcaaaccagactctacatgatctgaccttactcttttctactcctctgcttctccccttcagacaggacacttctcgcataaatgcccccagttcatccctctctcagagccctagtaactccgtccgcatcccagaacgcagactccccaggtcactgcacatctgtttccttttcatcgattatgtcttagcttcattgtcacctactcagagaatccttctttgacctgcctagagaaactaggccaaacagcccattcattcttcatcatactacctcattttatttgctttttagaacttaccaagtcctggaaaggtctaaattatttgcttgcatgtttatcgtttatctttccctattaacatagaagtttcaggagaacagggatttagtgtatgtaccagtgaatccccagcacccagcacagtacctggaaaagacatccaaaacatactagttgaatcaatcagtgaaccaatgaagccactaatcaatcccggaattccagggaacacgtgagctggtgtctccagtcagaaaatctatcctaaaatgctcaccttattaggtcaaaaggctccctcatcatttctcctcagtgcgagtttttacactgagaaggcacttgctgcttcgtactcatcagacagaagccaaatggagcctcttttcaaggtggagaggtcagttgtgggtgcttgtggctgcccatttcaaatagacacaaagagggcttttctcctcagcagtccatattgcatcatgcattcactaacatgaacaaaacccacccctcccctctcctcacctgcataatgactgcttattaactggtatcctgggtgaacagatcaaagagacaggctcagcccactttattcccatttctgtcacctaacaggatgtccctgagaaaggcaactccagccaccagtctctgaagcacttgagggtcacaggaattcattccctgacattagcagccccacttctatcagtccttacatgaaaggtccttaaatgaagaggtccattcaaacctagcagttggcgaggactcgtgttttctgtaagccccacacaccacttacacaggtgaggtcctttaaaattcctatgtgggcccatcctggtatctttgccataaattcctaaacacagaagcttttccttccctcccactccctttaagaattttacatgaaaaggtatctctactgagaagtgctatttatttcaggatcattatttcacagatacagaaccctcgaacactgaacctggaagtgagccaaaatccaattaagagggtatggagtttgaactaggcaagagtggaggatggaaatatggaatataagcagtacagggttcctatgagtgtgagtgtgtgtgtgcattcacatgtgcatagtgtgccactgttaatgaagtgtagattctctttaatgtattttggatgcctctctctctaaatctttcgttgtccctagagtcacaaagatgttctttctcttattcattatgtcaggcaataggaatctttcccatcctggctggggaaagatgagggagaggggaagagttgatgttccatcatgtaaagaaaagtaaaattgtgctttgcccaattctgaaccccattgcaatgttgcagatttcaaattaacaattcaacccaacatgacagggaaaaaaatcaagtgctgagaccctgaagtttggattccagtagctctggcacctcacttaaccttaggtggcttgactgataccgaatgacatgcactttcaggcacaccagactctcattgaggaagagacattaatttgaatcatcactgccatcccctctcccctttgttcctgtctgaaccaatttccatatagtttcaaagaaatcatcagcccatgcaaaggagaaatcccagtggagcaagaactacattagcagcataagggggaaaatctaatttccaatccagttgctttgttgtttcaacctccaaggaaggttgctacatatgcacaacacaaattaagttttaaaacaccatcatgatttaaaattaataaacactctcatgggaaaaaggtggtccttgatacaaatcttctcatacaatgaaggtcaactccaccagagcttgtgggtggtctgggtctttgaggtctcaatcatctcagccaaaaaaatatttaagaacagcatatattcattgaaaccactgcatctgctacttatagttaatggtgagttcattcttagtctaaggcagtatccacattaagaattcttaaactaccttgttgacagatcccatggaaatgtattttagtggtccaaattaagaattcttttttggcatgacaagatatgccaatacaatttcctagtgccctacttactagaataaaactcatggcaagacaccagtgtgactacatcattaattaacctgaaccacataccggaacactgctgctaataaaactcctctataaagaaaacatgttttctctgctgagaatcctggaatgtaggccccagcagagctgctgccttaaataaggagatatttcgatgtttgtgtctgtgtctgcgattgccacgaaatttggtcatttatttggcttgatcttcaataacttgagttcttccttgcgtgtgcttttttggaaaagaaaatgaaaatggcgcctacactatcaggatttgctaacaactatgtgaatgagaggatcctttttgcgaaggtaggggatgctttatcctcactcttttgaaagcacgccctgagctttcagcccacgaggtactgaatcagagacctgtagaaaccatccatcttctctagaaaacaggctgacagaaacaggagcaaagctgtaacagctctaactcccaggtgaaactgggatttttccaatccattccatatgaaatgacatacatttcttttttcttttacagagaattcttttgggaaaagcatctgaaaatgcttatcgatacttatctggtaatcttgtaaccttggagtccccctgtgagactgtaataggcagcaaagattaaaatccccatcctatttatggggaacctaacttagtaaagaaaactgagtttttcactgttctgtaaccatactaccaaaaagaccagaaacagaacgaaaagtttcttggccactaacaattaggtttttttttttctggtccaaccctgaactttccaccaaggatctcaaaacattctaaaaatccaacaaaccattatctcttagtaccttggaaaaacaaggattcctgatgaagattttggatcttctcaagttggaaaccatcagatcccaaacttcatttcataagcttttcaactacatttctctacgtaatctctcctggtgagactggggcaaatagtcttggttttgacaacacccttaattatgcaatttccgagttctctctggtcattgcaagtcttggttgaattgttaaaagcaaatgggatttcagacatttcaacctgtcaacatcaagtgtagtcattgagaggaaaacagatagaattagaatcattttttaagatcttttttttcttttctgagacaagagtctttcttttttgagacagtcgccaggctggagtgcagtggcgcaatctcagttcactgcaacctctgcctcccaggttcaagcgattctcctgcctcagccttccgaatagctgggactataggtgcccgccatcacacccagctaatttttgtatttttagtagagatggggtttcaccatgttggccaagatggtctcaatctcttgacctcgtggtccgcccacctcggcctcccaaagtgctgggattacaggcatgagccactgggcctggcctgtttttttaagatttgaattgagaaaacttataaacacaatttattgaagaccttattttggttatttgattaataccaaatacatagaaactcaaatttatataatttttaaaggggggatttgaacctgctatccaacattttaaaaaacattttctaattttaataaatatgaaaatacaaattggactaaataagtcaacatttttctcccagtccttagagactaatgcattttccaacaccagtatcatatatcacccatcccttttgttcaaaacagaaaatgcagtgaggaaaaaaaagcatgtaagaaatagaagcaacaagaggagtaaaaataggagcaatggaaaacagatgaacagtaagcatctcattcttgtataaaaatcttggatgccagtagctgctcccatcagtaacacacctctaaccaagaggatcatcaaactctgggaagcagatcacctcaagggcacaatttacacttggccctgctccctacatggagcctaaacattaaagtagttgtgtctataatcacctgttagtaacagactaaaaagaagggtgggccagtgggtgaggaagactattgtgattcagaaatgtatgctggtagaagaccatctctgttaaaagcaggcaattaagtatctcattgtaaagggtacctgatccgtcttggacaccaaatccttcaactttgagactttttgtaagtatgtaaaataaaagacaatgtggagtcatggagagaacacagacaaaagtcaggatgacttctgcctgctccttctacataattagctctatgcgtttcctcaagtcatctcatcttcagtctctggtttctttatcaagaaaccaaaagtattagtatatatatagagatatataaaatggactatatatatatccttcccaatggtatgaaaatcctccgtgaatataataaatttctcatgaccaaatcttgtttgcttagggaaccagggtatgaggaaaatggaattccctactctgatccctctgcttatagcagtgccatgctccaggtatctcaatttcagactctggactgcagtttctgctcagtctcctagacaaggtcccatgatacaagaccacatacttgtccttagggtgctgcagtaggtagatgctatttctgaggatgctttcctctaaaaggtaacacatcttcccataaatctaggttaggaatcaaactcaaacacattcagggactaggagcataacatacattagtgaaacagtcaaggaatatgacaataatgaggggtggggactgtggtaaactggatagcacatgccatctaaaaggggaagttggtacatagcaccagctcatcgatatcatgtagaaaacagaggtccagagttggcaagtgtttttaaaggaagcccaaatcttttggggtttatgtggaatctctccaattgtttcaatgttggcaatgagtattaaaaagttagagtgcgtgagacaagcaaagggcccacagctgccagtctgagccttctgtttcaaatgaaagcagaggcaaaagaaaaaaacagaggcatatttgggcagttctttcttccctgtggatccaaattatggtataactgtctcttagggtagttatcagctggagaaccttaagcctcacgtcccacagtttccctaagaaatcccttatttgaggagagacccagctgaaggaaataatgatgagctgcactttcattcggccctgctcagctcctcctgccccgcagtactcggctggaatccctgctctcaataagaatcttgtcacaagaatgagaaatctgtagagaaggcaccatgaaatgtcaagcaggaagaggcaagagctctgacaaatccaatgagccttgaggtctggcaccaagctttaaacttcttttgggcataatcaatagctgctcaataaatacttcttcaatgaattttttaaaaatcttgattaggagctactattatttttcattgcatgctcttcactgaggtgactgggagattggtagattttgcccaataagataatgaatgcctggggagaaaaagctctgctaagataaacaggtgacacctgtttgaactctgatggcctttcagggcagggtctgttatcttgtacttctttcaaattaattcaacagttatttactgagcttccactttatataggacattgtgctggagacttcaagcgattctagagctcaatatctgcctacaaggtgctcatggtatcacaggaagagagggatagaaatacatgcaattcaagataacacagcacatgcgactaagcactaggctgaatgaagtggtatggcaacacagagaaggaacccactcactctccctgcagaggtcagtgaaggccttgtgaagaagtcacatttgaaacagaccttggcaaatgagtgaacttttgccaagtggagaaagggaacaatgacattctaaaaagtgcacacagtgtgagcaagggtgtagagaggtgaaagccccactgtgtgtctggaaaaggatgagcagtctaggattctgatgaatggggtacacattacggaggagcaagaaatgcatgccctcgggcctaaaaaatgtcttctatttttggctgacaattacattggtggtttgctctgggttaagctttgccaacgcacttctaaaaggcagtagctgtttctctagatcttcagtgataactcagggaaagattaaagagctcaaaagatattagtgaaacccagtagccgtattaatgttgcccagtgatattcctgaacctaaatgtcaaagaaatcattcaaggcattttctttttcagactgatactcccaatttagaaaacaacacaacaacaaaaacataacaaatcaaaatgaggacaaaacccaaaaagatggaaataaatactatcaaaaaaaatcttagctaaaatacaatgccactggattaagcacagaattaaactcatctctgatttgcctggtagctgaagcaaaaagatcaacaatgagttaggaaattctcatcatcaaataaaagaaacgtcagttcctcagagatcagttgatcttcacacgtaaagtttaaagtaaaaggaggaggaggagaagaaaatgaggaagaggaacaaaagaaatgacatgaaaaaaaaaaatccctccatttaccaaaaaaaaaaaaaagttaaactgtttctatttaaaaccctcaagtattttgtcagttgagggaactgaaggttcggagtctgggtatgtttttctgctttgtagcctctctctgttgatgtttttctggctttctaagcaaaaaggaaacctcacccattcctgtagacatgcatttatgaccacattctcctggccagtaaccctcagtggctcgtggaggctctctcaagggtggcatgtcaggcaaatggatttggctatggagctactgcttctgtggctactactcagattcaacgcaggcgccttcagcgagggctccagggcaaggctcactcattaaggacaaaatgtgcaggcacatttgacctttggaaatccagccctggtctgaagcttccagattcaaaacaaaagcttcagggccggaaagagagttagaggaggcacacttcctagcttggggcccatcccccacacattccccctgtgactgagaggctcacaaaaccaatagagcagcattattaactctgcaatatcataagagagggcttcgctctctgccttggtggagagagagaggccaggggaggggcaggctggctccaggggaaagcatgcttcattagagtcttaactcaagggaggcaactgcttgtgtaagcgcaacagatgaacgcaatgtagagaggctcccataaaaaccctggccctggtctaggagtcgtcacagcgggggggagaaaaaaaaaaaaaagcatagctagactgagcaaaggctgggtggcagagagctgtcatttggcatagacttccaaaatgccagcaagtgaaaagtcatgtcaagggactaacctaaggcagaagttttaaatgtgtcatacaaatgggatgctccttcatctgcagtcacaaattttaaagcatccactgtcaatcatttttcactctgttttcttgggttaccgacaagtacccaaatgaacacttatacattttttcaccagaacgaaataatagctctacttcatgaaaatgacaccaccaaccctatccttgtgttccttctgatttgcctaggactcccacccagctgggtcactgtttccctctcataggtcatatgacccaagccaactgcctctatcaccaactcccatgatacccaatgaacacagggtggctcagtcttcccctttctttgaagatctgtgctggtctttcggtcatcctgccactatccccaagcagcttccatatctgtcatttcagggcagcaaatctgctgacattaaaagtaaaccaactaagttttcaaacacatcttagtccccaaatccttcctccagtcatgcagatcaagtaaatgtcttatctttatgaagtcgtggttggcttcagcttctccaattctggcgtttgattctagatagaaggttaagtaccccctgttgcacatcagacttgcatcaattcaatccatttgctgttaaagaagcatcacacttcccagaaaggtttttttcccctttagccacataccaagccagaatcagacaaatgcagcctgaagtatttttagttattattcacatttgtcaacagggacagtgacaactcaccagtccgttctggggcagaacttaaggaatggaactctcgtatctatattgtaaaaacgaattgccaccactgatgaccataactacctgctgcttacatgtatacagactttgttaggaaatactgtgcagtaacgtatcattaagaccttactggcaggctcagtcaaaatctcttatttgacatgatttaatatgtaacatggaaagacccaataacttttcctattcttcactcatttttttccaatggaagaaatactacaaatacactaagaaagaagttgagagtttcttttaatgaacctttaaacaataatacatctattcaacactggcaatatacctactatataaagtatgacaacttttttgcttagcaagatgaaaattacaggtagatacatggatgggaagttatcaaacccaaaaagagactaatcataaatgaaatacaggtgtcagttgtaagtgttctcaatgtctgttccattttagattccttttgagtggtaactgtaaactttcaggaaaagtttttgagaagaatatttttgggaagatgagtagaaatattccttcattatgtcagatgtgactgtgaatgtcactaaggagtattctttcctggcaccctaatctttcccttatttcccaatcacaatttaaacttctgtgcctatttatcttccaggtccacctctagactttaagttccacaagagcatgggcaatgtcaggttcaccactgcatcctcagcacctagcacagtgtggggcacacagaaggaccccaggaaaggaagaaagagataaggaatgaggaaaggaaggagaagggtggagaaattaagtgaatgaactaaagaaagagaaccaaaaaatcaccaaagagaaataaattatagcgatgaaattgagcattctctacttccttctcaagagttgcaatggtttattatgaacgagtgtgaccattctaatgtcttcatcccttgctgatgggtgatggaccctgctccagcaagggccagtcaactgcaggactacaagtaaataacattctgatataaagtgaccaacaggcaagtggacaggtgaatacataaagcacaaagccctctatgcagccagggtgtttttgagattctcctgttctcatctcttcatacatatcacccttccttccattgaagctaccatgtatattccccacattctctccattttctcttgcaggttactttgggggaattcaagacacactagaattaagcatatcttagatcactcccctcccctgaggactcccagtcactttctggcctatgctcttcaagtaccaaggcctggaacaatatggatttgcccccttcccctgagtcagaccaatataaagctgtcactgctgcttcccgtcttgctttctgcaccagacccctttcccttgctttatgggatcctcccctttacctcctctggaatattcccttctctcagtcttccttctccttaggggaccctttctgttgtcctgtgtttcccttggggatctccactcccacaagtaagtatcttccaggatatcctggaagtaaggcttctggacttcctttcttccttttacttattcctgctcaagagagaaagtggtagcattggaagaaaaaacaaaaagaagaaaaaaaaaccagaaaaacggaagaaagagaaaacagtgcatggcccatttgtctctcatccggcctctttcctggagggctttactctgccctcttccatgggggaagcagcttggggccagaacatgaatgccccactgatgcccagataggacaggtagggcacggacattcctggcaacctgctattctatgcaacatatactttcccatggtataagtcagcccatgggctagaaggggttgggcacagggaagtatggggaagctaaattgagactgcacttgccaattgggtataaatccagtttcattaataataaagctgatatttgacctctgtctggttcctatacctatcttctcaaataggttaagagaggggtgaagtgtggcaaatttgttgctcccattaaaagaacagcaattgtactgtaattatagacagtggttagtggtccaaattattggtcctcttaagatgcctgctgttttttcagttaacaaataaaatttcaaaaaacagaaacacaggataacataagtggtccaccattccatcacctaaattgctcttaaaaaaattaaaagcaatgatcatatatgaaggtcaaaaacattgaaacagaacagaaaaggtataaaaagtaaaaatctgactttctttgcccccagcactctcccctccttctccctcaatttgtcaagtgcttatatatccttttatttgaagtgttatgcatatcagcatacataatagacacttttattccttctttttttccctcatttacagaagataattggcttttcattttaacagctgaaaggccccaggtgcagagtggctggggcggaggagtctgaaggcttctatcccccactccaccctctgccatggctcccctggccccataaaggtttcacccctattttctaggtgttcttacgaccacacccacccaattccctctgagaaagtggctcaaaataaaatacgtcttaggatagctacatgagatggcgccattgggagaagctggcgaagctcctgtgtaacacgatatgccggatactaacaccagcccctcgcctcggtggcttcgatgggttctgctggccaaagttgtaacatcagccagttcttgaaatgttttaggaagcgtttgattttctttaaaagacaaaaccatgttttccaataaagctaactgcagtgaacttggaatgttaccacttgatctgaagcattttttttttaatagttaagcttctacccgctttttaaaaatcaaaactaaaccttaaaagtacataaatatttaatttcacagagaaaggtatggctctccagatggggagtctgtccaattcatgatctcaagcattttatggcaacacttccctgtaaatcaaattggtggcaaaaatccagctgcatactcaagtgttttgtcacattcctgatcccagaatttaatttctcatgtggaagtttgagccaaaggtatgtcccaacaaatccctacagaggttggttgagaggctgacattcctgtccctcttcaccttcacttactcatggaagtctggggccagggcaaatggaagctgtgagcttcagggacccgctcgacttgacctagggtctacccagtcaggcacagcaagagaggctcctcccaagccaccatgcggtactgcttcccatggtcattctacatgcaagcttttgctttgaatggatgtataaagacaaagctactcaacccaaaaagatagtaatgagcaaaaatcctggtagcctagtgatcagatccagcccacaatggttttttgacatatatactactttcattttgcccatatttttttaaaatcaggggacttcaaataaaaattcagatttctagcttctcttgaaaaaccaaaagatctggcgacaggttctgcaactctcttgagcagtatttggctggagatgaatggcaactgccccttcagatagggtctatactttctatgtcaccacagttcccaccactctctagtgccttatactgtgccttcctcactcactgacattaccaggctgactccccggggccatctttatgactcctgctctctgacttttcctttgccaacatctgctttgggggcagggatctcctatcacccctccaccctcacctgattccccattctctaaattcttggtgcccttaatatatgatatacccagtcattacctgtgtcatctactgtccttccttttgttcaagacaacaaaaacaaaggaatgtctccttacagccaactctgtgttccacctaaaggatgcagtttccatcagctcttagggactgataaatctgtcttttccccagtcccacccagtcatgttgatttcatagtcaataataagaaactggtgtgttttctttttggagatgatcttcaataattttctgaggagaaaaaattaaaaatctgttaaaagcaacacccccactcagcgctgtcactctctctccaggaggctctgcctttgtcttctagactagccatacatttttctagcacttatcactgctgaggttcagcaggggtgccagactaacatagagaaaggggcctcctgggcccatatcccaggcttgcccatatctgctctactggcagcactgttagtagtccaagaaatctctgatgatccatcccggctgactcctgtgctcacactctgctcagcggtggtgctgtccactgttgataaggcactcctgccacagttttggcaacaggaagacatcgggagagcctctcacagacagagctgcagatatgccttcatttcaaccagtactctaggtaaggcagtatgagagtgcagctttgtacctgacacctgggctccccaatccttgtcagtatggcacctgtcttaagcaggatgtaaatctcaacatattcatttgaagagttcacaggggcttggccaacacagtcaatgtggtcctcgggtctgagttcaaccttccttccaagctgcagtaaccttctaccaactttatcctgggctaggacaagagtctgcatctccaagagcaacatactgctctgtcattctgaccccagtgtgccataaactaggaggcttccatggacgtagacatataggtaagtccaggacttcctatccaggtaagtccccgtcttcttattatctaacaacatgtgacagtgtattgttaatgagtcactgtagccacacagatgtctactttcagaagcaaatagtccccagaattctcagttttacccaaaacccagacttccttcatccctgaataccactaccaccctcccccacaaccacacacacatacagacatatacaaatgcacatgattgtttcatgaatgtggtaaaatacaattgttaagaatgtattttaaaaactaaagagaagcatattatatctatccaatagttatacaatactgtattccacagactaagtttactttgcaaaatttagcttaaagcaaacacacatgaatacacacgaaataaattacaaagttttacgtccccatttagacaaccagtaggaaatttttcaaagtaccacaattaaggttcaagtaacagccccactggaacaaataaaaagtcactaagttcctgctcggaaaactgaatagaaatcataaagaggaagaaagccaacaagaagcgatagtttaaggcttgaaacaaaagcctcccccactgcagaatagaaaacaattacaccgtacagcatgtaacagtttacaaagcactctcacatccatatagcatttgattagagcaatcctactatcataagccctgcacttcatatgggaaatataatttaataatttgctttgttttatactgataaagtcaggactaaattccaggttttctgatgccaaatcccttgaattttccacgacaccggtatttttcaaacttcaatttcatttcaccttcacggatttttaccaaatcagcattccatctgtacaatcattcccctattgttttcatttttacttgcctcactaaggcattatatattaaggctgcatgtgttttaaattcttttcctgcaaatgttcattaatagaagataatcataaaattaaaaacaacaaaatcaaaacaatattacaaactttcaactggaggtttgcctgtcaaaagctctgagtgtaagacctgttctctttattaaaaaaaaaaaaaaaaaaaggaagaaaggaagggagggagggagggtgaaaaggaggggtgaggagagtttaccaagccttagagaggcgttaaagacatggcacctcaaagctgactgtctccttgagttaaaaggactgaaagaaaacagcaatgggaataaaactgcctcccgaggtaattctgtgttatcaacactgcgcttatgaagccctgtggaactcagcccacccttcgagaagcagttccctcagccatgttgcaccatgccttgtgttaacatgtgaatatgtttaaaatattgcaaggaggctcacaattcttgagggtccaatactggcttgggcttaaataatgatctctgaagctcaggccagttatccgcaaattgaggagggcaggggggagggatcggaaagagatgtctaatactcctcaagttctggtatttgtgaagtcctagtctctataaatatggggcataaaaaagagctcctgggtgcaaaagctggaggaaaaaggcaggcgcatcttgggtaggaggacaactggtttgcattctggttctcttttgcagggaaaactgtgcaaggacattctatgaccacataatgtctgcctttccctttctttttctctctcttcctttttagaaatatttttcagaaatattttaatagtagctaattcacacagtcaaatagtcattggttttgaaaaattttacacacacacacacacacacacacacacaaaatagtaataatcttgggcctttatttggcactcaaaattttttaaaaagaaaaaaaagtaatcggagattggaaaaatggaggaacacccagcagcaagtaatttttttaaatggctttttttaatcaggaaaagaatgaccctaaaaatcaccatctggtcaacctaaatgatatccttagtaatgtaagaaagccaatataaaagaaaacactttttaaaaacacccctaatgtagaatagcatcctaaaagcattagaaaaggaaggccaagtgccttgctggcagtatttgagtgccaagggtaggaagaaaacacattacttgattctcaggaaagtactttattataataccctggactttttcacacaaaaagcatcacttcctcagtgaaacaagtcatataaaatccacttccacaaaaaaataagcagttacagcggttaatggaattctctacaacatgcttctatgtcagactaagaaaactaagaactggttacatgtttttcttacacacacacacacacacacacacacacacacacacacggagtttttactacaactgaccagctgggtctctgggagtggcaaaagaaactgtgacaatagcaggcttttttgttaatgagggatgtctgatgggaaaaaaaaattgtttggtattgtctcattttactcccacttagaccaagaggctgcatgctcaggaaaatcagtcagtttccaaattggaaaatgttacaaataccaataaggaatgaacatgctctagagcaactgctaagcccaggcagggggaggggtgaaccagatggtcttttccatcccagatttcgatgatctacaacagaacctgaatgactaggaaaaagtgagatgcgatttggaaattgctttataaaatagaatcccaaacaaagacactcaacaaggcagagaaatctaaaaggaaatgaaaatggttctgggtgagagcagaaagcaagccagtttgagactgtgattgataaataaagcttgtccccaaatcagaacattttggagcggaaggtgccttagagagatgctagtcacaagcccaaatgcatgctcactgggccagagatcagaaattaagcgaggtggaaatagtggggacagggttaattgaagagtgcacgatctgtctaaaagcattcaaattaaagggaattgaaatatgcatgccggccaaataaaacacatcttcaagccagttcagtctaggagcttactgtttgtatgtctgataatctcactgttcctaaatctacctacactgttcacatgaggaaactgaggactagagaagtcacatcatttgatgataaccacagagcagcgagtgtatacagcaaagccaaagtgctaggattatgttacacaccgagatgatgttaaacaacagcaaaaataaaaatgacattaacccaaagtcctccgcacacctttggttcaggtatactcagttcacatggtttattcttttaagaacaaattaaattatcatctagttaaacacaaagctagtgagaactgggggaagaaatagagggaggtcgtactaaaaaagaaaaaacaacaacaatgaaaggttcagagtcagacattttgtttctcaaaaacaatagttaaatttatagttaaatttactgccctgagtcagacatggcaaacagagctgattttacagagaggtaaagtgagacacttaccatggctgtgtcatggtttattttgtaatatattttttaaagttaggtgttcaagtttccttctagatgcttctcaaagagcaaagtgagaaaaataacttccattcctggtattggctattaagaatctttttttttttcttaagtgtaattccaggggaaaaaaaaacctcagtgagatatatcaagtagtggaaaatctttgcaggaaaatcatgaagtagagagaaagatgagaacatcctcccttggggcagctggaaagagactagacaaagaactgaaaagttcctttggggagcccacctcctgctagccaatgggactttccttccctggtttctctgtagctaagaaaacacaaatatataatctacagaaggagagaatgcagccttcacacagggctggcatctctgaaataaatctctccataggtgctaggctaaaccttaaatatgaagatataatcttttgagttttatagcagcatatgcatgattcttcccctcccccataaaactctcaacaggaacaaccacatcaaattattgcttttcagaggccaattcaaaaacaccctactttatcacagaaagaatattccttatgtatgtgagtgcttccattatgtcttatttgaagggggaaaatgaaataaaaatccgatctgagatatttatagatctcataaaacctgattcactctcataagctgcagtaagctcagtcatcaggtaaggcagaaatggcaggtgtagtaaccggcactgtattatgttatatatgcctaattctggctcttaaaaaaaataactgcatgctagaaaaacataagatacgtaagtcataagtcagactggacagaaagaaaggggaagagattggacatttgcatgaacaagccaagcaaattccaaggatgtcaaactaggcccagtttccgggcacaaagggtattgctagtcctcccccagttccaagcacaaattacttaatgaaagtttcccttgtggatggataaaaggtataccatatccaatgcccagcattccgctttcccctgccttccatcatttattgtctcttgggcattccaggctcactgggatcttcaagacacgaaagacaccactgagagaaagagcattgtgcctctgtgtattattattgagaggaaaatggggaaggaaagagcatttgttgagtggatgttatgtgccagacactaggtcagagagctgattcttatcaggaattaagaactccacaaatgacaaacaagactcagagatgttaagtgactttctcaaggttccacctctgcttgatttcaaatccttcatgtaatttgtctactatgaaacactgtgaccttaaaagtgcctcgcacagtccagtccttttacagataagaaaaccaaagcccagaaagaagacagaccaatgaactactggaatccatactgggccactgactgccaggtcacgacctttggcttctgccctaatgtcccctacctaaagagcagtcagtatagatgtaacaattaagagtgctgggccctgctgaggcttggatcccagctcaaatacttccaagttgtatgattttaagcaagccattcaatacctcaaatctcagcttttccatctgtaaaatggggataaatagaatacgcatttcatagagctgttgtgagcattcattgaaatgatggatacaggtgctcaaatgagatcatctttaggaagtgtctgatacatatgagacagtactatgatggttatttttatgacaggaagattagccaagtggaaagagggaagagaaaatttattccaccaatggttttttgcaactcatttgctttgcagccacagtaagacaacttgcttaagcttcctgtgccccattttctcacccctgaatgggaaattctgtaatatctgtctgctccctagttaaagaaagaatgtgccaatgacaaaagaccaggagcaaaacaccctgagcccttcagaacaaaggctcaacacagatgtttgttacattctcatatgcaaacataaaaagacccatcacagaggaaatcatctcttgatccgtattaaagaaaagcaagaaccttgagaaggggaggagaatgtacaaattagggctgaacaatcttggaagaaatgaagtcgactcaggtctgaccttaagcagcatctcatcactctcaggggaatcagttctgcatagggcctcacagaagacatccttcaacaccatagtcagaagctgcacttcactaacatggtctgtagtgcccatatgaacaaaggctaaaagctcaaaaggcagggggtgttggggtggaaagaatctatttccactcctttgtatgctgagcaaatttgccgcctctccaaaaataagcaccaatgttatgaccactccattgaattcctgctaactcggctctggaaggtgaatgtgagaacggcgtcaagagcaggtgggcactcccttgcagggcaattgctccacggctaattgccgttttcacagctgggttgagctttccaaaaggcatccttcaaccctgagctctgagctcctctcctgatgttctctcttgccaaccatacccccatcaaagacagtttacagatgaaaggatgtagctacaggacatacaattttgcaaacatcacagtttgaaaaagaggcgtttctaaggcttctttgtgaagatcaccacacgcccacagtcattaccacaggagctaagccttctatgggtgtgaaggcagcctccttgccggaatgtcctcagcagcaattcttccacagtttatttttgctcctcttactagaaagatggatcctctgaaattctttataaacagagtctacttccaaacactgtggttggtcagtaagaaaatggagagctgctacctaatgcctctccagcatcatccaacagatgtacatgcatgcatccagccctttcaaaccatggagcaggctgaggtgagtggaaaatcatggccaagggcctactgagaatgaattgtttgaaacccagcaaggctggagtttaaagcccaacaccacaaagtttccaaatatggaatttgaccaggttaagcaaattcctgatgggtcacaggaaatgtgagccaaacagactgccttagacactttagggtgagggaaagcaaagcaagaaggatgaaacaacacttgggcagctgctattaacaaaagtgccagatgaagcacatccaccagcatgatcctgttttactataaacctctggtccgtgtggattccaaattacacaagtcattaaatatttcaatataagaagcaggtaaccccaactctgacatatcattaaaccctctatacaccaatggctcaatgccttggctgcatactggaattgcctgaaagctttacaaacactgatgcccgggtccttcccaaagagatactgattttattggtctggggtgcagccacgattgagaaccactgaaaaaggcatagtcaaatcttaagtcatagtcataacatgctcctcaaataactatcgagtgcccacagtgtgcaaagctttctaagaagcaggtgatacattaaaagttgactaccaaaactatacgcaaggcatcaactccttaaagcataaacttaacaagaaaaatgacacaacagaaaagtaaaaaaaaaaaaaaaaaaaaaagaaaagctttattataactcaaaactgtaaagcatcacggggaagtaaaaagctctgcacaagagtatggaaatcatagcagttacagttggctggtagcaagggagggagtttggcacccatttgaaagttaaggaatgggtggaacttggacaaagaaaatcaggaaggggagagggaggaagaggaaaaaggctaaaggaaacaacaaaaataaagacagaagcaggaaaagcatagtcacttaatttggatggcatttactacatgtgaaaaggggggaacttgcaaatattgtgtagacccagtcttggaacaccctgactcttggaagtttggcctcatgctatgtataagagggagccatgaacagtttgaaagcaggccacctggggtgatggtggcaaaaaggcaagtccagggaggtgacagggattgtggcaaggcaatggccaagggtgccatccatgacaggctgatgctaaagcacctcagaagccaagtcagtgggatttttcaactaattttagacttccgctaattagatcttttcacctaattttttattagattcaagaaaaagaaaggagttacaatgactagaatgtcaaacctagatcatgagacgaataatcacattattaaaagaaatagggaagccaggaaaaaggaagcagtccgtggaagaagttgatgagttaggggtttaggacatattcagctgaagtgatggtagaacaaccccaaagcccatcttgcttgttgcttatttctggttagaaaaaaatgagggcctgaaacccagggaaatatctggaggtggagatgtagagtatagctgtgaggagatgaagaagccctgaactgggaaggagattttaacctctaagatgttagaggtgaaagagatctgtgagacacattctgggagagaactttcaccatcataactaccaattcaaggaggtagggaagggcaaaaagtaactggggaaaaactggggcaaaaaagtcaagtgagccttccattttcctttcctcattagggacaatggtaaaaattaggcctacttcatccatcagacctcaaaagactttttgaaaaacctctcagaggttgagtttcttcactactgcttattacaaccctctcaagaatttaaaaacatttaaaaagattttcatcaactggtacatgggttgctggtaaagtttcgggcactctctttgttggtgaggtgccagaaacaaagcaatttcacgtttgttgctttctacttccatctagttctatattccatccaaccccctaccacatatgccccactgcacacccttcatactcccactccatttgttattatttaaatgacaataatttttataagactcgagttataatctggggctattttttcggtacagtgtatattttccaatttagcacacattaaaagtggaaaaagaatcaaattacacaagtaagccttctccaaaatattcgataacttgttctagaacctagccaatcccaaaattccatgaaccagtagtcttaaaagtaaaaagggaattttcttgcctcctttgaaggcaaaaaagaaagagaaaagaatcagaagtgagtcaaggtatattcaggtgacagaaagcaagtaaactggtctgggcatctgagagtcctgggccctgaaaccatcagtgttaataagctgtgtgaccttggagagtgcaatgcctcatctggctttaacaatcacttagttcaacccagtattttagagttgaggaaaccaagaccctttcaagatttgaaattctgagattctatgttcctcgctttggtacaaggctgagaacctgactttcaaaatgaccctcaggaaatgtcaatacacccacattcaaaaatagatatcgcatatggctctacgttattttaattacctctaatcatttccgaatggcacagacatgggcactgtttcctggccattatggatatgtgtattcacattgtatactcatctgccctaaaagtatccagcccacaacatgacattggctgaaagctttttcacaacagaacttagtaaatctcaagtatgttttataaacaaggttggaactatgtgggtaatacagataggcacaggtcagtgttccaacacagaactgaatgtttctttctttctttccttctttctggcactcatgctctattctgtttaacttaattttgaacatgctttctctgccttactacagtcaagctcctagagggcagattctatatccaattcaattttgcattgcccaaatacagtattatgcacataaaaagggcttaaggaatgaagtatttactgtggaatattttctatacttgaatataaacaacaaaaatcccacaaagtgtgactaggtccatctaccagctcaatgaagaatggtatccccctgaaatcagaagtcactcgcacctcatttgggctgatactagactcagatctcaaggctactgcaaacgctcagctgtaacatttatatatcaagcatgtggtactgctcgaatggaggggggatggacatgagtcgtttaaacgggaccaagttcttagggtcacaccaaataccccgagaaggaaaactaaagggatgtagggtggtagaaataattctgccaattagcaggaactaatctgggcaaggtggggcacagcaaaatcacaaacaatcttaggtaaaagcatgtcccagtaatggcaacattttgtttatttggggaattttagatagaataaggatatgtatattctacaatgagtatacagagaggagtgttttttaacttgtcaatgttacatgtaacatgaataattagacactataatttgtttcaccaactttaacaccattagtagttgagttttctaatcactgtacttggtaagattcggcattttggggttaaaacattccgcccccctacccccaatcgtttatgctaagcaagcagtcagttgatttgggagaacaaagggactactggacagaggaaatctctgcccctcaccctctggcaccattcaagttaagttggggagctgtcctaaactttcagcaaatcgcagttctaacacataggctaactgatatatcgagtgaactggaatcacagagcgattttctgcatttgccagtcgtggggtccagcaaagataattaaaagcccattgcacaatactataaaatgaaaagataaggggtatccaccgaccccgtctggaatcagaccagctatcctatcaacttgagccagatgggactggccagaggaaattgtattcttctttcctcaacaggcacagagagcaattaaagaagattgcaatgtcttcttgtactccaaaagttaaaacgcaagaattctctgaagagagtacaatgtgaagattcataaaagaatggctattaaaggccccattaggaccctctctgaactatctccatttaagtagagaggcaaattagcccccactggcatttatgtttagaatgggctggcagaaagaagcagcccacatttggatgcttaaggtctctgacacacccatacataaatcatttcagggcaaggctgtcatcttgcatcttctgctctgccttttaaatggatgggaccccaacatcccattctcctcagggtaaggagtgggggtgggaagttcatggagaacaaagaatagtgacctccttttccccctactaaggacagatgtagtaaaaaataactgcattataatgtttgcccactttaaaataccaaactgcaaacaggtagactgaatgataatgtttgaagcccctaaatctacacaaagatgtgtctgttaaaggaacatggaaatgaatctattaaaggctaagtgtgtgattgattgcagtcacatgtgctttcatttgtagagttacatctatttagtgattgcatcttcataaagataaattctgggtaacgggcagttatatttttatttcatctaccaagttgctgtttcaaataaagaaacagatttacagtaactgaagaacacacaaatcacataccaaaaaaaaacagttattttatcctttcagtgtggctagcaaggctcctttgtgtctacaaatttccctgggtggtgctgttgccaagaaattctaattcatgacaaggctatctgcgaattggggactgaggcaaacctacggatggacagaccctacagtttgctttgttttcctggctgatatagcacctggcagcccaggcctgcagaaggaagtgcaaaggcaagatcttcacataaaaggagaagcaatgtggctcacagaccaaatcccatccctggtaccatgaggctgttcttggaatgcaaccatttctgtacgttttcccctagagattccttataccaaaggccctcataaaaagtgtttcagggtgcctgaaaccaagatgaaattgcagtgttatggggacactttagtccttacagtagccaagtatgccattagtttaaaacaataggggaatgggggaggagagaagaatgttctatgatttatttatttgtttccagtagcagtggaaaattttctctgagcaaagagaggcctgaaactgaccccatctgccaattatgaatcagcattaacaacaaacataattccataagacttttcaagcaaacatgcgatgctcctcaatgacacgacgcaaagctaagtccaaataagacttagatcatcactgcttgacctgcactcatgaaatagcagactagagataaaacatataaaagttctaaaagtctttgtatattcaagaagaaaataaaagcattgtatcaaattctttttattttccaagtcagcagtgtgtctaaaaaaaaagattatgatttctattggcaaaaaaagtcatgaatgagtttccctttactcataatcaagtggtaccccataagaaactctggtttctgtcctacccttgaccttttcctacttttgctcagacagctcttggaaattttcctacaagttttcaaagcgcttaaggctggtagtcttaagaattgcgcgtcagctgaattctataaaataatagaccacataagcacagtgtaatttacagttatatgacaggcagaaagatgatgttacttgggccgagtgcttaagtatgcagtcagagcccaggaatggagagctgttaatgtgtgatgtccatttggatttcagaattataccagcaacgattattttcagacttggagctatgtggctaaggcatcattgccagaaaatccaatgtcaaaacgaggatctccgtgacgagagggagccctgccacagtcagtgactttgtcacaggctcactgactattaagcaggacaattatcccatatcctaagtttaaaataaaatccccaaattgtttatcttcaattttcaaacgtaaaaatgttcttgagtttatcatcgaagccactctttctctagaaaccaagtcagattatcagagtctccacattttgctcatctccatgagcccaggtacattgttcactttaagaagaacatctaataattactcctcatttgacctctaaaatctgattaccccagagcataaagaaacttcttcctgtctggggttctttgcagaaaccctgttgagctgttttgagcaaaagagtctcaaaatttcattatccgatagttgatttggaactaacagttgcatatcaccatcaccaccccttatactcagaagcagcaagacggttttgggagggggaagaaggaagggctagaggttaaaggttttgtcatcagtgtaaacctatggtcctagtcgcctttatatagagcagttgtgattacggagtccagaacataaagctcactggagtgatatattgtttattagtgcttccccacaagctatgcatcagcattggctataagcatgacgctgaataagttggctaagggttttaaggtgagagtggctggcagttggagagggttaaggcaaaaaatgagggggttccgaggggtgaaaaatcctttgcctgtagaaactaaactagagcttccctgaatggggaggaggcagaggagcagggggaggaggggagaaggaagagcagagatggcttcttaggaaacaatagatctaatacatcctctagttgtcaaaccgatgatgtttctttgcagatctagagtttgtcctggatggtctagccagatctagaaaagcaggtttcctgtgaagagaccttcctccaaatctggctttactactctgaaaacttgaaccaaaacaaagttgcatgattcatcagtagggaacgttctaacaaataaagccaactttcttccttctaacactgcttaacagttagtcacaaacaagggctgccttgggcaggctgactaaatcaacagattcccttctctaacctgtctagacagttgttaatatgcaaccgattccataccagtgggctgacagtgtgaaatgaaggctatttcagaagattttggtttaattagcattggaaataaaaggaagaaaaagatccagtgagacccttcatgagacacactctcgttaaggataaggaaaaggatgcattgaagaaagactttattctaaaaatatgtgaactgtgtatgtgtttacagagagacagagtcaagcatctgctagcgtccttggacaagaatgcatgtgtggacacagagacaccagacgccaatacctggaggaaaactcacagcctctgaccagaagtgaactagcaacaatggtacagttaaaggatccgccttgccactcggctccttataccaaaagccaaacctcttttgctaaagcagagactgttacatctcagcctcaagctggcaaatcctgctttggatcccggcagaggaaattcagccgttcattagccttaacaagctgctgtcactaagcgaagaaattacacgagcagccacacaccgagcctctcacagccctccccccaagggcaagcgggtttctccaggacggactgtacaagttcacacttcctatgtgcaaatccggactgtcttcttggactttccatggtgcacactgtacaatttttaaatacccgtgtccccccgcccccacccaccatctttcctgcagaatgtcccctcagcagctcctaatcgctgctgaaaaaaaccactgtttccgcagcagagccagcactttccactgaccagcactttctttattccacttcacaaagcccagtgaacttgtcaccagccccacttcatcctccctgggacggctagccaacttggcatcggtgcccttcagcatcctgggagtttcttaactagtcctctaagacaaagtcaaaggcatggaagcacacatcagcctttgtccgaggttgtgctgcctaactagagaaggaccctaaacaaaaaagagaaacaaggacacgcatagagggtgttctctttctggagggatcacactgggaaaacctacaattcattgtcagcctcagctacatcttcccgtcctccttgagtatcttttgtcagtgggctcttctctcttttgcctaccttctaatctcaaaatcaagctcctattctttattgacactcgctaattactgaaaaacactccgctttgctcctgcccaccctcccccgccccccatccgatggtcataagcaccagttgaaacagatgaacctgatttcaggtatcaagtgggtagagctcatgcatgcgagaacgtggtccctgtcagcaatcgctcctaacaccccaaaccaccttcccacccggctcctccgaaccccagaagttcggcaggtctctgataggggacagcaaacccgacaacgtgtgcgcagggatgtgtgttggcgactgaaacgcaggcagctcgcaccggctgctcagctcggcactctacgaggttaggggtgggtggagaggtaagcgcagatgactgtttcagaaaacattttcaacaacagacagccaaaaaggaagaaaaaaaagtcaaacaaacaaacaaaaatttcaacccagagcccacaccaacgcagcccctgcgtctccgccgccaccacacgatttacacaagtaatttaaatcattcacctgctgccaggtctcctccagggatggtaaagctgagaagtagccggtgtcgtggacaagttgtagctcctggaatatactataactagccaacacgtccatgctgctgctgccgggcaaaacgggaggcgaaaccctcccccgaacacagttggggctgtttgtttgtcagtctgtctggctcaccccccaagaaggcagacatccagtggcccttttgttttgttttgtttcagtcaactaaaaaggaaaaaaaaaaatcaatgcaggagagggagagaggaggtgagagaggagcgagtgagtggggtggatggagagaggcatccagcgtgtacagtgcagacgactgccaggaaaaggggacttctccacgggagtaacaattcccttccagggctctaatcactccagctcgtggatcaggaagggggatgcaaactcactgacacgaagctgccatctatttctgcagcgctgttcgctcctaatgcaatctttgctctttattttgggaggttgcatttttttctctcgcgatcgcttctcttccccccccttcccttccctccccaccccccaccccatccttgctagtttgtagtcttccccctcccttttctcctcctcctgctcttccccctccccaaactccctccctccgttcggttctccgcgcagccgtgggatctcgaggagggcgtccattaggccgcgtgtgaccatgtaaggtaaacagggggctcatgaagtcactgaggaccaatggggagcccggagcagagcctggggcggggcttggccctggcggcgggcgcggattggcacgctgcggatctccctgctgccttacaaggcggtgcgaggcgagctatttttagagggctatataagggggctgaggcggccgcccggcggccgggcagcgcgagcgcaagggacagggagggtcgtggcgacactcgcgccagctcccgggacggctgggctcgggctggtcgccgacctccgaccctccactagatgcctggcagagcccggcgcgtccggagcccgcgcccctcagagggaaggggtcgcgcgtcgccgcggcggccctgaggctgacggtcgggaggtgaaaggccggagtgcggggtcaggacgcctcctggagggggcgcggcgcagggggccgcggggaagccgccgagggcgcggagcgggaaggaaggacagtggccaccccgcctccgcctgggcacggggcagggacccgcgcgaggcggtgccggggaggtcctcacgtactcaaaaacaagcagaaaaggcatccagggccccttcccgaactccccacgggctgccagggtgcagagaagaagcgcctgaggaggaagtgccacacaatgggagagaacaaaggggagcggagcgagaccgcggcctgcgcccgccccccgcttgcgcacagtccccgccccgccccgcgggcgccgccgccgccgccctccctcccgcgcctccttctgaccccgagcgagagacctggtcgggagtccggcggctagagttgattgcaaggggcctgttgctcgactgtgcgttaaagaggctagagggagcctaggtagacgtggggcgcaagctggagccggcagcttgcgagggggcctttacgtgatgaggctcaccatggggtctccagcgaggtgtctgcagagcttcgatggtgagaggaggaactcgatttctcgttttctggagttgggatgtagacatagagagatctgttacatctgagatgaaaaccctgcacaattcacgttagggttggccaattgtttgcttgaccttaaatggttagtgtggtttaagcttccccaaaatgcgctgtgagctgagcttccacttttggaatgattgcagaattcggtgcttaagagatgagaaacttcgttctaccagtaatggaagaaacgcttcaccttaatcaccctccttgtctttcccctccctttgactatgtaggactcgataacacaacatttgaaagattctactctatgaaataagcacagattgaaattcagtatttgccaaggaatattaaacatgaattactgggattgaggaaagcctgatttatttacttgttagtgtctggaattctgttggccagattcatagcattcattgtatgagtataattggaacatttactctaatgtagatgcagatgcatctgcaattagatgtgcaaggacgctgccagctaactagctgcacgactttgagcgaattactgggtcagaacttgtatctacccatctcagaaacagaaatagtgggatccgcgttgtctagttgttatgaagagtcaaaatatctttggtaactcacctagcatagtatctgacactattaggtgaatactaaatattagctatcattgtctccccacttgagctatgtaaactaataggacctttaggagaatatactattaatagaatcttggagatagaggaaaggtagaaaccccttgctagtttgttacaaggtctccccttctccatgctctcccctgacccccatgctatttcaactggggggatgggcaggaaccattgagaaacactagggcaaaaaacatgttcatgaataataggggaaggaaaggaacttgggtatagaaaactagaggcaaaaggtgaggcaagaccaaccatataatttggtacttgagactcaagtgaacttattttgtgtgtgttacattataacaatttttgaataaaataggacatatcggttaacgtgagtttgaagattttacaaataatagttcccatttattaagcacttcgaatgtgccgtatgcgcataaacactttatatgcaatgtctcatttaatcttaaggacagccccaaagtatccccaactttatggatgaagatacccacgcttggaaatactaagtaagttggtcaaggtctcacaacctggaagtggtcaagcaggggttcaaatccaagagcatctgactccccacactgttctgtactgagctttgtatggtgaaaaatggggttcctcagctttaagtcagtgtgtgtttacaaaaattgcttgggtggggccggaggaggaggcttccattgagacttttcctatgtaactatcagccgtctgacttgcaaaaggactcaaccaaaattttacaaagcaaatactgcaaacctcattatggtctttgctccaagctttgtagaatattttagattcattttaagagatttatgcagcaaggcattctgaaaggcacattttcaatattagttatatttagctactttttataccctagagacccaagattcacattgcaaaacacatgcaaggtatccagatgtacaaagtaatcaacaaattaagatcacaagagaactttggcagttcagcaaaccaaaataaactgcactgttgtaactaccacttactggttgattaccttctttgtacctagcattttacacatacctctgatctccacaatcctgtgagggaactcttagtgctccatttttatagatgaagatactgaagtttagagagtgcatgtaatttgctcattaccatgtgtccagtaagtgggtaaaagcagattagaatacaggtctgcctccaaatcgactccaaaatctgtcttctccacaagtattgccttgggaggtgttcattttacttctaataatgtcaatctttggaagtaatcctatagaaaacaccctagagtaaataataaattatccccccacccggggggagcttagaaataaatgaggatattttaagaataaaatagtaaaaatttaatatgtgaatacacacattaaaggcatcaggctgtttccaccagtaaagttttgcttcattagtgtaggaagtctttattatcccagtgtgattagtactcctcaaagtaaatctacttaaagctgggaccaaatttcagaccaatcagtgaagaaagctttgcttaagactttatttgaaaataaaactaaatgttattaaaatacattcattctgtcctatatgggcatacctcattttattgtacatagctttattatgccttgcagatactgcttttttatacaaatcgaaggtttgtggcaaccctgcttggaacaagtcttatcagcacaattttcccaacaacatgtacccactttatgtctctgtgtaacattttggtaatcctcacaatagttcaaactttttttgttattatatctgatatggtgatctgtgatcagttatttcggttttaccattgtaattgttttaaggcaccatgaactgtgcccaaataagacatagaacttaactagtgtgtgtgtgcgtgctaattactccaccgactggctcttcccctcctctcctcaggcctccctattcgttaagacacaacaataatgaaattaggccagttaatatccccactatggcctctaagtgtgcaagtgaaaggaagagtgacatatctctttaaatcaaaatctagacataagcttagtgaagaaggtatatcaaacaccgagatagaccaaaagctaggcctttacaccaaacagttggccactctgtgaatggaaagaaaaagttattgaaggaaattaaaaatgctactccaataaacacacagatgataagaaagcaaaacagctttattgctgatatggagaacgttttagtggtgtggatggaagatcaaaccagcaacaacattcttttaagctaaaacctaatccagagcaaaaccctgactctcttcaatattacgaaggatgagagaggtgaggaagttgcagaagaaaagttggaagatagcagaggtcgatttatgaggtttaagggaaaaagtcatctccatgacattaaagtacaagggaaggagcaagtagtaatgtagaagatgcagcaaattatccaaaagactgagctaaaatcattgataagggtagatgatgcagccttccattgaaagaagatgctctctaggactttcatagctagaggaagaaagcaatgtctggcttcaaaacttcaaaggacaggttgattctcttgttaggatctaatgcacctggttcctttaacttgaaggcaatgctcatttaccattttgaaagttgtagggcccttaagaattatactacatctactctacctgtgttctataaatagaagaacaaagcacatctgtttatatgatggtttactaatattttaagctcactgttgagacctactctttaggaaaaaagattcctttcaaaatgttactgctcattgacaatgcacctggccatccaagagttctaatggagatatataaggagttgtacatgttgttgtcatgcctagctaacacaacatccattatgcagcctgtggatcaaggaataatttcagcttttaaatcttattattaaggaaatacatttcataagactataattgccatagatagtgattttctgatggatctgggcaaagtaaattaacaaccttctgaaaagaattcaccatactagatgctattgagaacatttgtgattcatttgtggaagaggtcagaatatcaacattaacaggagtttagaagaagttgatcccaacccttctgggtgactttgaggggttcaagacttcagtggagaaagtaactgcagatcgggtgagaatagcaaaagaactagaagtagagcccaaagaggtgacaaaaatgctgcaatctcatgataaaaattacatgaatgaggagttgcttcttacggattagcaaagaaagttcttttctgagatggaatctacttctggtgaagatgctatgaacattgttgaaataacaaactacttagaatattattatacataaaatgagttgataaggtaatcacagggtttgagaggattgactctaattttgaaagaagctgtacttttggtaacatgctatcaaacagcattgcatgctacagagaaacctgtcatgaaaggaagcatcagtgtgaccaaatttattgttgtctttttctaagaaattgccacagcccctccagccttcagcaacccactctgatcagtcagcagccattgacattgaggaaagaccttctaccaggaaaaagattatgacttgctgaaggctcagatgatagttaccaatttttagtagcaaaatattttaaaattaaggtatgtacattgttttttcttagacacaatgctattgcacacttactatagagtatagggtaaatataactcatatgcactgggaaacaaaaaacttgcatgacccactttattgtgatatttgctttattgcagtgggctgtaaccaaagtcagcaatattttcatagtatgcctgtatttaacaatatttacgttgttagtatgactatgtgctaattgtaaaatgaataaatcaagaaagtgattgttggtttaatttttctacaaaaggtaaagcaccggttggggcccagaacacaataccccaatatgtatggcaccctgacatactgagtattttgagccaaaggagattgggagagccactaaagcaggaatttctctctgaccttcccctactcctattttctctcctgaaacagatcatagaaactgaaatttctctccctcaaagcaagccataaaacctaagaaggtcactctctgacctcctcccttttgccctgaagaccttcgtgtgacaggtgttctgcccctccctagaggccaaagagaatctgaacaaacaggccttgttaagtttccagtttattaactttaggccatacctcctttttatccaatcccacttcaacacgactgttcatcctttatcccacctaagcactaaaatacagttttccctgggtctttgtgtcttcatttttgaaggctcccatgtcatgtaaaactttgattaaatagatttgtgatacttatctcttgttaaactgtcttttgttataggagtgtcagccataaaccttgtgataagggaggaaaagttattactttttctccccaactcaacttacaatatgccttatttcatatttgacttttacaggataatcaaaaagagggtcattttgtaaaaatgttagagggcttcatcagtttccccaagggtctctattagttttttgtattcaaagtattctcttctgaatcagcaatatagtcaccctccctgttgatttttaccttcacttgttagtttaactctacaaatctctatttgccagtggccttatcaaccttactttcattgacatcataaaatctaacacttttggcacgatttgcaattttactttgcagtataattgaatatattgcattgtattgtaaatgtttgccactatgagagcaggagagaagattgttaagaagggatgtttgagtgggggactaatttataagtggtcctatcattaataaatatttttgtgtactgactttttcttcccttcaccatcttactacagtggaggaaagtgtgaacttgggttgtgtcgtagaaaatgtgagtgtcagagaggcggaggttggtaaacaagactgcctgagaaacatggtttgaatttggaagaacatgagaacatgtatgtggccacttgtgagagctgtttcataattgagaaaaatgaaatggtggtctcatcaggcctctagtgtcctggataaaaatatttcttgaaaatacgtctctctgtcttcattctgtgctcactttctgcccataatttgacttcccgcttgttctgcctacaggaaaaaatgaactggttacaaccacaggagcctggtcaccgcggcagtactattgctattgtcaatgcaaacatccaaagacattttagttaatatgtgtgttttttgtgagtttaattagcatgggtctgacttcctaggtttgtttaattttaagacactaacatattgagatttctagacatgatatactttaaaaaatggtctcggtgaattaaccaagaactcttattatcttcttcagaagacatcccaatcttgccactagcttttagaattctgtgggcatattacagtttaacaaaacatttatttttaaataaaatgccaaagccaaccctgaatgttacatcttacattgcaaggggtcatacaaaatggataaaagagggacctggtagattgtgagttatgggcgtgtgacccaggagacaatttgctgcttccttctaactcaggtgatctattgcttaacaaaaattcacctaccatcatgataaaggtaaggaattcacaagtccagcaaaagttcactgtcaagaatgctctgtccaaccttagaatgttggactttgaatgtcattatgacctgtgttacaggattcctgtggagataaatattagtagtcacttttctagcttgagctgtcagcacctaaagtgtcagtatcctctatgaagaacaaaatcatcatttgaattcaatcagtcattcaacatatattatgtaaaccagtcatttaacatatattatgcaaaggacttaggttgaaaataaaatggtaaacacagacatattaccaatatcaatttctgagagagtagtactgtgtctcagaagttagaaaaggcatttgaagtgtctagtccaaccttcatcagatctactgcttccctttgcaacactgcttttcaggagatgcccagttcctccaatggtagggagatcccagcaagcactaggataagctgctatgattgaacctgattggatgattttccccatctaagaatagcatcacaagctattcaggggtctctggacaaagattttggaaaagaagccagtaggaaatgagaaaaaaatttaaaaaatagtaaaaagaattaattttgctgtgcaatgacgcaaatgcccagatagttgtgaagccagtgagaaatcaagttgctaatgttttagagattcttagcttttgtggcatgtgaggcacaatttgtaagagtgttgtgtttcaacctaagcattttttgttgtgacatgttgaatacaacagtgtaattattaatatgttaaatatcactctcaatgttttatcagaatattatcatttttcttttaaaagtgccatttccaaagggcttggtatgcagttaatgggatttaacagcagaatgcatcttggattttgtaatggaaatcaatgggagaataagattgatttgatggaaagtctctgtactgcaaactttgctgacaatgaccattcctttaagtgagagatacctattccacaagtgctcaatgatgagtttttatgtatatgatagatctagatagtttggaaaattaataatgtcagaagcaggttttgttttgttttgctttttttctgactagtctctcatttgaatctgactaaatttcctttaccagaaggatgcttacttgagtgctttgaaaactcagctgagtcatagtttttaatgctggtccctgctcttctcaggagtaagttatcacatgctttaaaatcctccatttgggccggccgcggtggctcacgcctgtagtcccagcactttgggaggccgaggcaggcagatcacgagatcaggagatcgagaccatcctggctgacacggtgaaaccccgtctctactaaaaaatgcaaaaaaagtagccgggcgtggtggcgggcgcctgtagtcccagctactccggaggctgaggcaggagaatggcatgaacccgggaggcggagcttgcagtgagccgagatcgcaccagtgtactccagcctgggcgacagagcgagactccgcctcaaaaaaaaaaaaaaaaaaaaaaaaaaaaaaattcctccatttgtgccatctaaatgggagaaataatgcttcaatgcccctctcagaatgcttcacaattcccctaactctcttctcctcccgctttgcaatgctcaaagattgtttgaagcaaatgtggtcatgctttatactgtgtcatttcattttggcttctcccaaactgggcatcgtggaaggtatgcccttagctgctctgcctccctttggtcattatttgggaagccagtgcaatctcatttgatgaagaccaaaaggtagcataactcagagaggcttactcctcttacccaatttgtccaaatgggaaattccacccagctctcgttgtgccacatataagccccaatcctttccttttctgtgatatcaattttcaatctttgaggaatattcatgttaaagcaatcctcttttgttttgtcctttctacatgttcaaaactattattttaaaaaacaatttattaaagaacatacaaaatatcttt

SEQ ID NO: 1274 - DNA, 653370 bp, Homo sapiens
tatagaacactccacctaagaaaggcagaatactattgttttcaagtgaatatagaatattcacaggtatagatataccatatcctagaataaaaaacaagtttcagtaagttaaaaagtattgaaatcatgcagattatgttctctgaccataaataaattaatgagaaattaataacaataagatattgttatttctagcaaaaataataataatattattatcaacaataagatattgttatttctagcaaaagctcaaaaaattgagtattaacaacacacttaaaaataacatgtaggtcaaagaagaaaacacaaaagaaatatttcaagtttttcgttgaataaaaaatttttaattttcaaatttgtgtgatacatctaagactctacatagaggaaaatttagtgctttaatacttaggaaagaagaacagtctacagtcaatctaagcttccaccataagaagctataataaaacgatgagtgaagtaatcccaacataagtagaaggaaggaaattttaaatattgaagtagaaattgaagatacagaaaattaaaaaacaataaaataaaaactagtaaagccaaaagctgattctttgaaagaatcaacaaaattgacaagcctctagtttgactgatgttaaaaaaattgaggagacacaaattaccaatatcaggaaaagggggtatcattaaagatcctatagacatttaaaggataataaaaaactattttgaataactttttgccaataaatttgacaacctaaacaaaatagatacattccttaataggtacaaatcactaaaactgatataagaagaaatagaaaatctgaatagtaattctatatttacttaaaatatcatgatatgatttggctctgtgttcccactcaaatttcattctggattgtagctcccataattcccatgtgttgtgggaggggcctggtgtgagataattgaataatggggcagttttgcccatactgttcttgagatagagaataagtctcacgagatctcatgattttacaagggggagtttccctgcacaggtgctctttgcctgctgccatccatgtaagacatgacttgctcctttttgccttctgccatgattgtgaggcctccccagccatgtggaattgtgaattcattaaacctctatcctgcataaattacccagtctcaggtatgtctttattagcagcatgaaaatggactaatacagtaaattggcaccagtagagtgcagcactgctgaaaagatacctgaaaatgtgaaaatgactttggaactgggtaacgggcagagattggaacagtttgaagggctcaaaagaagacaggtaaatggggggacgtttggaactccctagggacttgttgaatggctttgaccaaaatgctgataatgatacggatgatgaaatccaggctaaggtggtctcagatgaggatgaggaactgcttgtgaactggagcaaaggtgattcttttatattttagcaaagaaactggtggcattttgcttcgccctagaaatttgtggaactttgaacttgagagagatgatatagggtatctggtggaagaaatttctaggcagcaaagcattcaaggggtgacttgggtgctgttaaaggcattcagttttaaaagggaagcagagcataaaagtttggaaaatttgcagcctgacaatgcaatagaaaagaaaatctcatcttctgtggagaaattcaagctggctgcagaaattagcataagtaacaaggagttgaatatttatcaccaagactatggggaaaatgtctccagggcatgtcagagacatttgcagcaggctgtcccatcacagactggaaggcctaggagaaaaaaaatggtttgtgggcagggcccagggtccctctgctgtgtgaagtctagggacttggtgtcctgtgttctgtctgctccagctgtgactaaaagaggccaaggtatggctcaggccatggctttgagggttcaagccccaagccttggcagcttccatgtggtgttgagcctgccagtgcacagaagtcaagaactaaggtttgggaacctctgcctagatttcagaggatgtatggaagcgcctggatgtccaagcaaaagtttgctgtaggggcagggcactcatggagaacctctgctagggcagagcagaagggaaatgtggggtcagagcccccccacagaatccctactggggcactgcctagtggagatgtgagaagagggctgctgtcctccagaccccagaatggtagatccactgacagtttgcactgtgtgcctcgaaaagccacagacacccaacactagcctgtgaaagcagccaggagggacgctgtaccctgcaaagccacaggggcagagctgcccaagatcatgtgaacccctgccttccatcagtgtgacctggatgtgagacaatcaaaggagtcaaaagagatcattttggagctttaagatttgactgcccccgtgaatttctagcatggggcctgcagcccctttgttttggccaatttctcccgtttggaatggctgtattttcccaaagctgtaccctcattgtatctaggaagtaactaacttgcttttggttttacaggcacataggtggaagggacttgccttgtctcagataagactgtggacttttgagttaatgctgaaatgagttaagagtttgggggactgttgggaaggcatgattggttttgaaaagtgaggacatgagatttgctagggtccaggggtggaatgatatggtttggctctgtgtctgcatccaaatctcatcttgaactgtagctcccataattcccatgtgttttgggagggactagtgggagataattgaatgatgggatggtttcccccatactgttttcgaggtagtaaataaatctcagtcagatctgatggttttataaggggtttctacttctgcgtctctctcgttctctcttgccactgccatgtaagaagagctcttcactttctgccatgattgtgaagccccaccagccatgtggaactgtgagtccaataaacctatttttcttcccagtcctgggtatgtctttattggaagcatgaaaacggactaatacatattatatttgaaatttatagtgaaaaacctttcaaaaaagtaaactatagcccaaaatggtttcactggtaaattctatccaacatgatgtagggaaggaattatagaaaccctatatgaactgtttcaggaggaagtatgctccaactcattatgtaaggtcatcataaccatgatacccaaaccagataaagatattacaagaaaaattacgatagactgatgtcccttataaatatagaaacaaacatacttttttaaatagaaaaagctttattcaagtataattgatatacaaaacactgtacatatttaatgtatacaatctgatgagcttggacatatacatacactcgtgaaccaatgccataatcaaggaaatagacatgtctatcacctctaaaagtttcctcatgtccctttcttctgtgtgtgtggcaagaacacttcacacgagatctacattataaaatattaagtgcacaggatagtattgttgactattagatacaacaatgcttaacaaaatattaattaatctactcaggtgcactcaaaatgggtgcactaaaatcttagacttcaccactatacaattcattcatgcaaccaaaagtcacatgtattccaaaagctttttgaaataaaaaaattatttatttaagaaaaaatagtaaatctaaactggtgatatataaagggataatacatcatgactcactggggtttattgcaggaccgtgaatttgatttaatgatgaaaatcagtcactataattcaccatattaaccaaacaaagaaaacaaatcatgtttatttaaacagatgcagaaaaagcatttaccaaaatttaatattattttgtcacagaaactctcaacaaaagaagagaattccctccactttgtactgagcatctattgaaaacctggagccatcatcataacggtgaacgaatgttttttccctctgataagaaattaggcaaaaatgtccactcttaccatttctattcaactttttaactggaagtcacagccagaaccaaatagcaagaaaaagtgtaaaaagcatacagattggaaagatagaaataaaactgcctttatttttggatagcataatcctatatataataatcctaaagaatcaacatataaactacttacaagtgatttcaacaactttttaggatccgatgtatataacctatatcacttatattactatgaaactaaatttatgaaaaattaaattgaaaaatatttacaatagcactcaaaaacttgaaacacaagttaaattttagaaattatgttgacatgtacatgaatgggaagccaagttgggaggattgcttgagcccaggagtttgagactggccttggcaacatagtaagaccttgtctctcaaaaaaaaaaaaaaaaaaaattaattagctgggtatggtggcatatgcctatagttacagatactcagaaggctgaagtgggaggattgattgaacccaggaggttgacgctgcagtgagccatgactgtgccactgcactagagtctgggtcatatagcgagactcatctcaagaagaagcgcggtggctcacatctgtaatcccagcactttgggagaccgaggtgggtggatcacttgaggtcagaagttcaagaccagcctggccaacatgctgaaaacctgtctctactaaaaatacaaaaattaggtaagcctggtggcacacatttgtaatcccagctacttgggaggctgagacaagaggatagcttgaacctaggccagagtgagactctgtctcaaaaaaaaaaaaaaaaaaaaaaaagaaacccaaaagacatgtacattcaaaactataaggcactgcttagaatattaaacatgtaaataaatgaagacgggctatatttgtgaatggaagtctaaatattgctaagatatcaattatcccacaatttatctgtaggtccaacctcattacaatcatgttccctactctccttttttgggtagaaattaataagctgatatttaaaattatatggacttaagaaaactaaacatattcttaccatatgatccaggcaattgtgcttctgggtatttactcaaaggagttggaaacttgtgtccacacaaaaaccttcacatgtgaaatatgagaatagttataatctatagtgacaaaattagatcagcagttgcctttttctgggaatggaggttgggggatttattgcaaaaggtcagatgctgatagcagttgtatcaataattgtcaaaacttggaaccaaccaaggtgtttttcattagatgaatggatgagtaaactgtggtacttcaagataacgaaatattttttcagtgctaaaaagaaatgagctatcaagccatgaaaagaggaaacttaaatgcatattactaagtgaaagaaacttatctgaaaggctatatattgtatgattccaaatatatgaccttttggaaaaggtaaaactaaggggacagtaaaaagatcagtggttgccagtgtttggaggtggggacagggaggaggcatgaatacgtggagcacagaggaatctcagggcagtaaaattactctatatgatagtgtaatgttggatacatgtcattataaatttaatgtaattataaattacattaaaacctaatgtaaactatgaaatcggagtgataatgatatgtcaatgtaggttttcagttgtgacaaatatatcactctgatggggcatgttgataaagggggaggctatgaatgtgttgggtcagaggtatatggaaaatctctgtaccttctgctcaactttgttgtgaatctaaaacagctctaaacaatagtctattaaaattaaaaaataaaatattcaacttcaccaatgaatagatttttacctaaatattacataatatgtgaagaacctaaaatagtaaagataattttgttttgtaaaacaacattataggatttaccttacctaactttgaggctcactgtaaagctacagtaatagagactgtgatagtggaataaggagatatatatatatatatatatatatatatatatgccattatatatatatatatgccattatatatatatatgccattatatatatatatgccattatatatatatatgccattttatatatatatatatatatatatatatatgccaatgaaaagagagtccaaaaatagacccacacgtggtcaattgacttttgaaaaaagatccaaggtaattagacgaggaaattatatctttctcaacaaatgatgatgaagtgaatggatatctacatggaaaaagaaagcccttacctaagcctctacttcacagcaaacaccaaaatttgctggaaataaatcatagacccaactgtagaagctaagactataaaatctctagaaaaaaaataaagaagataatgttcacaactttggtgtaggcaatgatttctgaaagggacaaaaaatattaagcataatgaatgatttaataaattgtatttaatcagaattaaacacttctgctctttgaaagcactccaaatgcaaagtcaagccacagattgagaacaatacatattatagtaaatgtacttgacaaaggtcttttctctagaatatgtatttaaatcttattaataatctggcaaacaaagcaaaatgagcaaagatttcaagaagaatttcacaaaataagatatacaaatgacgattaagcacatgaaaatatgttcagcatcatcaaagaagtgcaaatgacaccaccaatgaggtatcaccacacaagcactagaatggctaaaatgtaacaatattagatgttaataaagccatagagcatctggaactcctatatattgctgtgggaggaatgtaaaattataaaacaacattggaaaagaggttcacagttttgtatagcgctaattacatacctgataatataactcctaagacttgataggaatagagaaatataaacatgtccatgcgaacactgtgtttaaataatcatagcaattttattcttcatagccccaaactggaacaacccaaatgtactttaatagttgaatgtattaaaaaattgtgatatatccatacgatatagaatgatagatactattagaatgatagaatattattcagagatgaaaaggaatgtattactgatataagcaacatgactatacctccaaaacatgttgcaaagtgaaagaagccagacacaaaagattactattttattattgtatttacatgaaatatgagaatagttataatctatagtgacaaaattagatcagcagttgcctttttctgggaatggaggttgggggatttattgcaaaaggtcagaaagaaaactttttgagattatagaaatagactatgtattgggtactttgtcagatgagtatttacatctaaaaaatgtttcaaatgagcatatttattgtgtgtaaattgtaccttatttaggtttatttggaaaaaatatagctctaaatatactggttcattttaatttgggttaaatatttaagaattttttccatgtgctgaatcaaacaagtagagttgacagtggagatcatagtcttattctcaaggcattttcatgtaaaataggaactcaggtaactgcagtaactgcagaaaagcaggtacaaatattgattataaaatcctgggaaaatgtaaagaggaaggggatagagggaacatggtatattttcattccacaattagagttagcagctgcatcattctgattttcctttttataaatattttttattatttattagattaactaatttgagttgaggccacaacatggttgagtaaaaataatcattttcctttttataaatattcaataaaacttttcctttttataaatattttttattatttattagattaactaatttgagttgaggccacaacgtggttgagtaaaaataatcattctgagaatagcaataggtttagaaggttaatttagggtgcctctctgctattagatgtacctgaaaaacacttctaggcaaaattagaccaaattaaaaacactggggcttcaattataataaactctcaaatataagttttattattgtttattataataataaataatgtataagtgtgcagacatgggcagactacattttgcaaatttccacagtaaggtaaaaggattacaaagctttctggtataatattaacagaactaaaagacatgaataatattaaagaatgggctttggctagtgattttcaatcaattctcttcaaagcaatactctcttaattttactgaaagaaaattcaactttaatataatatttagataaatcaatacatcttaactataaaaaagaaaactatctatataagacaatatgtatttcaacatataaatgcttgggtaaaacttccttaggaggcaaaataaaataaaagtttgcacctattcttagatgaccccagtgtaatcgatgggatgttgatattgtgctggtgactcaagtaccatgggcaaggttgttatcagtgatgtgcttctctgaaagtacatctttacacccattgacaaatgggtgtaaaatccaaaaacacaaagtaaattatcttctcaatgtatatagtagatgcatcctagaaaaaaacaaacaaacaaacaaaaaacacacacaaaaatttgatgtggaaacaaacttaaattaggtttcaaatataaggcaaggttttgttgttttgtttgtttgtttactcactacataaatgaccagtggcccattcagaagtctaaggacaaaatatgttgtaggactgtcctgaccactgagggacagctcacaccctgacccaacagtacactaatgcctgcagtacccaccgttcccggagtaaaccaaaagacatcctgcgactcacaaaatccattatggagttgttttaaaccttatgagaaccactgacctaggccataaaaaacaaatgaaaaaacaacaaaaactaggaatggcagtagttctgttgagttaaagaggagaaagaggagaaaccaggactggaagagatgaaattgtgagtctggaaggaaactattgcaaaggcctttattacctttaagtaaatgtctcctaactgaactgaaagccttcattctaaccattagtttggtcaggaacatttcagggacgccagggtggctgttttattttgcacttcctttactgccctcccagcagcctacctagcagtaagttccccagcctgcagtgtccccagagggcaccttccctcggctagtaacttctcagacactctggccttggggatgtcttggatcttctaggtacacagtggctgcacacagttttgccaggcctttctcaagaggtaaaagttcctagctgtttgcatttcccagaaataatgttttccatgtgtagggattttacagatttcaaagtgctttcatgtcaattactttctttaatttaaaagaagttcagataccaggtcaagctaggaatgatccggtctcagagggaaggagcgctctaggaaaggaggatcctttaatagagggccgtcctggggccgcgtgcccatggaaggcgagagtggaggagtgtcctctttctcccccaccctcaggcggcggcccggccaaagccagagggggctgtctcctcctcttccccagcagctgctgctcgctcagctcacaagccaaggccaggggacagggcggcagcgactcctctggctcccgagaagtggatccggtcgcggccactacgatgccgggagccgccggggtcctcctccttctgctgctctccggaggcctcgggggcgtacaggcgcagcggccgcagcagcagcggcagtcacaggcacatcagcaaagaggtacagtcgaggcatgggcttgggttgcatcctttgccgggaccgagattcctcacttcttccactcttccgagagttgctgtctgtggactgccgtcttgcttcgccttcagagagtgcgctctggggcaagaggaacttgaagcaagttcaagttcaatgccatgagagcgtagtgtagggggaattacctaagtcctgcaaaaggaacggggagtgcttttcattgttctttagtttcgaagaggtcttgctatcacgatacatcccgtaaattgatttctgaaatctttccaagaggaaaactttttccaattggaaaaaaaagaatttcttcaaatcagagcccatcctgcagagaaaggcttcccaagctgtgtggttcatcctgggactttatggagggtagctgatgcatcaaaaaaaaattatatatatatatatacacacacacacacacacacacacacacacacacatatatatatatataaagttttacagaactttgttttcaacttttaaaacaggatttctaaagaagttatgtggttttttttctttcatggcaatggcgcctccagcctcacctttttcaaacccacatcttatcttcatatcctattttattgtagtgaaatcgtgaaatttctccttttgcttaaatacagaggagacttctatgtcatgtgtactttaaggccacagtgactagatatacactttggaggactttggaagatggctgtatttaatgtaacttaaataacttattctcctcagagcctcttagtgtttatgtatatatagctctcatttctgaaactttggggagtctttgaagagttattttattatcatgaattttacaggaagcacatgtgcagcattgtaagacatactttgtaacacattatttcagcaaacaattctttaagttggaaaacctgtatcaaagtaaaaaaaaaagaaatatttattattcggttttaaatatgaaaatgtttaacctaagagtacaaaatctgtaggttagaagcttttaaaagttttaatgaggctgaatctgcttaagttttgaagtatacttatccttcttccagttaacttctagccaagtcaatagttctgatatttgttcttataatctagcatttttagcagtactattttttaaggagtaaagagatatcccaagctctttctataataataactccctgattaaaattcttggaataaaaatgaccttgcattcactatataacttttttccttctatttttgcttttgcttctctgagaggtaaaatggggccaatatgacttaattaatataatttacgagagtgattttaagagtatctctggccacttatttttaaaaattctacttttaactattaaactttgctcaattacaaggtgtgtttaaacaagacataatactttaataatgttaggcagctgggagaaatgaggggccaggggcaccaatccttatgtccacttggaatggggcagaaactcaaagcatgcagagtaaggatcaagtaaattgttgctaagaattatcctgaacacacacaggatttctcttttttcctctcccttcttatttactctcttttcaaataaggtaatattaactctgatttctatgacccaggcacaagatgaagtgaattcaggaggaagggtttatactaccattctgtcaagataccacttaaatgctacatacaataaggaattttattcaaaatagctacaacatacaatctactataggctgctataatctgcattctagtatatattattgtctttgtcatagaccatttacaatatatctggaggttggctcaaggataaatgacttaaacctgttaatgttgaaagtatgtaaaattcatgaaactttaaaattggatagtgatttatgatttaaaaatgccttatgtacacgatctttattcaccttcagatattattattctcaaaggacaaatttagaacttaggcttccagtagttgtaatttaagtttacataataataactttatttcaacaactaaaacacttccggtattgtttgtgctgaattcccttttttatggttccaaggtttctttccattaattgtttaggccatgttttctttttagtgttgttccattgaagcaagccctctgtgaaaatcacgggatatgagtttgactggagaagggttttcctggctatgatcaacttttctgttttcgattatactagcactgacctttctaggcaagcgctaattgtgtagaagttctatttccccttataattcgataccactttattaagaatttttgacatgaatcaaccatttttagatgttgcagttgagttagaaacataaccagactttttgttttttactttttctttgaaatcttatgtggtttctatagcatactcgattgtagtatgaatagcattgattcagcaagaatgatattccaaggaaattctttagctatatttaaaattgacgaaatagaatgatgcaatcaaaatgattctgcatttcagcaaggcagtgtctaaaatgttttctgatattcttgtgaataatatgtggaaactgaagcataatggcaggtaaattgcaactgattgaaaaatagttcacaaagaatattgcatagtggattaaggtcaatccggaaagaagtctctagcagtgcaacagaggttttcttatactcaactatcttggtaatggcttgatggaaaatgtaaaatccaagcttatcagaactgcatgtggtccaaaattgatagaggtggctaagctggttactaacaagttcagaaattttaaaggtctctatagccttgaccatgaatggcacctacatgaagttgcttttattattcatatccacatgttaaaaaaaaaaagtccatttgtgctcttctggaaattagttacattgtttatatgtttaggaatgaatatgaagacaggaagagaaaggccactctgaattgcagcaagttcgatatgaacatatagtgtaatatggtgacaaaaaaggttggctcacttttacacaaaactcatagaagcacataggtctgttgcttaacacacatttgggtatttcattgacaaatgggtgtagatgcagagaagggagagcagaatggttaagagtctgagaagattttcagaagaggaatgtcccaagtaaaatctttccatctgaacaaggaaagatttagggaaggcaatcataaggactgtcctcaaattttcagaagagtcgttatgttaaagagggactattctaaaggctgaaggtggatccatagaagaacatgacaaacaaccaggtttgaattttataatatggagaaaatagctcctctcctcacttcctccccatgccattttgagttgttcagaaatagctgaattgtgtttgagcaacttgcttctggaaatgaccatgcagtgatcagatgtacagttagtgagggatgctttatgagggaatgcctctactgagaggaagttaagactcatcaactgtctagccatttgtcagttctaagattctaatattatagtctattgcttttagagtgcatacttgcatttaaatttctgaattcttaaaatgtcaagaaaatgttaaatatataaaaatgtgtttttaaatcccttctgggatttaaaataaaaacatgtttgagacaatcctcacacatttttggcaagaatacttagatatttagcatggattttccacatcatcgtcaattgcacagttctaaaacatcttgtgttataacacgcaagaatactttataaattacctgagaaattttcaggggattcatagtggccataaacctggaattaatttttttaaatatttttctttgctgcatatgttaactttttggcttgtttgccatatactgacctaatcatttagtaaaaatgattcataacagataaaatgcatggcatttcaacatattcaaaatatttatatgaacatattcaacactgaatattatagatgtgatagaattaataaaatttatataaattttatattatgttatatttcacatatcaatgtgtacagatttctggtctatcttaagatttttctaccctaggatttcatgcaaactaatgaactgaatctatatcaagggatgctgggggctgggcaaggtggctcactcctgtaatcgcagcactttgggaggcctaggtgggtggatcaccttaggtcaggagttcaagaccagcctgaccaacataacggaaaccgtgtctctactaaaaatacaaaaattagccaggcgtggtggcatgtgcctgtaatcccagctactcaggaggctgaggcaggagaatcacttgaaccctggaggcagaggttgcagtgagccgagatcgtgtcattgcactccagcctgggcaacagagggagactctatctcaaacaaaacaaaacaaaacaaaacaaaaatttaaaaagatttgcaacttatcatctatccagtttgcagtagggccttatttagcatctagaaaccatgtgaaaaagatcaggaagaaattattgtaaataattattgtaaatggttgcacaagtggtttaacttctaatctagaagattcgggtttaggatttgtttacagttgcaacttgagcctcgatagctaaacaggaatttaggcagaagctccgtttcagtaaatgagaaaacaagacagagtttagagaaagataaaagtagattttccaggcttagtatataccaagcagatagaaataaaactaattctaggctttccccattggtaagactgaatttagaggtcagaagttgtgaaggaaattggtggggttgggcctatatgcattggaatgtggtaaatgaatgaatgtttacagtgagtaaagaagataaaaaaattcctgctcttgtggaactaatatttagttgggatggagatgagcagacaggactatgatgaatatatgatgaagcaacaaaagaacacctatattgtataaaatgtagttgatgaaaaatgtcctggacaaacaaatacaacggggtaaggacagtcaggagttctaggaatggagggaggttgatggctattttgttggtaaaggttggtaaaggttgacctctttgagaggatctcactttggcaaacacttgaagatgacgtgggagtgatttgtgcagttatcagggggaagagtactctctgtacagggagcaggcctatgaggatctaagcttggagcatggtgagaaggctcagaggagaaatgggaaactggaacacatagcattgttgaccttaattttaaagattttgcctttttgtctgagtgagatgaggaggcatcggtgagttttaacagagttaaataaatgaataaaatcacaggtttttttgtctcaaatacgcactaatccatgggactagaccaacagtccaagcatagaattattttagatttatctcttgtcccaaacactccactgatagaacacatttaagtgattctacattcaagagcattccacttcaaccatcttatcatggtgaagctcagatgtgtctttgtaacactcttttcttccctttggcaactcagtgctattccattattcaaaatatatcagtacctcagaaacaatttgtgtgcagggaacttccgcagcttttaaaaattttgctccagtgtagttagaaatatgacagatttttaagggtaattttaaatagtatgcactttaaaacaaaaatgaattattcacaatcccacatggacatataggtactttggagttcccttttttattatctatttcaatctcagacgctaaagtttagacacaattgttgaaaatgacatagtgatgtattgatctgatgatttcttttatgatatgaaatttgaaatgctacctgttttacattcagaaacttattctatgttctgtttccatttttgttactgttttaagaatcacttgtaagctttaacaataacgttttggactatagtaatgcaattttggcctaatttaattctgtcatttagaacaaaaaaggtaaaaaaattggatagcttttccttctctctccctctcttctctttctcccttcctttcttccttcctccctttctttattttccttttcccttagtattcttcctgtgaataaaataaggtaattaaaatagataattctaacaaatataacatttaggaagatagtaaggcaaaactttacttaaatcttccttattaaaagccacaggtaattactatctaaagatagtttgagacatattttcagggtgagttaaagctaaagacatttgcttgtcaaagatgtataatatgggtttaaaaatgtttttctcctaagtaatcttgagtgtggatcttaatatgggaactttatgctatttggattttatttggacacgtgacatttacaaaagatcattgaggattgcctattaatgggttattattcataatatcggcctctgtgacatgcctaatctagttcaaacaacaagttaatctatgcaaattcctgatgatgaaaacctcaggagctatttagtgcctggcacttaggaaatgtaccttgtgcaatgttaagtatgtctctgtatgtgtagtccactcaactgacccccgaactgtgtacctccccaaggctcttcatttagctgcgtcttgagtgccagatggtttagattggtataataatatgtagtgcattgtgagcattaacacatttacttacgtagcagagctgtttagtagattaatataattatcctcagtttgtagaaggaaaatatgcccagcaacttgtcaaggacaaacaaaaattccaatgcttattttagaattagaaattaaattacggtcctgctcttgactttgtagatgctaactatcacctcttttggacttttatatatttatctttcataaaataccctgaggaaaaaaaaatccatttctaagttatgttagtctatcatatccagagattcatttggtattatggaagaacaaaaaataaaatgtgtagtcttgaagggtctttttcatttaaatacacacacacacacacacacacacacatgctgcttattactatgtagacatatacacacatgtattacttaaaactatgcattaattcaaatgcattcatcaaattttagtgtttacattcttggaactttgattactggacactaggctataagaaaatattaattgattctttattggcttttctgaagtaactttacagaagttacttcagcaagctagaaacaacggtatttattatactgtataatgaaccctttaagaatagtcaatgtgtaaatgtcagtgaatgaaaagaacaagaaccaaacagatatacctaagaatcagagcaagattaatctcaaaattccttctgaaaagatgaaaaaccttgacatcttcataaaaacatttaaagactttcatttgaagttgaactcagttaagacaaaagtcttccaatctcccagattttgagagggtgtatttgtgtatgtatgtgattgcagcaccagtgcacatgtaccatttacagcctagcactcacaggacctaatttgtatatttagtatgttttctgtttgatttttgttgtcttaaggtattagattttgtttatcaaaatctttgaataagaaaatctaaaaattgaatttctagaaaactctagttgccttgacaaatgattatggaccaaagaataaattataaatgagacaattataatattccatccagtagctatactgttaaaattccaaggtataatccctttcgagttgcttgtaacttagaaggtcctattctatagaagaaatagagttagtagagtttgctgcatcaaatatattttttcaaatgcctacatattatagttgacacaatttcctggctttattgccttctgtgcaattttcaattattggatgaggctgaaagtttgaaagagaatatgaagcagtgcaattgtcatttcagtgagctacctcatctcattggtttgtcgtggtacatatgtaaaacactgaatataaaacatgaaacatctagtaaggcctcaataaatgttcattttcaaaatgcctcaaaaaatgaattaaacctaacaacctaacatgacattctctggctgaaagaaacactcttctccaacatcatgtggtataccaaattcagttgagactgtttgtgaaggaaggaatttgcttatatacttaaacacacaagtatttgaattctaattagaatttgtgctgcagtatttctttattctcaactttatagcttagcctacaataaaaactcttatcaatacgtacctctttatacctttagtttccacatacagtactcttctttggaggtaactgaatcgtagaaaacgtatggacttaggagaaggctagactcggatccatagccaagtcaccactttactaagatcaaaagcctgagtcaacggagttaaattttctattcgtaagataggtttaggttagataataaatgtgaaaatacttgccagctaatcagtaaatactagctcttttcttctttattttatgagcataaaactaaaaaaaaagatttgctttgcatatagcatatcctttttgcttaagaacagcaaaatattctaaaaatttctttgaggagaccctaagagactatagatggcaaactatttatctcattgccaagagattgaataattctgtcgaggttacacagcaagtcagtaacagagataagaagaaacacaagttcctataattagctaacagttatgttagtagctctgtgtgagaagtgatttaaaacaggcaacatgatggaaatttttgcaataatttgtagttattcatacttcaaatgtggtacaataaacgttttttctaggaatctcattgttgaatatgtatttattttgttgataaactattttttaaaaacttctttaatacttataatatgtttagataaatatatggcatatagtaagcacttcataaaggttagttattattcttagtctatgaagtatatgttttcattgacatctgcttgggtagagatgacaatgtggcgtgtttgacacacaatgtaagttaatttcagcatggccttcagtggaaagtctaattggattgcagaaaatctctcaatatagattgtctttatttggactctccctaattactatagtaaaaaaaattcttggaatacattatttaatacaactctggatagggaggattcttagtgtgtctacttgtgtattaaatttttagtgtgtctattttgtattaaatctactattaaaaaaaccaccaaaaaacaaaaccaaaaaacctacttcagaaaatcatatagtactctaacaaatctctagagaaaactgcttttctaaacttgggaacgctggattttgaaaatatttcagacaaaacacttcttaaaggcccgtttaccatcaaaaagtttcaatcttgcctaacacataatgtgcaaatattcattttttcattctgatacattagaaaagtcactggatttgtaattggaattccaaaatataaattttccctctagctcttcctaaagagattaccttaaacatggataagtcacttaactattctgaaattcaattttccatctaaaaaatgacaatgtaatgttcgaatctatttcatggggttgttataagggttaaataaggcagaccatacaaataccattattaatactatttgttattataataaatgacagagttggtcttaggcatcattggttatgaagttttgctccaccccctttctttgttttttttccccagtggctcctaaccatttgttattaattaataatgttatgtattaatatacatatatgtattaataatgttgttaataatgttatgtattaatatacttagttctcctgttttcaaggacccatgacacatagctttcaaacatggcacaaattatttgtttagtaaacatatacatactactgcataagaagaaaatatggtatctgaaagtgtacatcagcttcctacaaacaagtagcaaagagtaagtattcagtgaaattataaaactatcataaaaatagcctaagggctctgaaacattctatgtcaagattcctttttatcctcttaaaaataattgaaactttgatttatggtatatctactatttgattgtattaaaattaaaattgggaaatttaaaaatgtttactaattaatttaaaataccagtaataaaacaattacatgttgacaaaaagaacataactttatgaaaaataattttatatccaaaataaaactcttcaatgtctggcttaatagaagagaactggattctcatttctgcctctgcgttcaaattattacatgttattttagtttaaattattttggtttaagcatattaagaaatatataacaacaaacatagataagctattggaaaaaagaggagtctgtcagtgccttttaagatagctgtaaatattctttgattctataccaaaactcagtaagtggtagttttcaaaagattggctgcagtgtggtatctgaaactgcatcaacgatatttttgtacgcttttatattaaaatctacggatctatcttacacctggaaagaattttacccatgtgtgatgttatagtatcattcatagatcatttggaagatactgatttactagttatgcagatcagccacaacttgacagattttcttataaaatattttaattacattttttatgactattgatctcaccagaaaagtccctaaatattagaagctgttaatctcacaatggtagagacaaatttttcagaatttttattttcatttgtaagtttctgtagttattgacaaattttgttatttttcttgaaatagttactttattcattcttaagaaaatgtttatcaaacaaatgagtcttaaaaaccatagttagatcctttttgtagtacatagggtattccacgaaaaaagtggctagtttagcttgcagctgaaaacaactgtacaaatgcttttcctcaaatcaaccatcatgcttcagtatacagttgatgttaaaaagatgtacccaagatttaataaatttaatcattgttactacttcatcaagtacattcatctgtgaaactagttgtttttttcttctgggagtgtgtggtggtgaaaactaaactgaccactagcatggtttagtacccctgccttgatttgtgctaatgtaccatcagtgtttcccaccactattgcttttgcaccatcagtgcacatgtcaacacaatgaaaaggcagataataattaaatcttgttactaaaaggatttttgaacttgtgtacctatggataatgtattgtggactcccagggattcacagatctttctttgagctctacagggttggactacagttaagttcctcactgcctgcctcttcaccaattctacaaaatctatagccatatgaaggtaaattttgcaatcagaaaaagccaaaaccacttcagtttttacctcaggtctagtctaggagagtgataccatttctttttaagggggaagaaatccagaaaagcttcttctgtggaaaaagcaggaagtgttaaaaccagccagacatacatatagaaatcaaaatctctgccatatcatctgcccttcttaatttcctttcacttgcccaaactatagtagagatagtgtacttacccacagttggacatatgatgttattcctaatagacttaaaaagtgaactcatggcggggcgcggtggctcacgcctgtaatcccagcactttgggaggccggggcgggtggatcacgaggtcaggagatcgagaccatcctggctaacatggtgaaaccctgtctctactaaaaaaaaaaaaaaaaaaaaaaagcaaaaattagccgggcgtggtggcgggcgcttgtagtgccaggtactctggaggctgaggcaggagaatggcgtgaatccgggaggaggagcttgcagtgagccgagattgcgccactgcactccagcttgggcaacagagcgagactccgtgaactcatgagcaaggtttagtacaaaggaaacatactaatatctgtaattctgaatattagcagaagagatttttattccttgctgagctcctgaactcacatcaggaggggtcctttgttcttttcatagaaagaattcctgttggaagcactggatatcgtatttctcaaaatatggaatttccttcatttatttctagcctttgaagttttgtgatttctaaagcatttaaaaggttttgtaatgttgagaacctaaaacgtgattcttttctctgtgcccatctcataccattgtatgtgtgtcatatgatggatctggtttctttttcttatttgttgggagatgtccagagactcaaggatctatcctttgaccaaatttttcactcttcaagggcctcatactgctctgatttcagatgtatagatatattgcttatcaaacactgatgggtctgaacatgagtggtagtaagatatttccagattaagtagacaaattgtgcagaactttttagtatcactatttaaatgactaaatttttgaggtttatgtgtatccagcccaatatgtcctctccttatctagtataatttatctttaaaaattagactggcttggcatatgtcagattttgtatttaacagactttttatatatttctttgttaggaggtgttcaatgttagacaaagtgaacagattactttggaatccatgtcctggtcctgctgaataacatgtcctcaccctccttccatttttttttttttctgccatacacattccagtaacactgaaagagttaattgatgtgtcccatctttattgcttttgtaaatagctatagatacactttatatgtagataatggtatgttttaaaattctgcaaaaatagcttttcaattctctttattctctttctcaagctttgataaaatatttttcattcaacttttagggactgattttctccatagagttcctgatgtggtgctactggagtgatgctgagaaaacattattctaaatgttttttagaaacattttttagaaaacatcattcacccagaatctgaaattttatctttatttatttattcctttggataaaacattgccctcacaggctattcttttctaaaatgtttgctgtgctgttattattcactttaatggaaattaatttatctgctgacctcctttttgacagtttaggactgtattaagttttcagatctgctcggtgagaaatagtgaaataaaactagttaacatctatggaatacctaactatgggccagcactgctgtaagcatgtctcatgccttaatttatcaaaggtagatgctattaatctcatttaacagaagagaaaactgaaatgcaaaatgttaagtaactttccaaaagtaaaacaaccagtgaactggtagagaccaagatttggacctaggtagttctactttgtggcccattcacctacccatggcagcgtgtgacctcaaccctgaaagagtacaaattagtaagtaaagggcttcctttagtgacatacttcagaggtgattttatttcccttttttgtgagatttcctatgaaaagattaacaatttaaacaatatttgccatttagattcagcactatgtcctgatatatcagaagagtctatgaactttttttttttaaagactccttggagatagcaatgaatgaattcttaactgtgtcaggcatgcctgaattttttgagtcatataagagtttgtagcactcctagaattgttaacttaattggtaagaatgtgctttttttctctttgttgttgtatgaagtgttaaaccaaaaataatcaaggcccagggcttttcctggtccattaatggatatatgacaagtgatggcaaaaggatagttacagttattaacttaatcattaattggctcagggtatccccaaaaccgcagttggaactgaagtgctacaaaaatgaccattttgttgttatagcttttcttcacataaggaaataaataagcaaaaagagggagtgtcttatctatttgttgatcaaagatcttgtaattctgcttatggtaactcccagagtagagaatatcatccagttggccccctttatgaacttggattgcaatggaagtcctatcggccagtttactagttaacaggagctgtagtactagagctatgactgcatcagaagtccagcagtgtgggcacaaagcagcgcagcacttttgaagttagacatcgagagtttgagtcctagattcacaccttgctggctgagtgctgttgcaatagtgctgttgagtgagttatttaacttctttaaacctgatcatcctcacctttaagagaatgaaaatagtagtgcctttttaaggattaaatggaattaagtatttaatttgtattcagaagaggatggaatcatcattcaaagactttacaatcagtggtgttttcagcatggacaactggagctttaacttaaaagatctagaaactgggcttgttggccacagttttagtgtgattagaggtggtcatagggtagtcaaagttgccactatcctggttatggatggtaatagaactgcctatttatttgatgtcttcacttagttgtctcctaggtccttcacagcgaacatttgccaggattgaacataggtactctgcatttcctcaactcttttcccatcagcttttcccaactcagaaaatggtaccatcattcaccccttgaatcaaatttgacatctagaagttactattaacttctctctttccttcacctcccagattgaaataatcagcatgtctgtcatccacaccaccagagtttattccataaatatccacatctttttgtccctattgccttctagaccacagcactctttttttgcctatgcaacttcagcagcctcccagctgctctcccttcttttctcttttccattttacaatcaattttccatgcaataggcaaagtgaactctgaaaatagtaaatcagattagatctttcctctgcttaaaacctttcaatgcatttctattataagaataaattctaaattcattagattttaagtctattcatgacagctcttgtatttttctctgatttcaaattattctctttttctgttatttaccagcaacagtaaagactttttttccgtctcaaggcctttgtccttgctgttcctctgtccagagcattgttccattagatccctgatggctgtctccttctcaatattccaatctcatgtcaaatgtcacctcttacagaggcctttccagaggaccactttaaattagcttctgtcaggcactcatctccctgttgtaatttctttgaacaattaaatgtttatcttgaatacccttgtttatttacttttcttctttgttgtttgtctccccagactgttggaatataaattttgttataaaatggccttcatctccagagctgaggagatacataaatattttttattttgaattaacacatggctgtgttcaggctcttctgaatgtaattccatggaggaggtcaaaattggattcctgtatgtagtgaatctgtcccgtttatgattttcagttatataattagttagaagaccaatccaatcatatttcagataaacctcaagagcaattgctatggcagagaactagaagggtatttaatcaactagttccttttccaagatctttagctctttaacagttataaattaataaagtatgttatataatgctaggactttttgtctttcattgtttctgttgctttatctccagcttctagtctgacatatggtaggcactcaaaaattggatgaagaagcagctctttttggacagaccaagagtgttgccttttaaaacattttatgtgtactttttccccctgatccttttatagtatgaatgaatgtttgtataagacataaatttctacaaatactgaaacacagtatggacagatatgagttattattattaatatcacctagataatagataaaatattttagaaagtgaggctaccttaaattatcttgcttcttgagttttttttttcccctctaaggatattccagtaagagttgagcagtatttaagctttggataaggaatgcatatttcttggcttagtcagaacttttctggatggaaggtctttttggatgagaattatactacataagattaaaatgcccatttaagatgtaaattatagggataaaatatagataactcacatggggtgatttgattggcatctgttttcatttttctttgtttctttttagataccaccaaagtccttcctatttcaggcaaaaagatatgttttaaaaaccactcacaaggcctctacaatatgtcagataatgcatgtgcgtgaatgtccttggatgtgtatggtctcttgcttgaagttatcagccagcaaaatggtgaaatacttagaattaatcaaacatctggaggtcaagaaacgcagtacctatattcttctccttactttaagaatgaaactaataaaaaataaggcggagctggcccttcagcaaaggagggatttttattatatgagtgaatttgagagaaagggggacaagaaaagacctttgagatcagggcccaggtctgttttgttactactgtatccttactgcatagcacagtgcctggcacctagcatggtcacagtaaagattgaatgatagaaaaatagaaaaggaagagctaacttttaggaaggaacacttacttcccacttacagttattgaaaaaactatgaagatggttaacatcatgatactgtcggatgtaggcagttacaatttctactcaacgatagaaaaaagaactaaagagaatttaccaggacatgaaagaaaggtgtaagatcatggattcctgaaacaggatgttccaattaaatatttaaatttaagtgaggattgtaggagtttaacagctatttaaaatacgccctgctgctttccttcctaggttctccacaccttcaaagctcatcacttggataagattgcctctttactttttccaaatcaatctggttcatccattttttgcaaaaatgaaaactcccctctttcactaaggtatttgagccatcaagaacaccctcctgtctaggcatggtggctcacagctataatcccagctctttggaaggccaaggcaggaggatggcttgaggccaggagttcaagaccagcttaggcaaaatagtgagatccctgcctctacaaaaataaaatgaaaaaattagctgcgtgtggtggcacatgccagtggtcccagctactcaggaggctgagatgggaagattacttgaacccgggaggtcgaggctgcagtgacccatgatcacaccactgcactttagcctgggcaacagagcaagaccttatctaggaacaataaaaaattcattattcattatttgatccaaaacaaaaacatgttatagactatctatagattcaattttcaaaaatcctatgcttctcatctctaaatattgttataatactgcaattttcaaattagctttcacctttaagaaatgctactttccatattggaatgaataattaatatagaaccaaaatgcatgtctgggatttagaaaatcttgggattctgtttccatccttgcttattttttattaagctaagtcattcattttaagaaatgatcccctttaccccaactatagaggtatatactaccttatatactaccatacttaaaaggttagtgaagaggcatagaaagagtagtgaaacagtgaaaccttctagatgccagatgctatacaaatgtgaagcatatgacaccagcatggtgaaaaaggaagctaattaagaccatcagatagtatttgattttatctctccatagaaatcatgataactatgttacatagttactgaaatttagacattaagtttgtggaatctctctgacagttatattagctaatcactaaacagaaattttaaaagaagtatttaatattaattctcaagtcttaggagaatatttagctaataattctacagttgactgcagagtttattcattatttaattcataatgtcttttcaatcactttactgtttcttgattcatgaagaatacatgccaagtgtattagtctgttctcacactgctgtaaagaactggccaagactgggcaatttacaaagaggtttaattgactcagttccacctggctggggaggcctcaggaaacttacaatcatgacagaagggaaagcaaacacattcttcttcatgatgtcaggaaggagaagtgcagagcgaagtgggggaaaagccccttataaaaccatcagacctcatgagactactcactatcctgagaacagcatgggggaatcactctcatgatctaatcaccttccaggaggtccctcccccaacacatggggattacaatttggattacaattcaagatgagattttgtgaggacactgagccagaccatatcactaagagaataaaaatggacacagaatgccactttcctattccctttaaatatttccagttgaaagtatttccatgacctagtgagttcttagagaattcaatcactattgatgtcccaactggtataataaaagaagaaaacacataattttgagacaaattccacctttctcacactctcagcatataaacacataatcgaagcaagaaaaatgagaaaaaatcaaatatataatatgatgaagaattttacactattcattatgacatgtggggccaaagtgacaaaagtaattggacaaaggtagactcagcaatgaggacttggaagaaatgagctttcagtcccattttaaagtagaagagaaggtagggtatcaaaagtagggtgcgctacgcaaagtggagggtgtttttgttgttgttgtttttagagacagggtctccctctgtcacccatctttgcccactgcagccttgaactactgggctcaagtgatcctcctgcctcagtctccctcagtgctgggattacaaatgtgagctacccaacacccaatgttttcttgattgtaaaagaaaattgatggtttctcatgttcaccagagggaaacatccattcattttatcaatgtgtttaaaataattcttactccttctttcactttaaagtgtttaactcatttttgcattctattcataaatatgaccagtcacaacttagaatatgtatactgtattatttcatattaacacacacattttgttcttctataatagatttgtgtatggtttcatatattagagtgttaaatattgaatttattgtaatttacttagtgaaatactgatgttaacatctagtatgtttatttgagggatataggaggcttacagtgaaatcatcctttcaccaagatttctttgtaagacactgttactggaattgtgctttgtgcattacatttcattgacgtaattttaaacttccattctacttcactacaaatggaatttcattatatctgactccacaataagtgggttccagaatcgttgacatttagtagaattacagatcttagtgtctttgtacattctgtattaaaatgcattatgtgtgctttcaattctgttttaaagaaattgccattgatttacatggttgtatggaagagttttgtttaaatgccattgcctgatttcctggtggcttttattttccttctgaaatcatttacaaatatttcttagggtattggctactgttggtttgaaatgagatacaacttatggattataaatatgtttgtgcaaattttctctagcagtaattctaaaacctttgtggacattaagctgtaattgtagctttctcttgcaagcttctttatcctctgctttattattcccttgtaggaaattaagtattttatataataatgcttagaacatctttctcttttaaagagggaaattaagataaagagcttggcaaatataggatctttcctggattgtatgtttctgagatttggtgacagagcgtctgctgtggaggatggggaaggacggatctgggctgaagaagtagacagagacagtggactttggttttaagaggcctgctgctgggatcttctcacccatccctagcagagctcagaagtaggcatccagctgcaggtaattgtgttttgggctcaaaggagcccttagagtgccagacctaaagaggcaactcccgataagagtttcaatagttttatccattctagaaccgccatttccttaagagtctgaggcccagggaccaacgcccaggacatatatacactttgataggaggaacatttcaaattcatccaggtcaagatcactcactaggtcttgtgcacctcctccgcctcttttctgtctggagttagtaaccacctcaaaagacagctttctgactcgtcattataccacctacagtcttacttttagcttggtttgagggtgtcctgttcattacttacagaaacagatttggagtgtgaatgcccttaacaccagttttaataagcatttttaattctacaataatgtgattcagagaatttttttttcctttgtctctatctccctagatagaaatatgtggaggttggatttcctgctgagtttctttatttttttcctttcttttttttttttttttttttaagatggagtctcaccctgttgcccaggctggagtgcaatggcgtgatcttggctcactgcaacctccgcctcccgggttcaagtgattctcctgcctcagcctcctgagtagctgggattacaggcgagcgccaccatgcctggctaatttattcttgtatttttagtagggatggggtttcactatgttggccaggctggtctcgaactcatgaccttgtgatctgcctgccttggcctcccaaagttctgggattacaggtgtgaaccacagtgcccagccttcctgctgagtttcttagcattattgccaggtcggaacttaggcatagtaacatgaaacatgttctgcatctgaaggccagaatataataagcattgttaatttagttaaaggaaaaggctgctgttgaaggttagacttcttgtgtatgtgtgggagataacagaataacgtctcttttccaagatgcatatggttttcttttgcttatgtgccaattttaatcaatggagaaattaatatgttaaatgaaataattaaccattttataattttagtcggatattggttgaccagtacttatatgatggtataaagttctagaaactggataactttaaaaatctttccatataatgcattatattctgggtcatagtttcctatattataactgctaaacaacataaaccaattttattttcaaaatcaatctttggggtaacttctacttagagccctgacctaataaatgatgtacgtgtttatttctgacacgtattttgataatcatttagattagtcttatttatgtggatatgtgtaataaaatttctttggaaaatatggtttattgagtttaaacctcttacctccatttcactttcctaaattttaactatttttttctgttccattgcaggcatagtaccaattctgtgtcaggcattttattcactttgtttcaactgttcttgagatcccggaggattaggactattgcagttataagtctataactgaggaaaggaagcttatctggacaggaagatatttagagtatgatataaagacagtctctttttaaaaacagcattttaaaggtataatttcttttttgtttgtttttttcgtttttttattttttatttttatttttttcttttattattatactttaagttttagggtacatgtgcacattgtgcaggttagttacatatgtatacatgtgccatgctggtgcgctgcacccactaactcgtcatctagcattaggtatatctcccaatgctatccctccccactccccccaccccacaacagtccccagagtgtgatgttccccttcctgtgtccatgtgatctcattgttcaattcccacctatgattgagaacatgcggtgtttggttttttattcttgtgatagtttgctgagaatgatgatttccaatttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccgcaataaacatatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgactgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgcacagaagctctttagtttaattagatcccatttgtccattttggcttttgttgccattgcttttggtgttttagacatgaagtccttacccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagtttccccagcaccatttattaaatagggaatcctttccccattgcttgtttttctcaggtttgtcaaagatcagatagttgtagatatgcagtgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctgtttgtctgttgttggtgtataagaatgcttgtgatttttgcacattgattttgtatcctgagactttgctgaagttgcttatcagcttaaggagattttggactgagacaatggggttttctagatatacaatcatgtcgtctgcaaagagggacaatttgacttcctcttttcctaattgaataccctttatttccttctcctgcctaattgccctggccagaacttccaacactatattgaataggagtggtgagagagggcatccctgtcttgtgccagttttcaaagggaatgcttccagtttttgccaattcagtatgatattcgctgtgggtttgtcatagatagctcttattattttgaaatatgtcccatcaatacctaatttattgagagtttttagcatgaagtgtggttgaattttgtcaacggccttttctgcatctattgagataatcatgtggtttttgtctttggccctgtttatatgctggattacatttactgatttgcgtatattgaaccagccttgcatcccagggatgaagcccacttgatcatggtggataagctttttgatgtgctgctggatttgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgtcacaatttcagatcctgttatttgtctattcagagattcaacttcttcctggtttagtcttgggagagtgtatgtgtcgaggaatttatccatttcttctagattttctagtttatttgcgtagaggtgtttatagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctgtctcttgtgggcatttagtgctataaatttccctctacacactgctttgaatgtgtcccagagattctggtatgttgtgtctttgttcttgtcggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctatcaggtccgcttggtgcagagctgagttcaattcctgggtatccttgttgactttctgtctcgttgatctgtctagtgttgacagtggggtattaaagtctcccattattaatgtgtgggagtctaagtctctttgtaggtcactcaggacttgctttatgaatctgggtgctcctgtgttgggtgcgtatatatttaggttagttagctcttcttgttgaattgatccctttaccattatgtaatggccttctttgtctcttttgatctttgttggtttaaaatctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagtctcgatggtctttacattttggcatgattttgcagtggcttgtactggttgttcctttccatgtttagtgcttccttcaggagctcttttagggcaggcctggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttctggcttgtagggtttctgccgagagatctgctgttagtctgatgggcttcccttccagggtaacccgtgctttctctctggctgcccttaacattttttccttcatttcaactttggtgaatctgacaattatgtgtcttggagttgcttttctcgagaagtatctttgtggccttctctgtatttcctgaatctgaacgttggcctgccttgctagattggggaagttctcctggataatatcctgcagagtgttttccaacttggtttcattctccccgtcactttcaggtacaccaatcagacgtggatttggtcttttcacatagtcccatatttcttggaggctttgctcatttctttttattcttttttctctaaacttcccttcttgcttcatttcattcatttcgtcttccattgctgataccctttcttccagttgatcgcatcggctcctgaggcttctgcattcttcacgtagttctcgagccttggttttcagctccatcagctcctttaagcatttctctgtattggttattctagttatacattcttctaaatttttttcaaagttttcaacttctttgcctttggtttgaatgtcctcccgtagctcagagtaatttgatcatctgaagccttcttctctcagctcgtcaaagtcgttctccgtctagcttcgttctgttgttggtgaggaactgcgttcctttggaggaggagaggcgctctgctttttagagtttccagtttttctgttctgttttttccccatctttgtggttttatctacttttggtctttgatgatggtgatgtacagatgggttcttggtgtggatgtcctttctgtttattagttttccttctaacagacaggaccctcaactgcaggtctgttggagtaccctgccatgtgaggtgtcagtgtgcccctgctggggggtgcctcccagttaggctgctcgggggtcaggggtcagggacccacttgaggaggcagtctgcccgttcttagatctccagctgcgtactgggagaaccactgctctcttcaaagctgtcagacagggacatttaagtctgcagaggttactgctgtctttttgtttgtctgtgccctgcccccagaggtggagcctacaaaggcaggcaggcctccttgagctgtggtgggctacacccagttcgagcttcccggctgctttgtttacctaatcaagcctgggcaatggcagacgcccctcccccagcctcgctgccgccttgcagtttgatctcagactgctgtgctagcaatcagtgagactccgtgggcgtagtaccttcccagccaggtgcaggatataatctcgtggttcgccgttttttaagcccgtcggaaaggcgcagtattcgggtgggagtgaccagattttccaggtgccgcccatcacccctttctttgactaggaaagggaactccctgaccccttgcgcttcccgagtgaggcaatgcctcaccctgcttcggctcacgcacggtgcgcgcacccactgacctgcgcccactgtctggcattccttagtgagatgaacccggtacctcagatggaaaagcagaaatcacctgtcttctgcgtcgctcacgctgggagctgtagaccggagctgttcctattcggccatcttggctcctcccctaaaggtataatttctataaaataaagtttttttacacataagaaatgtatgtgacatttgacaaatatatatatacccatataaccgtcagcccaacaacaacaaaaaatagaacatttctcctttcccagaaggccctcactgtttttttgctgtcttcttccacagccctgaaactcttatctgattagtttcatctgtcttagaatttcctttatatgaaacaccaactaagtacttttttctgtctgccttctttcacccagtctactgtctgtaaaaatcattcatgtttttgcatccatcaatattttgctccttttaatcgctaacattttccgttgaatgaatgtacctccatttttattttattggcctgttgatgacattaagactgtttccagtttttaattatcatgaataaagttgctatatacaagtcatgtacaagcttttttatggacatatgttttcatttgtcatgtttatctgggagtaaaattcctgggttgcatggaaaaaatgttcgtttaattttataatagacaaattgttttctaaatgaaggcatgatcttagtctagtaatgtttatttacttctatcaacatatgtgtttggtaagttaattttttggataatgaatgataccgtaatggatatttttttctcactacttcttcctttctccctctttttacacaattaaaaaactaaagataaaagttggctctatagggaaaggttttattttttacatttctggcaaatttgagatttctataaaattcttcataggtatataaaacagagtaagtatattttgtttaacttttaaagcagggtattattcatttgttagttgtttaaaatctactataattatgggtaaggcagtgatacaaaaggaagaaaagaaaaatcccaatttattcattaaataagaatgtgtcaatgcattttgaatgagaagtcattttaaactccaaatacaaagatgagcaagacgattttttaacctcaggaatggcatagtagggaaaaaagtaagtgtatgtatatcattagattcatacagtcaggctgaatgtggaaagggctttaagaaagttattaaaattgtttttacattctggggaagtagaaacatttccatctaacaggaacagggcagtttcacagaggagttggaatttggactgagttttgaacagaagagaatttcgatgggcagatcaggaaaagagcagttcaggaggagggaatggtgggctgtggagcatgggcgaccagaaaggcagattaagttaaaacagggttgacaaattgggagaacacaggattaagggactggaatttaagtttagatttgctttaataaagaaaaatgttactttgtgatgagagaaaataagctaaaaattaaaaatttaaaaaccaatccactctgagagattaattaaagtgaagatggggtctgctaatgtgttactgaagtgaactgcagagtacagtcactggcattgatgagtctagatgctgtgagaaagatcattagcgcattgacaattctaagtagctggagaccttttaaactttcaacttccatatttttagtaatttttcaaatgtgattaatttagcccatgaaaacacaccccatcattgatataaccaatcattataattatttattcgactggtgtactttgtctctaaatgacacatttctatgaaaaaaagatcagtttcactaactcctcaggcttctggctgtgacttttcataaatgtctgtatgaacgtaagctataactttgcttcattgttgtttagatgacattaataattggttttacttactgactatgggcattttaatacaagattccattttaaaagtgtgtacttgtagcttattgcaacacagtgaccaaagacaccatattcttacttctggaatcaatttgtgggcattgttaacagtatcttcacaactgcactagtcaagcaatcagagctaagctttcaaagcagattagaggaagcttattagcaataaaatatagtcaaaatataccaggcataatcatatttttatgtagtggaattacctcagcacatggagaatctaaattaaatgagtttataattgaggtttgtgtgcaagggaaaagaaaattcgtctgttatggaaacgctctatattttttacattatagccaaagtcttagttaccttttgagggtatctgtaggtgccattaaattcagctatcctcttctgctgtgggtataagcacatggcaaacccaggcaaaaattagaaaaataaaaaggattgtagagaaatggagatataaaaaattaataagagaagaggcaagctaactcccttatccatttttttcctcaaggttattaacagaaattatttccaacataaatgtccataaataattttgaaaatctagaaagaaattgcatttctactttaaaaatagctttctatggctgaaggtttgcttcagttgttttactgtcacaactcccaaaaaccagctggttctgggatgtcgtaacaatttgatacttcaaaccaatggtttgtgctcattggctccctggtgcaaacagggagataaatgctacttaaatagtaggtgaatgtaattttgcactttagaaaatgtctgcatgtttattagagaagtgaatgctgaaatcagcgaacaaaatgtaaagtgagcaactaagaaatacttataagggctcacttgtattatttaactgtgtaatcctctatctcatatatatgtaatactttcttcaagttcattatagctcccgggcccagtacatcctagtccagttccaaccatgtctaattttaaaatagctatgctcacttcaaacgaagatgttgctatagctttattttattttataggcttcaattttaaagttgtatcacctatagataacaaagacagctttcatggacacctcaatttagaagagtcttataggcactttgtgagataaactgtaagtgtatgtgctaatcagataattcttttactagagactttaggtgaagatagcaaatcttctaaaacagactgataattaaactgggttgatcattattgggttcattattatcaaattgaaatatgctttattttgtaatgtttaaaatgtgttcttaaattcagtagaatattaatattatattatacttttccatttttaaatcatattaaaaatagcaaaaatattacttcttcaaaaatgctttatacttcatgtatattactgattttaagtaaaagtacaattaagacaattagccagacctatttatgagtagctctaattggagcagcttgttgctggaccctattcagtggtagagataaggttgagatggctgaatagttcatctaatttgaaatactttggtgtcacatggaccttttcctgaataccatggctatgtactcactatttggccaaatgctgaaaatgaacatatatttgcctccgtcaaaatgttttgtaaatgttcactcagacattgacataaacaaggcagaaaggttaatggataaaaaattctttttctttaaaaaaatacatacacatacgaattttctctcttttagttgctaacctgctttttagattagtccatggttatcttggaagaggtgtgggagaacaaggtgagagctaaggaaggaattctatgcaaagcgtttctgattctcttagtattttgtggaacagcatgagacatgtcttccagttgtgtaggataagtacagcccactgaacactgcttaccagcagtttaccacaagccagttataacatcaaaaacatcggaaccctttcttttcttctatatttgaataatgataaatgccttcatgctgtgtgagcactattgaagtgtgtttctctgcaggtaaacttggcagtgtcttatataactacactcgatgggagtattacttaaacagtgtgaaatacattgtctgataaaaattgtatcacaatttggaatgacgtttatgcaagtggatagtctgccagttattttatagtctaaaaaaatgaacctgtaaggctacagtataaaatccaagtctttatagttgtatatttgtagtgaaaacaaccgtgggggaataatataagcttaatcatttggtgattagtctaccaactattaatgatgagagataacctatctgttctttatttctaaaataagatgtgtaatacagctaattagtcactattttaaaaggaatttaaatatagttttcattgaaattcaaatatttaattgcatgtgtacctaatgcctaattatttacatgttggctgatgttctctattatctaactgctgtgctgttcttaattgctgctagttcatctccgcccatctcccttggtgatgatagtcctgcatttcatggcaattttcaatagcagtttaatggtcttaagtgggtagcataatagccaggtgaacaacaaaaaaaacaaaaacaaaaacaaaaaaactatttggcaaattgggatatgagaattgaggccaaaacttttagtccttgccaattttttttaaaacttcaattatcttgattcatattcccatttgttgggttggtaggcactccaaaataaatataataatcagagagaacaccaactgtaggtactagttttagcaactgaaacaactggcgttaaaatcactgagcttctgttacatgaatacctgagtattatgtggctacttctgaaatggagtatgcagtgctcttataattgggcatttcagttgaacactgcttcagtaaagtaactggcatttcaagtcttccttctgtagtgattgctttgtctttattcaatgattgcttttttaagttagaatctggttgcatagtgctccatggttctttcctatgcagtggtgtttctcagtgttgatgtggagaagccaggagacatcctacaactctgagaagcatttgatgttggcagcagtggctgtgaggttagcccatgaacttagggctagaggtgagtcttaaccttccaattcagcatcttttccatctgaacattcaagtcaaatgggaaacctgttggccctccagctggatctttccactgttttaactggaatgaattggataagttataaggcagatggtaagattggatctgatgggatggagtttggtgaagtggaaacttttaagcattaggtttgagatagctagggagtgttgacctctctttccccctgacattatcctcacatttgtttttattccaccatatctaccttgatccacctgattcttttcatttttttctttcattctctttgtgctggctttctttccttttttaaaatcccatggtatctcatcatctcttcttgtcctcccattctacaaatagaacatgaaattgaagccttttttaaaaaaaaaaaaaactaattacagaattaatatatgtttactatgtacttactacaattagaaactatatataaacaaaaaagagagcttgcccatcaatccacatgcaaaattggttgagtaccttgaagatttgtaatagtatatagagaagaacattatttttcttaactatttaaaagtgtattctgcattctcaattaaaagtcattttatcttttactttttcttttattcctttttaagcaacaaatgaattaaatttcctttgttttatatatgacctattaacctcaatggagaaagaggctccctttgtttgcttcaggacttacatattgttacagttagtccttaggtaaatgaaatgagaagagcttcacatcagcactagttcttccccatggaattttagtttctccacaaccactttactgaatgtgtataattataagaattatttcattttcttacaactttttctctttattttatactctcaccctattatctgtcctttttcttttttttttctttctttctttctttctttctttctttttttttttttttttgagacaggctcttactccgttgcccaggctgaagtgcagtggcaggatcatggcttattgtgcccttgacatctcagtttcaagtgatactcccacttcagcctcttcactagctgggactacaggctcttgccaccccacctggctaatttttctattttttttgtaaagatggtactttgccatgttgctcagactgaactcctgggctcaaacaatcctccccacctcggcctcccatagtgctaggattataggcatgagccactgcacctggcttttatattcttaatatttcttgtttcttctatttattttctttactttaaactcgttgttataaagtggtatgggttaatcaagagtgatggaaagattagctctgtttttctgtgtgtgagtgaaagatttagaagtaagaaaatataattattcttcttcccaaagtaatgatgtttaccaaaacactggtaacattactttaaatttcctaaatttataattcaatttagtaaagtaggacttctgaaatggatttttagatatattggggaaaaacaattcaggatctaaggtaaactttttaggatgtatatatatttgcatgccattcatggttgtgtttatctgaaaacctaatacatttttatcataaaaatctacataattctaaatcatctcaagtgaaattagaattaatataaagaaataaacaaatattggaagttaaaattttcagatttattaggtgttaaactgaatttttcgtcttctactcctatcctcccgtaaacactatctagaaaattgtcacccaacctattgtagaactaaaaacctagtggtcttcctcatcttcattgtcttcattatttccactacacgaaacattcccttgtaacaaatataatattcacagcattgtgcaaaaaatgtacattttaaatttctagtataaaatttgatttgtgactctgagcccccagtttccttagggcaaacaatatgggtgctttcagttaattttagtccaatccagtaatttttcagttacttttccatttaaaacaagtagttcgaggttcagccttctgatcattttcctgatatggaatctgggagcagcagggaacataagtaatgtcacggtgtcaggattgggaggtgtgcattttggatcctgattaaatgtatcaacgtaggtaatatattgtgattgtttcaaatagtggagatcaggaatccttcctggtacaaattcagttccccacagtaacctcaaaattgacttcaaacctactgacttcaaatctgactcatgatgtttctcctctcccatcacttttcactgtgttctgctgatctccatactgtttcctcaatgatgggcccaaaaaatgctggaagttttcttctatttctctctttgagaatcatgaggcactcattgggattgtggttcttggattgtttccctctttgtatgtatttatgtatgagccatatacaatcaactgttctctcaatatcaagaggtagcaattttaaatgttctgtgttttaaactttaatgtataacttacgtcagtcaatcctgataataccactattctcactagtcatcaacatcattatcatcattgtcatcatcatgtaacaattatataatggttaatattggccacaaatcaatcctagttccttaaaatctattagttgagccttatgaaactgccctttttgtcggttcaaatggtgagtagaagcaatttcatatggttcaacttattattacttcaatttccttacaggcttacagccaacacagtgattcaggccaccatcatctcacaactagaaatcatcactgtggccttctaatggatattcttgcttgcaatttagccctcccccatttgtttgttgtacttcagctaggttaagctttataaaacacaatagtattgagctattcctctctctaaaatgctgtcatggcatctgattgaccttagtataaaatccaagctctgttaatgtgatttataagtcatgtagccgtacatcccagttagtctctgacagccctggtttacaactgctgccccagcctaattaatagtggtgttccctttattctcagaagtggactggtttagatgatgaattacatgaccaccttatttataatgtacctcatgctctgccctgtgcagttctctccagcctcatctctcaccactttttaaatcataaaaatgagctgtatccattctgaattcctttggatttatggaatatatcactgtctctttcagttcaaagcctgtgcccataatgttgtcactgcctaaaatatctctctgttaacctgactaatgcataccaattttcatgctcatttttcttttcttttttttttttttgacggagtcctgctctgtcacccaggctggagtgcagtgctgcgatctcagctcactgcaacctccacctcccgggttcaagcgattctccttcctcagcctctagagtagctgggactacaggcgtgtgccaccacgcccagctaatttttgtatttttagtagagacaggatttcaccatgttggccatgttggtctcgatctctcgacctcgcaattcgcccgcctcaggctcccaaagtgctgggattacaggcgtgagccaccgtgccggtccctcatgctccatttttatagtttctccaagaagcactttctgacctctagactagtttgaattttcctatttctgtacccatattggctctattcttcccctaatcaaacccttttcccaattaaccatgtttatatcctagtttatgtgcttccttttagcatgtaccattgtttctctagggccttataagtatttgttatacagacattacatatatatatatattatatatacatgtgtgtatatatatgcatatatatgcacacatgtatatgagagtatgtgtgtgcacatgttgaacaaattcatgagacaaaatacaactttaggttgcttttggactttgacatctgctcttgactttttatgttgagaaagggatgttgagagtatgaagcactatagcaagggagaagaaaagaaagagagaccagaaaagggctgattattgaatatcaagaaaggaacacatagaaaacaagtaagaggctttgaactgacaatttggatggacaactacattccatttctgatcatcgatcctgtctttgcactattgcttgcacttatcttagcaggggcacttaaaaagcctgaaacgcgtatcttgcctgcaatgtacaaacttatcagaacatctcatatagtaacataattttcagtataagtatagataggaattacgtttaaatttgagtaagtattggactaagattatctctccttttttaaaagttggtaagttatgttaaacaaaaacaaaacaatttctaaaatgatgactaaaagtaagggttgtttaaatccattttataagatttacttccagaagatgaaagtgggaagctgaagtggcatatcatttctaagctatttttgtaggttgaattgcatccttcaaaaagaaatgttgaagtcttaaccccaggtaactatgaatgtgaccttatttgcaaatagggtctttgcaaatataattaagttaaggtgatgtcatactggtttagggtggaccctgatccaatatgactggtatcatagaagaggggaggagatacagaaatacagggagaaagctgtgtaaagatggaggcagagatgggagtggtgcatccacaagccaagcaatgccaaggaaagaagcatggacattttttcttactgtgtctagaaggaaccaactaggctgacattttggtttcagagttacagcctcctgaactgtgaaatgaatgtctgttttttttttttttttattattattatactttaagttttagggtacatgtgcacaatgtgccgattagttacatatgtatacatgtgtcatgcttgtgcgctgcacccactaactcgtcatctagcattaggtatatctcccaatgctatcccttccccctccccccaccccacaacagtccccagagtgtgatgttccccttcctgtgtccatgtgttctcattgttcaattcccacctatgagtgagaatatgcggtgtttggttttttgtccttgtgatagtttactgagaatgatgatttccagtttcatccatggccctacaaagcacatgaactcatcattttttatggctgcatagtattccatggtgtatatgtgccacattttcttaatctagtctatctttgttggacatttgggttggttccaagtctttgctattgtgaaaaatgccacaataaacatacctgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcccctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttgttgatggggttgtttgtttttttcttgtaaatttgtttgagttcattgtagattctggatattagccctttgtcagatgagcaggttgcgaaaattttctcccattttgtcggttgcctgttcactctgctggtagtttcttttgctgtgcagaagctctttagtttaattagatcccatttgtccattttggcttttgttgccattgcttttggtgttttagacatgaagtctttgcccatgcctatgtcctgaatggtaatgcctaggttttcttctagtgtttttatggttttaggtctaacgtttaattctttaatccatcttgaattgatttttgtataaggtgtaaggaagggatccagtttcagctttctacatatggctagccagttttcccagcaccatttattaaatagggaatcctttccgcattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaactctgtgaagaaagtcattggtagcttgatgggaatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttagaatgtctgttgttttaagccacctagtttgtggtcatttattatggcagtcctagaaaactaagatacctaaattaggaaacaaatataactatattaaaaggggatagtatatccaatatatttaatacagaaaggatgaagatatagatagtagaatgatcagaggaataataatttttttcccactgttctcaatatcactgctaattcctataagaacacaattactcaatcactaatctgctgtagtagtctgattgatgctaagccatgctgcaggaatgaataaacccccaaatcttaaaatcttagcattatagaggtttatttctcaatgatgcaatgacaaatacaggtccatctggtgactcagggtcccagttgtcctccgcttatgatgtttccaactcaggaaatgccttttatggttgctatggcagaggaagagaggagtggggagctggcacctaggtcttcagtgcttcagctaggaagtcatagtcatgactctgctccacatttttacaatctaagaatagtcagatgcccctcttaactgcaaggggctgagaagtgtagggaacacaagaatattttttgagagctactatctctgcttacatataatggcagaagaaatatcctcctaaatctattaaaatcatactatgctctcaaagattctagctgctcccttaatttgatattttatccctgctataatttttacaagcttcttttcatatatatatacacacacacacatatgtatttatgtgtgatgtatgtatacatagctattacccaagtctttccattaacatggtgttatatttgtccttaccagaactactgactgctaacaacataaaactcttttccatccaaaatcattcctatttaaacatttattagtgttcaattctaataccattcaactgctcataaaggagaaagaggaagagaaggaagaggaggagaaattttccaggtaagtttatagagtaaaggaaacaacctgccattttgattgttttgagtatcaattaaattatcagttaataattcaagaaaatatatcccaggaaaaaaaaaatcccctgtataataaactaaagcttttttaacatccttcttaatccctcatatgaaaaatttatactcccctcttagatattaataaaagctcaatgtacaggtagctagggtgccccccgtcttccctgctggatttgtaggtcctgctcatgcagaggggttatttcccagcatgtggatgctctatttgactccactgtaggccaaccaccccttctcatcaatcatgttgcaattattttttacacaattacgtcttcttttagagaagagaattatttaaccagaaataacatcaacaagccttttacagaatatacatgcttaagtttcacaccatattgttgagatattttaagtgtttaaaaaatagtatgtgaatatatttcggttgtaaaaaattcaaaggaagctttatacccattaggatggctgccataattttaaaaatggaaggtagaaattggtgaggatgtgaaggaattagaagccttatgcattgttgatgggaatataaaatggtgtgacaatcatggaaaacagtatggagggtcctcaaaacattacaaatagaattacaataggatccaacaattccacttctgggaatatgccccaaataattaaaagcagggtcctgaaaagatatttatacatctctgtcatagtagcattatttacaatggccaaaaggtgggagaaacctggctgttgacagacgaatagataaataaaatgttgtgcatgtatacgatggaacattattccgtctgtaaaagagaggaaattctgacacatgctaccatatgaatggaccttgaggacattctgctaagtgaaatataccagtcacaaaaagacaaatgctgttatgattctacttacctagagtagtcagaatcatagagacagaaagtataatggtgattactagcggctgcagggagagaggaatagggagttattatttaatgagtaccgagtttcagttttgcaagatgaaaagcattctggatgtgaatggtgttgatggttgcacaacaatgtgaaggtactaatactactgaactgtatacttaaaaatggttacaatgatgaattttatgttatgtgtattttacaatactttaaaataattcaaaagtaacatcctcactcccagtgctctatacagagaaaaccaatgtctttattctttagttctgcgtttacatagacacaaattctcacatagcaatatatggtttattctttgattcatttttttttcacataaatgctatcttaatgcatatcttgttctgcatgttcaacaatgtctcagtcttgccatgagaaacggagcagggaaacttcctgggcctaaactgaataggccattttattctcttctctgccacattctttgtggttctgtctccactggactgggactctccattggtcctttaccaatgagccattctattctcatgaaatattcatgagaatgtttcaccagatctaggatttctacatattacttctaacatttccatatttctttgcctaaaattttccattctatttgaaagttgtgtgccttttttctttttctttttatcacctacatggggaggtagagtgttggctttcaaaggtgaaattgcatctttccacaactctgagttttctgagttttgagtctgttcttgacttcttttaaaaaaaaactctttggtcatggtggcaatagaggttagagtatgaataccaactcctctcgtttaggcctctgttctttagatatggtcattttaccgcttcaaggatcagaacatatcatatcccaaatttataatccccagaggtaactcagatatgtataattctttaataacaatctgatttgttctcaatatttaaagtgaacccaagatgaagagttggaaaggaaatttttaaaactctaatgctttagtaggctctcaaactgctgacagctcaagtgttctgtctctttggcaacatataaaaatccagaataacagttaaatattccacagctaactattatttaatactaatattatgtcttggttaatggaagacaccatagaccacattttgaatatttgtgctcctttttaatattggtaatcctccttctgagataaattcaggaaatctgacctttctcctcagcccttttgaaataaagaccacttttccaattaggaatatctaatgtagtgttaaagctcagagttgaaaagatgttttagtattcatcagatataacgttgtagtattattggtaacattgtgaaacaaattccagtacacttcagctctgctaacaaagatgaaatagagaataaagtaggtgtatgctgaatcttattaaggttgacatccagtttgaatacattcatcctctaaggtatagttttgggtataaaccatcgagcaagcacaaaacagtgaagctgagagctgcagaacatagagatctggtggattctaaaggactgagaatgatcgatggctactgaaatgaagtgtgaaatggtatccatagctgatatttgtctttaactgataaaatggctaaagcatttcctggtcaacacaccactctccctcctctcttctcattcctctagaacagtggccttcaaactcttttcttgataacaaatgcacttaaattggagaatatctctctttctaacacacacataacaaaaatgtcatgagatgtcttaaatacttagacattttacattcagtgtactccaatatttctattttatattcttttttaaatactggttttgacctattaaatggacttcaagaaatttttcagtctcatctaggcacacagatttaaatattacttctatgttagtgacctcttctgtgagtaagctccgtctctaactttctatctcctttggatatccttattcgcatattccttccagaacgtacaacttaacgtggcttaaacttaacagctaaacattctccctctgaagtatcccattctttccacagtcctcacccacctccatcaagttattttcctcctgtttccaaatttctgctgagggtcccatcagtcttccaggtgtaaaccattagattcctactagatccctatctttcttcccgttactatatcagtgagcaaggtcttgattctatttcgttttttgtcacaattaattattattaatagaaaataaacacttattccagtttcaaagttgttataattgaagttgctaattttaaaaaatgaattttaaataatcacttaataatccttctttgactaagacaatgaaatgtggctttaaaaaaagtaatcagcaccatttgcttataggtctttcagaatttgttcttaaagtttctggaactttcctctctgtaaagtacaggaaatactgagctacactggaaagcctctctgggacaggcaatggggagttaagcagtcatcataaaggaatcaatgtacattcagcatagtgacttggactacacaacaattccttctcctctacggtagctcaagagagacatgcttctaagcacagaggtatgagaagtctcagactgttatttgctgttagaattggtctccccatctaataacagtaaatctctggcacagatgctattggtccttaatgtcctgtgattttaggaaatagtttggatttagtttaatttattcagaaatcaaacatgtttaattaggttcactgctctggcagagtaagggtatgctggtttagtatctttataatatatatataatgagtaggtaaatcatagtcttaaatcatacttagaatactatattatttaaaccaatatctatttcaacaaaatgtttataaataaaaacagctgatgaaactaaatccaaaggtatgacaaagacgactcagctctatgttgcttaaagaactttaaaaagcatgtgcccataaagccgttcaaggagagggaaggaggtccccttctccttattcttacgatagaattcctattggggctgtgccagaaatgagcacttctaagtatttcagagaagtccaaagtgttaaaaagtcttttatgcaaaagaacgtctttctgaatcagtgaatagtaatgctcatcagaattttctaataacacaaaaacaaagccaagtccatacatttgatcagttgtcaaagtaatgggaggtggactattatgtcaaccttagtcagagctcctgctggcttctttgtatacactgttcaccaatttgagtaaagtggactttgtgagagaatagtgtttgatggccaggacctcttttgggcatttcttcctaagtggaatacacaacagataagggagtagaggaggtaatacagggaagctactcattccagctcagaaggagcagaaggagttagatgaagcccatatatgcattcaagaagccaatggtatcctctagctgtggatagtggctaatgtggtcatccagaatccacactgtggaccgcagcagcgttttcccgtacagatccaaaaactctggatagggatttacaggatccaatggccggtagataaaatgaatggggatagttacagaggcaagagctcccacccagcgccttctgagcttcttcctctgattgatgtactgtaagagaccgtcaatggctaagttcccgtcattgatgcggatccctgcccacatgtcccacagctcactctcacagagccaagtacacggcccaaagactggggtgagacctcgagagaatacaaagaagttcatcagtcatgtgaggatgagtgatagcacacctccatctttgagtagcttttggagaaggagtggacggtgagtctcaggaaagatacctccatttgacagacagactctttatggtatgccgaccagatcgattctgcttgtacctgtagagaaactcctgagcgacaattatctccatagtcatgagacttgatcctgcagttctggagccccagatgccgcaaaagcgcttccacgatgctgacctgctcaaatatggaatagtgatgcggtctcggtttgtcactgaagccaacgccaagaaatcaagggcaatcacccgatgaaacctcaaggtcagaccttcccaattcttgtaccaatcgtagctggatattggaaaacgtgtaaaaccacaactgtctcctgacttccaaccacacccacagagtcttggtagaagatacgcagtcccttgtaagtgaaaaacttgcctgaagacttccacgagtgaagatcaggtgacagctgagtgtatgggatgtgcaggtacgcagcaagcaggagcgcggcccacagccccacctggacccaccactccctcatcctgcggaggcgatctttgcgcacggcggcgttatcccacgctgccagcctcggcgttgcagagcacggggcgccgtggcgcccgcagccctgcagggccggccggcagcggggtctcaatcagcagcccacagcccgcacagggcggcgccgcgcccggcagctacagccactctgacgtgcacggcggcactgcgtttgctaggcgcgactgccacaagggaagtgcccgggtgtgctggttgccgtggcctctatttctaaagtatttcttatattttcctatttcttttcattcctactgcttacaccctcattgactgaactattgcaaccgcctcttgaggtgactgaaatattcatagatattgcagttattctccttttgggcatatagtaggattacatttgctcacccctgaaattaggcatagacaccgtcaatgaaatgtgaacagaactgacatgctttactcttagattgaatacgagttttacaagccagtgcataattcgccatgctatagagacagatgatcttccagatggatgcctgagtgtagaatatatagatcagttccccccacccttcacacatgggcccaaaatgtacacggagcaggagcaagaaatacacgtccttgctatctttgttagtttaatccacagagactttggagtctgcagttatacagcatcctagcctgtcctgactgatatgatcccttaactgatttttctactcaaagtctcttctccctccgattattctacatcactatcatattaatctttctgaaatagaactctaattatataaattccttatgaaaatctttgaatatttccctgttatcttcactggctttcaagaccatcacagtgtgcatctcaacttccttttaaaacacccacggtttccctacgtgtacacacacactttctaacacgttcgcttttctgttcctatgattctaagatgctctctgctagtcctgtctaagtgctacctattcttaagtaacagttcaaatgccagtatctctatgaggctttttctggatctctgcaaaaaaaaagggacaagaaacaccttcctcccaaaggaacaaagaatggcaattacttataagtaagccagattttagcaattggaccatttttgtcttaaatataactaacctgtctctatagcttacaaggtattcataaattcttcaaacaaaagaaatttatcataaaggatacaggtaaaagttctgtgaaattgtttaaaaaataactaaataaatgaattcccaaatgattttgagtctttattgtagttcttatcacactttgcagtggccatttctagcacttttcaggcaataaatggtcttctttcacttccatattattgaaaattcttttgcataatgcctagcaaatatcttaatgttgaatatctgaatgaatgaatgaatgaatgaacgaatgaaattaaggttgcattttattttaaaactaccgtttttttcttcagaaatcacaacgaggcaaatgttgccaataaaatagttattaagttaaaaaacataaatatctgagaaatgaactgagaaaaggagaaatccttacaggacatgaatggtacaggagaatagtacatatcaaagggtgaactctgggtcacagcttgtgggatcaggcaagaacatgtctagtcatagtctttcaaataatcttattaaaaattattttttctaagatccacttttactcttttctctgactaattttatttagctttcaagcatttctttgtggcttcagttttgacttcagtttttaaacaatttaaacaaataaaaattacattacagaattgttacttttaaactcttactttccacggggactgttattgtaaaatctgttcttattcttttaatttaactccattattttgttttaaatgtaatgattgttcattatatttttctccaactgctttaaaagcaccaatccttctttgctgtatatgtatcaaagtccataaatattctttgacattatcctagccttgaataataaaaggaaaaaaacctctcacaactttttattctacaaaataatattaaaatatgcccctatttttactgtaaatgtaatcttcacagcaacagtcaagagaacaagactgagtcattcttcatcacacattgcaagggctatgtctcctctgttgtgaggagaatattgccctgcagcaatattctcacaagtggagctctgggtcattgactgcacttttgctaataagaaatcttcagtaggagtgactgggccttgtgcaaatctctccagtagtttcttccactagtgacgcattagagcctcagaatcaatcactcaacaagtgtttactgaaagcttactgatacccagaccttaaactgttaccaaacagaatgccagatatgggatataattccagcctgaagagtttatgctcaagacaagacttacatatattacagagaagcgtaacagagcaaatgattaagttctaagtttcactgtacaccctaaaaaaaaggagaaattgatatggaacatgaatagtataggaaaatggtccttaggaaggccagacatgagagggtgagctctaggtgaccacctgtaggatcaggaaagaacatatctagtcctggagttaagatttctattttttctagatttatagaggtataattgacaattaaaaattgtgtatattctagatatgcatgacgatttaatatacatatacattgtgaaatgattaccacaaccaaattaattaatacgtgtatcacctcacatagttatcactttgtgtgtgcgtgtttgtttatgcatggaggacatttaagatctgtgtttggaaaattccaaataaacagtacaatattattaactatagttactattctgtacattagatccctagaacttattcatcttataactgaaactgtgtaccctttgacccaaacctctcatttaccccaattcctggcaaccaccattcattccaccattctactctctgcttctatgagttcaactttttagattccacatgtgagtgagatcatactgtatttgtttttctatgtgtggcttatctcacctagcacaatgcccttcaggcttatccatgtcattgcaaatagcaggatttccttctcttttatggctgaataatattcctctatctccctctctccctctctttctgtgtgtgtgtgtgtgtgtgtgtgtgtgtgtgtgtctgtgtgtctgtgtatgtgtgtatactatatttactttatccattcattcactgatggatacttaggccatttatttatcttgactgttgtgaatgatgctgctatgaacatgtggatgcagatatctccttgagatactgatatcaccttttaaaatatatagctagaaatgggattgctgggtcatattgtagtactattttcatttttggaagaatctctatgcttaatgctgttttccatagtggctatgcctatttacattcccaccaaaagtgtagaagggtttctttttctctgtttcctcaccaacatgtgttatcttttgtcttttatataatagccatgctaataggtatgaggtgatatctcactgtggttttgatttgtatttccctgatgattaatgatgttgaacactttttaatatacctgttggccatttgtatgtctctttttggaaacatgtctattttttagatatgtttaggtcctttgtccattttgaaattggcttattttgtgttttcttgctattgagttgtatgaattccttatatattttgaatattaactcctgatcatatatatggtttgccaatatattatcccataccacaacttgcctttttattttgttgattgtatcctctgctgtagaagtttttagtttgctgcagttacacttctttgtttttgctttcattgcctgtgcttcgggtgtcgtaccccaaaaatcatgaccaagactgatggcaaggagccttttctttatatttattttagaagctttatggtttcaggtcatacatttcagtcttgaatccattttcagttgatttttgtatatggaataagataaacatccaaaatcattcttttgcatgtggatatctagtttccccaatacagtttattgaaaagactatttgttccccattgtgtagttttaatggcctagtcaaagattagttggccatatatttgtgggtttatttctgggctattccgtttcattggtctatatgtctgtttttatagcactatcacactgttttgattaccatggctttgtatatagtttgaaatcaggacccatggtgcttctggctttgtccttctttcttaagattgctttggatattttgggtcatttgtgatttcatatgaattttaattattaaaattcttattcttttttttagaactgttttttctacattttctttctttttttctttcttttttttctgaggtggaatttccctcttttcgctcaaggtggagtgcaatggtgcaatctcagctcactgcaacctccgtctcctgggttcaagtgattctcctgcctcagcctcctgagtagctgagattacaggtgcacaccaccatgcccagccaattttattttttgtatttcttagtagagatggggttttgctatgttggacaggctggtctcaaactcctgacctcaggtaatctgcccacctcagcctcccaaagtgctgggattacaggcataagccactacacccggccattttttctacattttctaaaaaattgccattgaaatgttgagtgactgcattgactctgtagatcattttgggtaatgtggacattttaacaatattagttcttccaattcatgaacacagaaagtctttccatttatttgtgttgtcttccatttctttcttcaatgtcttatagttttcagtgtacagatctttcacctccttggttaaatttattcgtatatatttcattatttttgacgctattgctttggtttcttattattattatactttgagttctagggtacttgtgcacaatgtgcaggtttgttacataggtatacatgtgccatgttggtttgccgcacccgtcaactcatcatttacattaggtatttatcctaatgctatccctcccccagccccacaccccccccaacagaccccaatgtgtaatgttcccctccctgtgtccatgtgttctcattgttcaactcccacttatgagtgagaacacacactgtttggttttctgtccttgtgatattttgctgagaatgttggtttccagcttcatccatgtccctgcaaaggacataaactcatcttttttatgactctgtagtattccatggtgtatatgtgccacattttctttatccagtctattattgatggacatttgggttggttccaagtctttgctattgtgaatagtgctgcagtaaacatacatgtacatgtgtctttatagtagcatgatttataatcctttgggtacttaattcttttttggataatttgttgttaatatagatgcacgactgattttcatatgttgatttcatatcctgcaactttattgaatttctttattagcttctaatagcactttagatggagtttagggtttccttcatataagatcatgtcatctgcaaacagagacaatttaccttcttcctttccaatttagatgaatgttatatctttttcttgccgaattgctctgactaggactcatagtactatgttgattgggagtggtaagactgggcacctgataaggttaggctttatgtccccacccaaatctcatcttcagttgtaaccctcatcatccccataatccccaaatgtcaaaggaaaccagatgaaggtaattgaatcatggaggccagtttccccgatgcttttcttgtgatagtgagtgagttctcatgagctctgatagttttataaggggctcttcccccttcgcttggcacttcttcttcctgctgccttgtgaggaaggtaccttgcttccccttggccttctgccacggttgtaagcttcctgaggtctccccagccgtgctgaactgtgattcaattaaaactttttcctttataaatcacccagtttcgggcagttctttatagccttgtgaaaacgactaatacagcacccttatcttattcctaatctcagaaaagctttcaacttttcactattcagtatgacatcagctgtagacttgtcatatatgtcctttattatgttcagatacatttttctatacctaatttgttgggagcttttatcatgacaggatgttgaattttttcaaatgctttttctacatctgagatgataatatgatttttattctttattctgtgaaagtggtatacagtagtccccctttatgcatgggggatacattccaggacccccagagtatgtctgaaactgcagattgtactgacacctacatatagtatgctttttattctatgtatatacctatgaaaaagtttaatttatgttaggcacagcaagagattaacaacaatagagcaattataacaatttactataataagagttatgtgaatgttgtctctctcactccccctcaaaatatcttattgtattatactcatctttctccttgtgatgatgtgagatgataaaaggccaccatgattagatgaaatatggtgaacgacataggcattgtaacataaagttaggttattattgattttctgatgatgcatcagaaggaagaccatctgctttgagcgacccttgattattgagctatgacaatgttgatggttggatgccaggtgcatatgatatcaatgtccaacaggtcggttgtgatacagtttggataccctagaaaaaggaatggttcatctcctgggtgggaggaaacaggacagtgtaagatttaatcctgctactcaaaatgcacaattcaaaacttatgaattgtttttctgaaattttccacttaatattttcagaccatgattgagtacaggtaactgaaaccatggaaagtgaaacaaagcataagtgagaatactatatcacatttatcgactcatgtatgttgaattatccatttattccaaggataaatccctcttaatcatggtgaatgttccttttgatatgccgttgaatttgatttgctagtatttttttgaggatttttatatctgtgttcttcagagatattggcctgtaattttctttatttgtagtgtccttatctgggttagcattgtataatagttacctcatataatgagattggaagtgttccctccaagtgtctggtcttgaacttttctttattgggagatttttttttctgatttattctccttactcattatcaggtactcattacccaaatttgttcagattttctatttcttcatcattcagtcttggtcgattctatgtgtctagcctttatcaacttcttgtaggttattgtatttattggtgtataattgttcatagcagtctctatgatccttttttatttctgttgcaatgtctcctctttaatttataattttatttagttgaatcctcattccttttttcttagtttggctgaaggtttgtcaattttgtttatctttaaaaaaacaattcttacttatattgatcttttctattctctttctagtcacaatttcatttatttatgctctaatatgtattattcccttcccttttctatctttgtcttagttttttttttcctatttccttgaggtataaagttaagttgttcattttagatctttttttttaatataggcatttatcaatgtaaacttctctcttagaacgtcttttgctgcatcccagaagttttggtgtgttgtattgttattttcatttgtctcaagatacttttgatttctctttggatttcttctttgacccattggtcattttggagtgtgttgcttactttccatatatctgtgctgggattaatatttctgactttttagccaggctgcctgtattctaattacaacttcaccacttacaaggtatttagctttaggtaagccatttaaactctcagtgcctcagtccccttatctgtaaaaatgagtaatacagtgatattaataataataatgagagtatctacctccctgactgattgtgaagatgaaatgaaatagtcagtagaaagtagttagaatagttcacagcatacagtatttattatttttatgattaactaatgttttatgaggtccttagagtgctagacactgtttgcatgaattattttatatgatctcaccacaaccttataaaaaagtttttattgtccgatgttttagacggcgtagttataggagttagtttcagccaccagttgtatatagagaagctgctaggcaaacataagatttttttaaatctagcacaaggacctgaactttaccacatctgtctcccctgttgactatcaattcaatgcctaggtcccatgagggaagggtcaaagcatttgatgttaaaatgtacttctcagaggatgtccttcggagaagtattctttctcttacttatgttttgttaatttttgcttggttttgattgtagacatcagtttgtaatcagaaatgaagggaaggtcctgggagtaccaacatttaagagtgaccaaaagaatggaagccagcaaaagggatagaattctatcatcttgactcccaaacctactccatgttgatagtcttaatcttagttaatgatccctgctgcttgatccaaaaacctaacaatgacttcactcatttccctccttctgcactgttgttacctcttcagggacaaaatttcaatactttccacttagactttcactactgacttctaactcatctttttgctttctcttatttggaacagttattcagcttaccctaagtccagagtgaatttccaaaaaatcaaaggttctgcaacttttcatttctcttcaattccaactcaggttcacacgtttatcacctagtgtagaagggctttcctccacagttttgcttggcaaactccttttcatccttcaagactcaacaaaattgttgccttttcatgaaaaaggatactcttccatccttctgatattaataattttttgttcttgtgtccatgatagactttgtcataatgtattacagtttatcctggaggaaagcaccacaagaccaagagtttcctttttttttttcatcccaatgcttgatacatagtagccatttgataagtacatgttgaatgaaagcatgaatttataacatatataccttcacctgacttggagtttcataaggaatgcaacagcttccaattcatttactttctttttgcttaacaaagtatctgacacatagtacaaaagttaaatattataaataaaagattaattgcacagatatttttaaaggagacagaaaagatttgaatatccaggaattccacccaacgatgaaagacctataggcggttacaagtaggtaagcagagtccaaaatgtagggtcattttcaatggcagagaggaataggagagtcaataagaagcaaatgctcaaggagcttgagtagagacgggaataggcatctctttattatcttattggctgatttatacttcttgtaaaataattagcttaagctaattatctaagaaacaagaatctctcctaggcagattcagttgcctttcctggttctccctgagtgctctgagtaagccccaccattgccttctagaaaaactttctttcttctttcttgcccactcccatctgatcccttcacggcatccagaatgatgatccaaaagtttgggtccaaatgtgatgcaaaagtttacagtggtctaccatggttcctttacaaaaaaagaccaaaaatgttctgccattcttgctcatcatgattttgcctcagtttttcaagttatgttttgttcataatggatttttttttgtttgttttctgaatgtgttctgttccttctactgccttaaaaagccctcatcactgagtcttcctactacttccctcacctccacttaccctactgaattttcaaactgcaagtcaaatattacttccttaggggaatctcatcagactgtctccctagaccaccacaccccacccaacaactagatcacatccctttattaggggtactatgttttcagtataattgcaattataattattgacccattgaatgagttgattcatgtcccttccttctttattataagctttaagagggcaaaaactatttctgtttttcttaccatctttccctctttagtgcttccacattgtctggtacattgcagacatctaataaatatttgtcggaaggaataaatattagtgagagaataaatgggtaatgcattcatgagtgaataaagattatatcatatttttgtggtaaatattttgtttaccttcaatgactgaaacaaagagttccatatcctgaaatatgacctgaaagccatggaatgaaaggtttgataaagctggacgtggtagctcacacctgtgatcccagcatttctagagaccagggtgagagaatcgcttgagctcagaagttcaaggccagcctgggtagcacaataccttgtctctacaaaaaaagaaacaaaattagttgagcatggtagtacacacctgtagtcccacctactccaaaggctgaagtgggaggattgcatgagcccaggagttccaggctgcagcgtgctgagatcatgccactgtgctccaggctgggtgacagagcaagagcctgtcccccccaaaatttttttaaataagaaagttttaataagcagaatattagtttaattatgaatgagaagagatgtatagcatttgtaggggtacagaaccatgtattccataaaggaagaagttaagagcaatgatgtggaataagcatggggcttttaagaacttgtctgaaaagaggatattctttggtcaatagttgaaaaaataaaataagccttgctggagtggagcaagtcaatggaaagccttcacagttaggtggagcatttacactaaatgactttatttcgaacattcaacaaacactgactgattgtctattggttacccgccatataatgttaggtgctggggaaatagaagtaagtagaatgaggtgggggaggttcactgtggctcttggaaaggaaaatacataatcaaagtttgtgttagaagggtcaatctgaaggcttttgaaaaatggatctgggatagggaggatgtttgttgaatgaatgaatcaatcaatccaattaattcaataaactaatcatgattttagtgagtattctatgaaccctcacttagtttgattaccttgactgtgacatttaactttgtatttcactacttctttgcttctcttacattcagttaaaaatatttttaaaatacaattttcaaggttcagaaacaaaaaaaataaatgacattctggaaaaaatagatgtgctcagaactaaaaaataaaaataatggagatggtaaatatataagtgagaaatatgatgatgattttcattaacaagatacaccattaaatatattctcacgtgatccaaagtaatttcgttctctgtgcccagcgagttggtatctactgatggtggtttttcaaatgcaccgtgcagttagacgtcatcactgagacctcaataatagacctccatcactgagaagttcagaggtagaagatgcagggggacaatgttggcctgcattaatcttagcttgaaaagaggatctttagataacactatctaaatttagctgtgttcaaaatgctccaccacagaagagcagcaaaaagcaatctcattaaaacaagctcagaaaacaattccaagatatatgagtaaaagcaaactaaacaacggaagcacaaatagtatgaccttctcttgacttctacttgcacagctctacttattcaagctctgtttcggacattaagcttttttcatagccataactttcgtgttttttccatcatcctgtctattatatttccccttttatcttttattgagttcttttaggagaaacttgaaaaaaaaatctctataaatggaggttttttactcaagagcttttaaaataacagtacatcaccagatcatttttaaaaagtgttctattgtagttaagtgaatatttattgaaatttttctcgtcttcccattgaagactacagaaatctctttcttccagttgagctcaaaaggaaaagcaaaaaaagatggacagaagccagaaatgctgaataaattagtgtcctttttatttactttttaaaaactatgaattggctcatttaaatagattctaaaagtatttgtatgtgggtctgaacactgttgtcatggagattaaaacatttttgttgttgttgtgtacagtggagatggcagttttcttctagttgatgcttctgtagaataaaaaaaaaagtttagctgagaaaggtaggtcttaatggaattgttaatatgtagtcttattttggatgacattttaaaatcacttacgtatttaatctgtggattgtagagcatgctgggaagttatcaattccattggtacctgcctcagttgcagttcagccttaagtacttaccaaagggagctcatttggggtggcaggggtaaccgaaaagtgtgggagctgaggtattgtttgagagcctgtgggcagtgtgactgctccaatcgtagtttcagtgaggaagagcaccatctgtgcaagattttctcagatgtcctctataagactttcattgtcatcagttctatgtgctctcaaatcattgctttttcttctttattttgcacataagctataagctattttttaagacatataggttttatttctgtgtgatcaaaaactatgtctcgggcaacttctactttttggaattaacaattattttctttgtggtcttgtgtgtgtgtgtatatatataaacacatacgcacaagaagactgtctctctgtttgtatatatacatacacgcacatataaatacacagagagagtgtgtgtgtatatatacacagagagagagagagagagagagagagagagagagagagtcagtcttgctctgttaaccagctggggtgctgtggtgcaattatggctcactggagcctccacctcccagactcaagcaattctcatgcctcagccttctgagtggctgggactcccagcattcaccaccacacccagttagttattgtactttttttttttttgaagagacagggttttgctgtgttgcccaagctgatcttgaactcctggacctccagcaattctcctggcttggcttctcaatatgctgaaattataggcgtaagccaccttgcctgaccatcgtccatatatttttgaaaatgacctaggaacaatgagactttttgaagttttttccgtttgctaacttatcagagaaaactagtggaaataatatcaaaaagaaatcatcaaatgctacccatggataatgtacaagaaaactcagcaaaattatttggcacagatgaagaagacaagaaaaatgtctgctttgtgagaataccatagtaggtccttcagacaggaggtactttattaagaaggagcaattctcattaataaagatttagagagatcacttataagatgtatttatggcagcaagctcatttggtacatgtatgtatgagggaatcaagatctgaaaagattttcatcggttagagtgatacgtctgttatgatgcaattaattgtgatatactgtctactggagatttgttctccaaaacctgacaatctagtactttgtaggaactaatgtgtataatcttagggggcttagtggacagaaagttcattagccgttggtactgtgataggggaaaaagcaaatgggaccttaaacaatatgaatagacatggtttctcaaagaatagtctatggttcacctgagcacacatcacaaaggatgctgacaatgcacagttaaggtaccccacctagattaaatgaattaattttggacttgggtttagatatttacatttttatcaggacttcttatgttcaccccaaagtttgcaaaatgctcatctaaaataagaaagatgataggcctgatccatcttctgtttactaggttaaatctggaaaatataaacctcaggtgccagacttcagagggatatagaaaaacaattactttttgcattagtccattcttgcattgctaaaatcctaaagactggataatttctaaagaaaagatgattaaggcgggatgcagtggctcacgcctgtaatcccaggattttgggaggccgaggtgagcagaccacgatgtcaggagttcaagaccagcctggccaacatggtgaaacctcgtctctgctaaaagtagaaaaaaaaaaaaaagaagaaagaaagaaaagacgattaagtggttctagattctacaggctgtacaggaagcacaacagcatctgcctctggggaggcctcaggaagcttccaatcatggcagaaggttaaggaggagcaggcatgccacactgcataaacaggagcaagagagagtgggaaggtgctacatactttaaaatgacctcatgagaactcactgtcatgaggacagttccaagggggatggtgctaaaccacttatgagaaatcagcccctattctccaatcatctcccaccaggcccctcccctaacattggagattacatttcaatacgagatttgggtaggatcacacatcctatatcacttttggagaaagagtggaggtagctctgaaggtttgttacatcacagcatttgaggaatggctggggtgatggcaaatatcatacagaagagcaggcgtagacaagatataccagttgttttcaaatatctgagaaaatatcagtaagaagaagtatagtcatgagtgtgcctcacttgcctaaacattttgattaaaaatgcattttagtagatttaattatgcctttttcctctggtgaccatctgttaaaaatttttaaaaccttgacctatgaaaaaatttgtcagtaagatgcatttgttgtaccaaacttctcagttctggactttttaatcagtgtagttgccatcggactcacccaccagcttgcctgctaatccatctgatctgtgtcactcaaatacagcaggcagtgaagaacagctgctttttcttatttcattctccttctatctgtcataaaatccaggtaccaataactagggataagtgttttaccaagagcagttatttcaatagcttgaacttaaataccagattaattttcacagaataaaaataatgtttagtataagttttaataatggcatgtagatgaaatatttggacttggtgacttttaagttgtggttgctttttaaatgacttctctgtttgaggactttgtgtatacacatttcctatcacatttgtggtaggaagattctaagatgaccctcaagattcacaacctctggggtacacatcctatatgatcccctcctgttgagtgtgattggagcctgtgaatatgatgggacatcattcccatgattaggtaacattttacaacaaagtagaagatataattcggatataactcaggtggctaaattagttttcttcaagctactcaaaaggaagattattctgagggcacccaacttaatcaagtgaactcctaaaagagtgtctagttctcagagagcttttcctgctcttgaagaagcaaataatcatgtgagaaggccacacagcaagaggcttaggaggcctctagaagctgagagcagcactggattgataatcagcaagaaagcacagctgagctaacatggagactgcagcctctctaggtcgacaggaactgattatcaatgaatgttgttttaagtcactacgtttgtgataatttattatacagtaataaaaaccaaatacaaaagattaaaaagaaatctaagttgaagatatcttaaaccgaattgcatttaatacacctaacctactgaacatcatagtttagcctagcctacctttaacatactcagaacactcacattagcccacagttggacaaaattacctggcaacacagtacactgtggaatattgttggttcaccctcatgaacatgtggtggactgggatcctcagcttgctgcccctgcccagcatcacagagagaaatgtgcttcatatcactagcctggaaaaatatcaaaattcaaaatttgaagtatgatttatattgactatgtattgctttggcactatcacaaaatcgaaaaatacgaagttcaaccgtcataaattgatgactatctgtaccaccaaatagcccattactcaaatcctcaactttttctcttcaatgtatgtgacctctatttatatagtcaatacttcttgatttgaaaaaggattggatgataatagaagtgaaaagtttgaatgattatactcatttttctttttctttatctataaaccagcgcccagttggaacatttccatattttagttctaaggttgtaaattgctgaaagtttaggttttcttattgatgattctctgctaacatttgataagtaggtcccattgaatatcacaattaatctatttaagaaggttgagagatatactgttaaaccaaagggaaaatggtaaatgaaattacaatttatatttttcccctaattcatgggcattgaatattaacttagtggtctgcacttgtagcttgttaattgtttgacatctagctgaaaagtaaagtgttatatcacagatagcttttctaattgcaaacacatcaccctgtttattcattggttcactaagccttaattaggtatctatcctgtaccaaatggtatgccaggggtgaggatacaaagatagaatagaactttttagtacaatgtgaagaaagaaacataaagaaataagactgctgaagtattttaactaccaggtttgcacgttgacttctttatgcttcatttggattttctgaggctttaacgttttccgtttttaagactaagctcaagggtcaactctttcatgaaaattaattgctatttatgtttccatctataagaagagtgaaataaacaatgaaatctaatgacactgaaaagtgctttcaatgtactgttgagtgggaaaagccacatttttaacttgtatattcagtgtgatcccaattttataattttactctcaatccatatatgtgaatataatacataggaaagaggttggaagtaattcaatcatgaggttaacaagttttatctcagatgagattgtgtgtgatttttaaaaattatatttattctacctaataagcatttattacttttataacctgagagataaacattattgaaaaagaagagcatggatttaaagcgaggatgtgagactgtggctgttacatatttttttggtttggaccttggttaagaaggcaaagagggatagagattgtgggacatagagggagacgcaggcctgaggacagttacagtgttataaagggagaggcttaagtatcattataatatgagcagaaattgcaaagagtgagaagctaaaatggaagggagacgataaatagctcagcaaggtttttagggaagcagaaatgactcagatttgaaatataggtgacagaattagccttaaggaggagaaagaaaagatcttttgagactataagaaaggaggtgagagttgatgtagccataaaaaatacagagatgaaagggtggggagttaaaagagcctgtgtatgtagcctaaattcttgctatgaactagaaagccaggtcattagccgaaattgacaatgggataggggtggtcttggggaggttaaggctagaaaaatccaagcaaagcaggtaacaagaggacttgattccagactgtgaacagatttgaggcagggtcagaaagccaccctgaaatttcagtgctataaacctgtagtgggaactctataggaatactaatttctcccttcatcaacaaagatattatactggtcctgtgaagaggcttagtcacttcccagtttatgtatttcaagattatattcctaaaacacagaagtttttcagtttgttccctaacctgaccccagtctacctgtttccatccaagactatcactaccacttctaaaccacctccagccacacaaaaaacacacactatgcttgagtcattccaaattacacaccttcctctaaacattagtgtgaaattaggacatttgggaaatgtgattgatatgatttgcatgtttgcccccttcaaatcgcatgttgaaatggtattcccagtattggacgtggggactggtgggaggtgattggatcatggggacagatccctcatgaatggtgtagcaccatccccttggtgataagtgagttctcccttagttcccatgagatctggttgtttaaaagaaattgggatctccccctgctctctcttgctcccactccctccatgtgacatgtgtgctccagctttatcttctgccatgactggaagcttcctgaggccctcaccagaatcagatgtctgcaccatggttcctgtacagcctgcagaacagagaaccaattaaatatcttttctttataaattacccagcctcagatgtttcttaaaagcagtgcaaaaaatggcttaacactgtgatatttggtattttctagtccattagtgcacatccccccgatgtaggataaatatggtatgaatatttgaatatttttatgagtaataattaagcttattgaattatcacaactccagtgagataagtctaattttaatatcattagaaaggtgaagaagacaagaccagcgagggctactaatttctcaaggacacgctcatcctcatgtgagagctggaactcaaaaccagaccttgactttgtcaaaatgcacttttggttcccaatctgatattaggtgcagattcttctcttctttaaccaagggccaaataatacagccacccaccccaccctgccccagctctccttttagaaccaaactgttgctctctcactttagtgaggtggaaggaagactatttcaaattgactgatgaattaaccctatcgaaggtcagaaaaatgttagataacttaagggggaaaaaaagaaaataaatatcaaaatgtggaaatgtttgaaaaagaaagacaagaaggataggggaaaatagagaagaatagagagagaaaggaagaaagaaaggaggagagaagggaaggaaggagaatgtttgatgagcttatgaaggatgtctctttgcaactgagtgtgaatttagatgggattacataacatgaaacaaaatgaaaagaagaaaaaacagatacattcagtgatttaaaaatggggtaattctttctgtttttatttcacaagtcttttgtaacttattttagagttttaaaactttgtagacatatttaaaatgttcaattttcactaaaacaatcacatttttaaacataagggcatatatttggtgtgacaacctaacatttgccaccaagtgttaaagatgaaccagttttaattttaactagacgatttgaaacttttttgatatacttgagaatttgggactaccaaaaaacccctaaatatgatcctttatattttttattacttctaaaatattttgattctaaacaaatatatgtaaatactatgtggagaatttagatactaaaaatttaagtcaaatattgtttaagtacttacaatatgcccgggactgtacatgatgctaaaagtagccagatgcaatggttactgacttcgagtggcatctttttgaaacagagggcagaaatgaataaatctgagataacatgatgtgagcttgttccatactggagaatggggcactcagagaaaagagtgtgtgcaactgcaggtggggagaagctttgggtttggcactccaggaagatatgttcaaagcagaagggtaaagggcactgattgttcaagaaaagtgagtagtctggaaagggtcattatttcagaagcaacataccaagaaggaggcaggaaaagagaagacaaaacagcagcatggaagatgggtgaggagccaggccacgtgggtagaacttgagtatcataatatttctccatctaaattctactaggactagaagtcttatggacattttatttactctacaaagtgcccacgtcagtgacagataaagagtcaacatctgggagtagcttaggtgggttccacatggcccaggattgaacctctttctctcccttcttagctgtttgacctcagtcaagttatgtcacctctcatgcctctgttttcttgtctgtaaattgggaataataaggtaataataagtattgtgaggattatatatacatgtatataataatacatcatatataacattaatatttattaacacacatatataatctgcacatatgtttattatgtatgcccatatatatattacattatatattcatgtatacatatacatgtaaggtgcttaacagagtccctggtaccaaataagcactgaatcaacattaactattattatttggtttatctgaaacattcaaatggtatagcactaaggccatgtaaaaatatcatgtatttcaattattgaaactttttcacatttttgggtatccaggatagagaaggggaggaaggatctagtcacataatatttgagagtcagcaaattctttcaacaataatgtgattgtatttgtctgtgtgagatttctatgatggtcattttcatggagccagtcaagcattgactttgaaattaggcagatatgaatttgaaaagtagttttccctccactagccgtttgaccttgtacaagtgactttaactcattttttattattaaaaaaatagggattttttctttgtaagatttttcaagaggattcaatgtggtaacaggtataagtgcctgttagagggcctgtcatagataaatcctcaatgaagggtaactgttactaaaaggaagatataaggagagatatgacactacttccaaataaaaaccctggttcaatattggagcatggggaccccctttaagagaagcatcctcccagcataatgtccaaaatgaaaatatttcatttgtaagcataagaaaggggtcattttaagtgaaatgaccgacttatcaagccagtccactgaactgtagcttggagtctgagttacaaagtaatctatagtgatctgagggagtaatacaaactccaagttaatgactgtagaataaattctactgatatttgcagtctagtgtcatcaaggctaattctcctttaaagaggcaaaagcttcttattgtccccaaaactgttgatatagtatgtaactcagcatgtcacagaaatgttgtttatccactttggctattttgtttaaaaaaaacttttctaccctttttatttatttatttttaaatttctatatttcataagtaaaccaagcctcaacactcggcatttcaggccaggtatggtggctcacacaggtgtgtggtaatcacagcactttgggaggcttgtgcaggaggatcgcttgaggccaggagttcgaggctaacctgtgcaacatggggagaccctgcctctagagaaaatgaaaaataattaggcaggcatagtggcacatgtctgtagtccctgatactcgagaggctgaggtgggagaattgcttgagtccaggagtttgaggctgcagtgagccatgatcttgccactgtgctccagcctgggcaatggagcaagaccctgtcttgaaaaaagaaaacaaaaacaaaccatttcaaattcaaacatatttttctgaattaaaaaagaaaaaatactctctttaagtatatgaaaaagcaaatatctttcctagagtatattacattttaacagctcttgaaaattcagttaagtggtctagtgcttgtggtaatctggatgttagctaacaagaataaaaattaattccatacgttatcaacagcaaagaattttggagcagctaccataaataagaaactgctttagatgctggagatctaaatttggtaagatataatttcagccctcaaggatctagtttgttaagaaacataggcatcataacaaataaatgttcttgaattcaaaaaaaattaaagcttgattgttcagaaagcaatttcatctatatttaggagatgtttacaggtgttatattttataatgcagatctgagttcactttttgtacaagtagaagagtcacacttttatattaatagtgataatattattaacactgttggatttcttccatgtactgtcctagatattttacttattcctagaattttatagaataggtcattttgcttatgttagccttcagttgcaggtgatagaaatccaaattgagcatctattgacacctctattgatctgtccagggaagtacagaggagacctgccttagccatctgttgaccagaggaccaatcacatcaacaggactctcccctctctcttctaagctttcctctttgttgtctttattttcactagggttttctctgtaaggtgcctaaaatggctactagtagctacaggtttaggacctggtccttagcagtttaaatcggaggaggaaaaatacctcctgttcttaaagtccctattaatctctgttggccttgcatgggtgatgggcccaaccatgtaggaacacagggcagcttaggtcacatttccataaatatcagagaagtggtattgcctgatatgtatttcatagctagcaaatgacaactggaattgaagtccatgcttcttccgagtgatcactgtccctctaattgagtacctttcaattgaacctgtttcctggcgttactttaattttgtgtgaaaaactatcttcttgattttaagtaaaagcaatgaaaaaaggccctctaacattttctgctcacaaaaaaattagctttacagatagtagacttcatcagtagatacagtctttaaggaagaaaaacatagtttgtataaaatattactataccctttactatgtaatgtctcctggattctataataattggtgggctgtgtggtctgcttgccatcttccaagatgtgccccttattgaaaaaacaaaaacaaaacctatgtctgtagtatgtatatttgtgcatttaaatgtttgtgcccatggacttgtgtgtgtgtgtgtgtgtgtgtgtgtgaatgtatgtctatatatatatgtatggtgtttgtgtgagaggcaaagagaagagaaaaaagaatgacgttagcttatcaatatattataataaaattgtgttgactagtttctttatcgttctcttccaaactgataaaaggacaatttttggtgtgcggtttaaaagaaatgaacttttccccctatactgagggcaattttaaaagaaggtagtttctcaggtgtttctagtcaaaatgacaaacctacaaagtacatttgcattattttatgtatactttactgatagagtcctttaaatgttgagttcaagctaatttttcttaatcttcaaaaagtttagggatcaaattgtatcctgcagatttttgttatgctaaatttcatttcatctcttcttctttagttctacagagaagttaggtcaagattgtttgaaagtagacttgagtccagaaacttgtctcttcgaccagtggattatctaccaatttgaaaaaatatagcatgcatgtggaagaaaatgttacttttgcatgtcagcatgttgtcattattattagaagaacacatctttcaaagaaaggaaacataaactccataatgctgtctgatattattcttgaagacggctatcattttagctgttataaaacaggaaggaacatcatggagcattagattataatatctatagtcccactagcacaccattaaataaagtgaaggtatgaatatttaaattagaatttgttttttatactatattatgtcaggaagaaattgcaagctctggaaattctttgtgtcttaggaaaatgagattctattttttatagctctttaaaaaaaatacctgcatcagcagacaattggtaacagtcatcatatttggtgttatttagcatttctcaaaaacatggcagttgtttttatgtgggtgtggcatgttggcatttttacattatcgattccttgattcaatttctactctgtgctgacctgtcatatgggataaatctaactacagcaaagctctgttattcttcagtacagtacaacagataagtaagccagatataatacatttgggtgaaaaaactacaaaatcatagagggggatctttttaagagcttttaaaacaatcttttggtttaaggcagagaagtattctacaatgaaacactagattgcataagataagcctgtgcctgttccaacttaattttctttgttactctaagaactccccatatatatgtaaatttcagcagtgttaatgggctttctttggtatgtcagaagaagaatgtaatttgtgaactagataaatctataaggcacaggtgtgagcaaaaaaaaaaataataagaatcactcctcacaaggaaatactaaataacaattattattgagatgtttcatgcattttttttatccatagtagtaagtactactatctctataaagaggaaaaattcaatccaacagtcattaaagttgttctattaaatgtagtgataaatcttcagtttgtatttttaatataagatctgagggataatcaaagcaaaggcttatgtggatagggcatttattacataccaggaaatgtcctgaactctttacacatgattcattaattttctgaattacacttgtagataggaactattgttatcctcattttatagacaaagacacagagatagaggttaagtatctttactggggccacacagctaggaattggcagaaccaggatttaggcactaaaatctgtttatttaaccactagcctacatggccattggaaatgaattatacagagatgaaaagttttcgttatagattccctcgttgaaactcaaaaacagaaggcaaaatatgtaaaagaactcaaaactgagaatatttttaaaaatagaataaaatgtcatagaaaaaaatcacatttaagagtttctttcttctattacttttaccattgcagttatgggcgtttggatacagtttgggtttaataaaacccccaagtttggtttttattaaaataagtcaatctatcattggtcaatacatcacatttatctctcttttctagtagtgtcaaatctgaggagcaaatatatagctactatacaaaaatcaaagatttaaaagttttagcattgcattgagctattaatcattgtaaaaacattttaaatgcctccattttttagatgatagctacacattaaagatggggtgtaggtagggtggttgatcagtgtatctaaatagactatagtatgcaaaaacattcagtaaaaaatgttccttgagcaagaagaaaaaataaagacagctgatcaaaacacatgaatttatatgactcagtaattcttacattatcataaatttcgctaccacttttatgaaagcaattcacacaattcacaatgtgaggagcaattaccatcaaagatacataataatatgccatgtggtatatggagccacaggatgaagatggcaggttttcttgggccatcaattttactcaagggcattttaaaataatattttaatattaaaggaagcatatgatactgtagaataaaatttatttgcatttttaaaatctccaacctgactcttctgtgaaatttcagagctgtggctgttaaattggaactatgccaccagaccctggggtatgtctatttattcttctctgcctttagggaatttttttaaaaagttcaagaagccgtgagataatgcagccttcatagttattctgtttgtagattggtagtaaatttttgatacttattatgaatccaagagtggaggtgaaacatagcactggatatttttatatgtgttggtctatgtcaatcaaataggagagataaaatgatagtcttgttagtgaaagaaaatagggacaattaatgtataataaacttaaagttacatgatatgacagcatagaattaaaaatatgtctgtctagtaatttttttctccttcgcaattattgctttcttcataggcttttcctattgttctctgtcaagacactgcagtctgttttaatcattatcatctactgcttctattttacttgttatgtcatacaaattcatgtttggttctccactaatactgtttcaagaggtcacgaagaaggtatttttttttttaaaggaacaccaaaatcgaatgatggtatgatggattttatgtgtgactgagcttgtgtggagtgaagaaaaattcaaaataaattcctctctgagacacactgcatggaaatatcaaagcagtgcaattctttcataaattaaaggttatactctcattctgttttgggtccatccagaagatgataatgtttcgagagcagcagtttctcaggacactcttctgtgtttcactatggtaccaagaaatttgccagggaaagaaatgatttgcctttattctgtcaatattatcaaattaagaatgtttttccaaaaattcttttaaattattgagtgtttattatgagtatttatgatgtgcaaggtgctaggctaattgctggttgtatataaaggtatttggactccagtactattctatttttattttgtagtctgtgtgaatttataaaccactaaatcttacaggtttaatactcaaaactcctcttgtcttcaatatacctaccatagactgtaagggattatttcgagtagtcagttggggtttgatatggtgttaattctttatgcatttacatcattctatcaatttcaagtgtgttcttttattctttttcttttttctttaatttttccaggctgaaatagttatcttttaaagtctgttctacagcagctgctccaccccagtcattgcctttagctttctctagattgccattaggccttcttgaagtcgtgcttattacagatatgtgaggagtgctttttttagggggggaaggggagaaacagatgtagaataatccttttttgttgttgtttttaacacccttttctatgatggccagtgtttcactgatgatcttgttggctgtctccgtggctggatgagttgtctcgaagagcagtttacactcagtagtgaccaggtccttgagagctcttagctcatcatcctttaagtatagtttggagtattcttcccaggctgtactacttcatgcatttttttttttttttttttttttgcctattgtatttagagtttttcctgaaatgaatttctcactatgtatttgactatcaagaagagttgtatcatctgcaagtttgaggtttcacttgaaaatcctattagcccatacagggaataattcattccagtaggttcttaatagcccttccctgttccctgtttctaatccatttattgctctttaaagattaccatgtactcctttttcttattataaaatattgcatattcatattaaaatctggaaaattcatagaagcagaaataagtaatctaatgaatcaaaaacaatgtcaagtagtgtttcttaatcattacaattatttatgaattttggttttaatttttcaacatttggtctacttgatgtgtggcacacattgttctatgaaatccaaacagtgttattgtaaagtctctgggcttcttagagcaaaagttttaaaaccatcatttatatgtttaatatatttttatctatttctagatttattttaaaggcagtaaaataatctaacaggctcctgggtacccatggtgtttattatattatgaagaaataaaatattactcatacagtcgaaaccctacaattaaattcctttccctcccttcagagggaacctattataatgtgtgatttgtgatcatgaatgatttcaactagtttttctgatatttatatttattctgcaccttcaccctcatcatcatccttacaataggctttatcttttggaaatacatataatattgatgtgctctggttttaatcatcacctgcctcttgcctcagcaagctctaggttgtattttaaaggagattaaatatattttcactgaatttaattgtatctaagtaatacctttcgaagagtcaaataatacagaaaagctcataacaaaaagttgcaattcttccatccctccttcactctcagagacatgactgatctatctcagctgtttcttctagcatttacccccggatttaaaaataatatatttaaacaactataacttaatttaaacattttagacattatctcttcctttcctagtatggaagacaaagattgagcactctcatctgaccctcacacatttctgcctacatcctgcaacatatacttaaaataaatatataatgctaacattgttaaaaccatataaatattactcacagctgagctctgtggtgcactgtgtctctcttttcttttttgtacatcgttgcctggcattaataattgctttgttttgaaaaattagtcttagtttactacatacattttactaattttaaactacactttctgacagaattattaaactcccttcagtatgtttcatcacatttggaaatctattaattgatgatttttgttattatttgtgtttcattgttaagaaaaccatcctgatgcttttctctcccacatttttgtagcttccttagaaagagtgaagaaaaggtaaatgtttttaataaattatgtgtctgaagatgccttaattcccccctcttttagatatcagctggctctagaattctaggtagaaagcatctcttctcagaattttgaagatattgcttcatggctctcaattcttcactcaccttactctatgaaccccagggtctttacatcccttgaggactgaagtgtgtttccacttcaggtgctttgcactggctggtcttctatctggaatgcttctccccaagatatcttctggctaactctcttttcttcttagaaaactgctaagatttaccattcccaatgagccgcctcttgtccttttatttatttttgcaaactgcccctgcccactgccattcctggtctccctaaacaagtcttagtatttcttccctttctcttttcatgttgaaatacactatatagtttacttatgtattaggtaaactttttattgcctctctctgtactccccaagctacttcttgacccttgaaaaaatgtagattccatgatcgtataaaatttttattactttaaaaacttttctaaattaataaattataaaaaattaatatattcaaagcaactagatgtatgcctaaacacctagaaaagtgcctggcgcatgttagaaattagaaagtatttcttatgaacagttttatgatttttcacattgaagttgaagagtcttgccaatttcccctatcttatatatgtgatcagatttttgcctctgtaaacttttaggattttatcttgaccccaaatgttctgtagtttgatcacaatatgacctgtgctatgaattttttgacccgggaaattcatacacctaacttaaggattttaatttttcattattaattatttaacaatgtgttatttatctatggaactcttctttgttagatattgaatttcatggattaatcccctagctttttgtctttggtttattttgattactctttttttttttttccttttttttttttgagacaaagtctcgctcttgtcccccaggctggagtgcaatggcatgatcttggctcactgcagcctctgcctcccaggttccagcgattctccggccttggccccaccccgcccccgccgacccccatgagtagctgggatttcaggtgcctgccaccaaacccggctaatttttgtatttttagtagagatggggtttcaccatgtgggccaggctggtctggaacgcctgacctcgggtgatccacccgcctggtcctcccaaagtgctgggattacaggcgtgagccaccacgcccagccgatttctcttttcttttatttccttttctttatattctattgtttcccctggggagacctcctcacctttatcttacaacattttaaatattaccataatttaataattcttttgtgctttgagtagtcttttaaaaattaatatctcatcctgttcttgttttgtgcatgccatatgttttgctagttctccgagaatattgactcatttttgaagtttttaatattatttttgcctttgtttcctctgttttgttttctttcatgggagatacaaaatttctgggaaaattttgctgtccaataatgtttagctgagacactaaaattgttaaatctctgtatgtcacgaaagcatgttaactcaaatatgaacaaggtatcatttcattggaagactcccaaatatcctctcggtaggctatttttatggacaggtattttccaatctttgtctgctagcatttttgttgagaacggagtatgagctaaggatgagaataatcacactctacaatatgtagattttcactttttcatttttagtatgaattcttatcctcacccctcatccttcactgcatggtaattggacactttcttattaaatttccctagagaattgtattagggttctgtagagggacagaactaatatgatatatatatatatatatatatatatatatatatatatatatatatatattagtttattaagtattaacttatacgactgcatatatatacatatatatatgtatatatcatgggagtttattaagtgttaacttactcgatcacaaggtcccacaataggctgtctgcaagctgaggagcaaggagagccagtctgggtcccaaaactgaagaacttggagtctgatgtttgaggacaggaagcatccagcaagggagaaagatgtagactgggaggctatgccagtctctccttttcacattttctgcctgctttatatttgctggcggctgattagattgtgcccaccagattaagggtgggtctgcctttcccagcccactgactcaaatgttaatttcctttggcaacaccctcacagatacacccacgatcaatactttgtattcttcaatccaatcaagttgacacttgtattaaccatcacaagaataaattcccagtggtctcttgccaggtcagcaatgggatagtaacgaggtttatagggttggcagggggatctggatacctaactaagattttgcagcctcaacacttactctagccttgtaaattatttggtacttaaaatttcagagacattctggggatcagcagctcaaataacacttcttgctgtggtttgctcctccccttggcagacacatcctatccccagcttcctctgctctgggctagtaccactcactccatccactttccttccatcctatattaatttgttgacacttcttttctgatgtcatcctctggaccatatatatatatatatatatatatatatatatatatatatatatatacacacatacacacacacatacacatatttatgacttaactcttattttagaagatttgtaggttataatagcatttaagtgtgtgtgttcatggtcaggtttaaccaaagtcctaggcctgagtatttcaatgtgaagaacaaacagaatatgatattactttcatacctctatttttgatagtctgtgattctgagccctatctatgctttcagtcaaattaccaatggtatgaaactctttaattttgtgtgtctcacgtttagagggtagcttaagaggttctttaactgcatgactattgtgaggaggatacttatgagttgttcttcatttccatggggacaaggacaatgaaaatacagtataatacattcagagtgttattagaagttaggtagtaccttttaattgttaaacaataaagtaataacattgctcattaggcatgtgcttatgaagacaaaaaggcctgatttactgatttagtgatttagtccaaggctttgacatccatatgatgtggacctctgggtactaaagaagtctataaatcccaatcacaactgtgattaattacaaatatcttatgcatgtatttctttagctaaagacagaggtagaatcaaataaaaattactccaagtttactggctctatttctcttcatttgaaaacagaattttctcaaaaggcaaaggaaaagtttgtcatccacatctcttattaatgaaagtgtaacaatcatatactcacatttctccttctgaataaaacaaactactgatgagagataaagataattatttttagtacctctgttgtcttttaaatattccttttttggaaaagcaaaacaagacatgattatattgggagaagaatggtgacccaagaactagatggccttcttctggtacggttctttcactatctggtgtatctctgaagtgtgatcaaaggtaactgatcataactagataatcgttaaagcccctatcctccctccctttctgtatttttacctttcttcccttattgatactaagaccttgatactaagttgttcacaactggcccacattctaggttgaaatgatggtgcatgttggagacaaatgtacaaataaataccatatggttatattactactgtgaaaatgtatgtagaaaatgctggggtaatatggactattttcttaataatctaatttcttacctagtagacagtcaacatttccaatcatggaaatgaactagtgtccacataactgaaatccttcacatctggctatctttaggccctaaattatgtgaaattcactgagtattttccacagagttgtttactgttgtaaaatcttaaatcaaaatgttacatcaaaggaagagttgcatcaaaagaacctcagcaaaacctcaaaacaaccaaacactccacttgtctgtttaaattattagcaaaagcagctctgttatcccagcttctaagctaaccagactcatcattttggcctttcatgtatgcttttcctatggccaaaacgtccacaaattactaataaatgctgacaaggagagaggttaaaaccaggaagccatgccttttagctgacaaaacattcattgaaatgctatctgggtgaagcactgagaaattaatcatctgaatagtctaaattatagtacatgaagaatgcaacttgctagggagacataccttcagcattattcgaggttaatttaaaccaacatgtaaatgtttgtatgcttcatgtgtggtatcccaaaaggttgtgttttctcttttgatctttgaatatgctgatcgcctttcatgaacagtggcattcaatgcactttgaaaaaaacacagtctttttctttgaaggtaagttgtaagaaagagaaatcattaaagcctggagtgcagaattgttgtcgactgaaatggtatcaagtgagttgaatgcctcatattttaaaaatgggcatgatctctattattactaacaaaaaaatctgcattttatgtgatatctgacatgggaaagggatgcttgatgagtagccaatgatgttgaactggctgtattttccgactgacttgtttttcttatgaaggcagcattttagtaaaattgtgtttgtctttctttctgataggctctaattgaagtttgaaggttcattacacaatgcctgggaatatgttgtcaaatacaattcacctctcccacagtgaatattggcatgattttataggacagggtactctagagctcagctgtcataatatttggctccaatttcattcataatggacagaatatctacaatgttttgaatccctactttcaaatgtcagcacactggaacaaatattaaagaatgggtttgaatctaagtagatgagtatttccttgaagcaacatgttatagcctaaatgttgtttccttcaattatgtttaaacaatgtaaccttaaatgtttcacagatgtatcacttgaaatccaaaacacatactactcatcaaagtcatctttatttaagcttaggaagaaaaatagaaatctgaaatgtttgctcttagtccacacacacttctcatctggcaggacatttctgaatttatttgggaaattgaatatatgtcaggtaggtttgggttgctgggtaaatgagtgtacttcagtgtcaggactgtttttattaacagattttataaactggcttggtagtttccagttctgtggcaagaacaatctatcataataaacctgtaacataaaagtacagaatacattcctgtttcaagagtctgtaagaggagtcccctcatgaacagtttatatgagaggattataaaatgaagttcagcagtagcacaagcaactgcagtgaatggtgtgttgttaaggttctttaaatcatgaaaaaaatatactttcaaggatttattaatcttactccaaatatatatattttggtaaatagcaattggaaagaagggtttgtatttcttagaagcactgagctgaccaatatattggaaaactaagtaaagcaggccagtgatctctattctgagtgaaatattttgctctgtttgacatctgggtgcaatgatggctatgtcagtgtcactttatttttctcttgtgcaagtttgataaaactctttaaatactaatgtgtattttagaaaacacaaattctgttatattccaggaggaaggaaattgccttaggatatgaatcagatttgataacatgaactatcttatttaattattctaaattgaaaacatcatgaaagataattgggatttttccatttttattttcctcttgtttcttgcttatttgaatcattcgttttattcttctttctacttaggctaagctctcaaaaggaaaggagatgtaattcaatgtatgtaagtttctaagtgtaggtatttttcaacaaacacataaacaatcatcgatgacattattacttatgtcacataaaaactgtgtttaaacagattaaaaatattttctggagagttttatttattttacaatgtttacaagtgaattgtcaagatgtctcccaatattatttcctttccagacagcaatctttaaatcctgcttgagtcatcttttattccagttttcctttttttgagtgtaaaggcaataaattataacaataaaagacttatactctttgtcccatagtttctcttttctgttgaaatatagcttgctctttggaatattaacatgtaaaccagaggtttttttttttttttttttttgaacaatctgactattctaaaacactttttaggatatcactaattgtcaataaggaattgagatccacagataaacttatcaggaacagaaaattgttttgaatacatttttaatatttaaatagtcacagatcaaaactaaatttttttttaaagattctgttgaataggtaggacttcacattggattcaacctggtatttaaaatgcaaatactttttgatttctctttttgctaagtaatattctaagagattagccatacattttaaaatgttgtgactgtttttgtgtttcatgtttgtataaatgtagagattagacacttgtttaagatccttaaagatctgaggtaaattatttttgggaaatacaaatttctttctgtaatttctaccttctgtgaacaacttcttgaagactgttctgttgctcttggtttatacgcaggtcccttaaaataacaaaataaaaaataagaaacaatacataaggacaaagactggaaataaaagaaaaataatttaaactcaagggattttcttgggtaaggcctcagagaatgttccagctgttcttaagaaagacattgtatataaaggccacatttagctgaatagactgaaaaattcttattatttgagaaatgattcaattgttgtctcaatgctaaatattcataaaaactatccattcattaatcctttttaaactgaagtaattagaaaaagcaggtcaatgtgcaaagaaatgggcttttcttcatcaaatggttaattctttattaaatggttattctttaaaatgagcaaagatgagctcagcaaataaggtacttgtaataatgaaagtactatatgcaggaatactggctttttgtttttaatctgcaattagttaattaaatttcattgtagatgtattgcataaaatacatttgaaaggcaccattcttcctcataatacagctagtgaaggtccaaatttcagtgactcaagtgtaggtgggaaaaagtcctcacaaactttacgcaaattgttagaaaagcttatgtaaacatgactactatgaatacagaccagggatgtgccccagagtcaatgagttcaattcacttgctgccacaatgctttcaggcctaggctctttgcagacagagagcagcatcagggaatgattattacctgtgcccagcagggtttgttcaactgctaatggtcaaggtagattcaagccctctatcattcccagagacatacaaaatcaaatactgacttaaagagaaatataaatgaaataagttctaaaaggaaaagaaaacaaagaaatgtcttttacaaggcactaaagaaagacacaagggaacattcatatagattattttattaaatatttattgagcaaaatatttgtgccaggcactgttagattggcctcatgagctttgcatgggcacccacttgctatacatcaggcttggaaacatactcctgaccagcatttatgctagacatgatttatgtctcatactgtgctaagggggtgactaaaatctatattgaccaatacttgatgagtatatttgacagatgtttaaaagttaaccctgctcaaaaatgtaacgggatctttactaatcaggatcataggtttgcatgggttcctaggaggaaaagaatgagtgggaccagtttatacaccaagcatcaaaggactccattctcaccctagggaaacacggattttactgctcaggggatgatgaaaattggattccgacttttacacctcagattatttctattaattacacctcagattatttctattacacctcagattattatctcagattattatctattacacctcagattatttctattattcagtcttagccgaagattcccagccccaggtccatcgttgctcaagggtaagatcacagacctagtgcctgcattatttcccttctgtgcaaatcgtgagggccaattttgctctctaaaaatttgcattaaacagaccaatcactagattccttctacagatcaaaatgcatttattcaatcaaacaaaagggaatccatgtgaggcaactaaggaagggctttccctccagtctggtgagcagtggctgtggctctgctggctctattttgtgaggtctttataaatgaccacaattaagctgtagatgtactcatgccctagatgtaaccatccgttctggggaatatggcttgataaacccattggtgtctaacacttattcatgtcactcattcattcattcatttattcaaacaaatatttttgagctcttatgaggtgccaggcactgttctaagcaatgggaaaacaggagtaaacaagtccccattcttatgatgtttttattttagaggggataggaagaaggagaaaaagccaatgaataaggaaagaaataaatcaacaagataatttcatataatgctaaggatgggaagaaatgaaaacaggtgttggaatagatcatggggtgggagttaattgaaggggtagtcaagaaaggccctgctaaagaagtgttgggttggttagagcccagcaagggacttttcagctctggagatgcttgtagagaaatgcagaggtcctaatatgggaatgaacatctcatgtagggtatagcttctcatgtttgaggaacagaaacaaggccctaaaggctctaatattgtgagccaggataagggcagccagggtaagggcagatgacatctggagacaggtaggggccaggtaggaccttgtactgtgtacgtaggaccttgtacatgtaggagtcagatcacgtgggaccttgtgcttcgtttgaattttattctaaatgttgggaattgattagatgattttaaaaataatactttcttaatactgtgtcactctgcctactctctgagaaacagatcataaggagacaagggttggaggcaagcaatgcttctacagaagactttggtaggttcggtttctataatttccaagctctgcaggagaccactacagcttcctcctcagttactcttatttacttatgggcccaaacccctgagcagttaaaatctggcatcaataacactatcaattctggctaacaccttggccagtgagaagggttaatataacaggagggaagatgacagacggaaaaccatttcttttacctcttttttggtctccacaggttgacaataacatgttgtaataatcacatgtatgcaatttaccagaagttttgaaatcttagattaccactaacattccaatttctaaagacagtggacatgaattcctgcagctctctgagaatagattttagctgttaatattatattacaacttcctacatagttgtaaaaatttaggttaatgattcctgtgaatttatttttatttttttgaaatggggtctcactctgttgcccaggctggagtgtagtggtgtgatctcagctcattgcaactttgcctcccaggctcaagcgatcctcctgcctcagccacgagagtagctgggattacagattcacgccactacacccagcaaacttttgtatttttagtagatatgaggtttcaccatgttgtccaggctgttctcaaactcctgagctcaagtgatccacccacctagacctcccaaagtgctgggactacaggcatgagccacctgtgaatttaaagtaaattaatattatgtacacagaagttacaataaaaatgcttctatttggataaaacaaaaaaattaaaactactgtaaaagtgaaagatactacatactttaggaacaactggtatttgtatgcaagtgggcctaaatctaatgttgtgtgaagatcaaagccaagtacaattgtagctcatgttgcagttatttcgaggtctcaaaagggataacaacaaaaatctataatagaaaacagaatctgggttaaaatcagtggaaataatttttatttcagaattaaataaattgagtgaaatgaagtatctggctcttggaggaaaatatggtatcttattctttaaatgtctttaaatttataagtcataagctgcaagtcagtagcatcattatgttgatgaattacccagtttaattcttataaaaattgaaattatcttctgaactctaagtcatattttagccacaggtatttttttgttttgtttaatcaataattcctgaaagaatgaaacttattcgacttttattacgtgacaaggtttaaaaaaatttgcttgaataaaacattatggagtctgaattcaaagcataaaggcagaaagtaaagtatgaagatctttcaaacgtctgtcacttttaataattttgttctatgttatatgacctacgaatgttaagagtctgtaagagtttcttcagctgcatttgattttaccaacaccttgtgggtacagttaagaagatgacttatttgaggctttataactgaaattggatatggttcaaacgttcaacagatataaacatattttaattaagaataaatatttttataagattgctgaaatgacttctctcaaaaatttatgccggaacatcaacaaataaatttgcattacaaaatagaaaattcaattgtggaaaatcatattctaacttattctgatgaagtagttcccttgtcaggaagctttttcttaaagtgtgttttatgatttgtgatagaattaccatcactaagtcgatcattgcccattggttagtctacatgtactgccttttagtgacatgagttcaattctaattaagaatgagaatagcctataactatgaacacagatagctacatgtgtctctagtgagaggtactagtcctctttgacatttctcttaaagcggaatttatttggggtagtgatggttttactggtagccataggggaagataagaaaagggggccaagatattcatttctactgctggcatgtggaatgctcttttcctgctccatgccagtctctcacttgatttagaaagatttgtgcgtccttagctttgaccatcaagaagagtccatctcctttgccttcctgtgcctggtacctgaaagacctagtgaagactgaaagaaaagtttttattttcttacatagtgaaagcactttgaagcattttgttacacatatctataatttaacatgataattatattgatcatttacaattctacacattattttagcaagtaatgaacgttcttaagtgcctagtgttgtcataggtataaatcaagtaggatacctgccctcaagaaagtgtataattttatgcgtagagataagagatgagtactttcgcagaaacaaatgaataattatataccaacatggagaacttaagctcataggtgaatgtgggaatatggaggagaatgaaaatcattgccaggtgagtgatcaaagagtgcattctagaaaaggtggtacctgtacaggggtttggaggatgcattggtattaaataagagagaaattagagggaagacacatcttccaggcagagtgtctagaagcagagccagcagcagattttagtgtaagcaatttattgaaaaagtcctctcagaagatatctatgagatggtaagaaaagctgaaaaaggtaggggagaaagtggacaaagatgtgatctctaaagttgagcctcagactgatacatggcatggtctggagggaaaattgcaccacagaaagaggtaccccttaaggaacaggatgccaggattttacccctcatatctgtcagttatcggctacaagtccaaggggcagggggaagtgcaagtgatgtatcttgctggaagtctcagggtcaggaggctctcattcaaagaggcaggtctctggaatgatgcagctgcaagccattagcagccaacccttgcctcagctgagagatgggtaccaggatgaaaggcctggtaaagggttatggctgtgccaccagtggaatttcctacactgggaatatacatgctaggtgcatagaatgttaggtgtgagaggggagaccagcctgttggaaagtattcattaatgcatatttgtcaagaattctagctggtaacactttattaaacattagatattgctattttatgtgctttgaagcaattacactgtttgaaaaaccttattttgtaaaaaaaaatctgttctattcactgtctcacagatttaggacagtttattaattaagaacactagatttcaagtcaaacagacctgaccttaaaccttgaccttgttctttgctgtataaatggttttgtatgagttacttaaccacactgagcctcaaattcccatcagttatatgtggattataatgtctgcctcatgcttgttgtgaacattcaatgtaatcattcatatgaagaagcaatgaacacagggtctggtgcacataaatgttcaacaaatgatagacattacttccttctggatgagcaaaaccttgatgctttcagtagaaggtatttggaactatggttgaatcttttctgggggtattgatgggactagagtcaggatgaggtggatgaaatgccaggtactttcatctgtatgacttgagagtgtatgcatcaaattttgcaccctcgagcacctctctcacctccacattgaaaaaaatacatgccagattaaaaaaaatgaaattggaaaggatggtttgtagaactgttagagcatccataaaactcattacaaagtaaaatatattagtaataaaatgattttagtaatacctcgggaaccactctaattccaaatcatctctctgtctcttgtaatggctttccaatattctttgaaaaatattgaggttattttagttatgatattggtactttgatttggtttaaatatccttttattcttgagatatacaatttcaactgaatggcaactatgacagagttgaaaatgtacagaaaaataaattatagattagacaacgtattaatttaaaagcagttgcaagcaagttactatattgcaatgaaaaaaaagttcctaaaattggtaattcaactattgctgtcctaatagctgaagtcatttttatgtatggcaatcctaaatcaaagccatcataagatgctgcagacctcttaatagcttggctccagtgataatgagcccaggacattagagctcatttgagagcaggattcataattttttttactgtgcaattttcctacctctggctttgtctcaaagacatagccacacatggagaaggacactgataataagagagtttgacattctttataatttttcttttgccaggatccttataatccttgaatcaaaatgattgaagcagttatttttaaaaatagaagctagatttaaaatgtattattttgtgcctcttttgacattattttgtttagagcacctttaaaaactctactggtgattaaaatattgaaactataacagtatttttggcatgatttttaaatacttctttcagctatatacttctctaacttattggcttattatttgatttaattgtccttaggcagtgttaattatgagagtttgccgagtttcttcttgggaatttgagaataaaggatgcgggaaagaggaggtgggtggaggatggatataaactgttttttcaatgtactgaaggcatttcagattaccagaagaatcacagagacaagggaccatttagccatagggttaaacctgtcactttacctaccccacaaataagtaactatggcaactcactgaaagtgcttagctaccatgggagtggatggagttcgtgctttgtggggacaatgctgtgggacctctatgcccccatccataagggaccctgggaattgccttctagcagagaggccaactcacatttcaaataagtatttttccctcctcaactgcttttctaagctttgcacattaacactgacctagtgcaccatttaaaagtcctaaatatatcacacagtcgccagcccaatcaaggtgagtggtcagacaccagcatgctgtgcacagtatgctagttggccttagagtaatacagggtacaccatttatgtccagttaaccaggtgaccctctagttgctttattaagcacaggcttgactgtcaaacaggtcacaaggaggacaaaaagtgtccttgcatcgtatgaaaagagttgcttgaaatcacagaataccctctattaattgctaaaatccaatttccacctgaagacatgcctccatgactcgtgagaaaaatcaattatttaggtaaataggatctgcaactcaaacactcagacctattagagtatctagcagcatgccaggagatagactgagctgcaagataaatatggaaccatcttgtggaatataaatttcagttaaaggttttaaggagtatataataaggaaagcattgttttatattaaaatgtattcaattatattatgggatggaactgaaagttcacatgcagttttcagatgtgtcccccaaagttaatatatttcctgggtactcattcacactcttctgccaatagtattaatgctttgggaaatgtttgagaagtgttgttccagtggaaatgagcctgtgggttcactgattcatttatccattcattcatttattccttcatacagtatatagctttcaagccacttttatggactattttattaactttgaatatcaaaaccaataaaatagactttgtgtctgctttgtgacacaatttaatgagtaacaattttttttttttttttgagaaggagtctcactctgttgcccaggctggagtgcagtggcacgatcttggttcactgcaagctccgcctcacgggttcacgccattctcctgcctcggcctccggagtagctgggactacaggcgcccaccaccatgcccagctaatttttttgtatttttagtagagacgaggtttcactgtgttagccaggatggtcttgatctcctgacctcgtgatccgcctgcctctgcctcccaaagtgctgggattacaggcctgagccatcgcgcctggccatgagtaacaatttttaaaataaaaataaatagcaaatgatgagtaaagtacaacaataaatcaaacaaaatgctattaggaccatatggcagaaaaacaacagaatcttagaagagttagggaagacttcccaaaggaagtggcaattaacctgagatttttaaagatgagcaggagaatttcaggcaaataaaacttgcagtggggttgggagtaggtggatggaccatgatattccaggtgaataattgagcactttagcttgggaggagggccctaaatgagaaagtatatgacctatttcaggaactgaaagaaatttggaatgcttggaatataaagtgtggggcaaatgatggaggacaaagaggcagcagggataatatagtttggctgtgtctccacccagatctcatcttgaattgcagttcccacaattcccaagggtcatgggagggacctggagggaggcaattcaatcataggggcaggtctttcccatgcttttctcatgatagtgaataagtctcacgagatctgatgattttataaaggagagttcccctgcacatgccctcttgcctgccaccatgtaagacgtgactttgctcttcaagtactttctgccatgattgtgaggcctccccagccatgtggaattgtgagtcaattaaacctctttcctttataaattaccctgtcttgggtatttctttattagcagcatgagaatggattaatacaaggcattagagggaaagagtggggagaggtaaagttgaaagacaagcaagaagcagatcatgaaacgctttgtgagccttgttagtgagtttcagggaaatccctctaactgcaatgtggaaaatgaattggaaaagtcagaagaggaaaattcattaaaaggatgtgaagtaattaaagggatttaggataatggcctgaactaagatggtggcagtgggaatgaataatatgaatggactgacaggattttttttgtattttgactcagcaggtgttggtagcattagatatagagagtggggaggaagaaggctctaggcatgatgctcagattgctgatttggttaaaggaagcagagaaagatacatctggagaggaaacaagaatccccactttttgttttgttttttccagttcctgatagatagccatgctcaagtgtcccagtggcagttgagtatttagagtcaaagctcaggggagaactctagctggtgataatgatttgggaattttggcataaaaatactcatttgaacccagggaaatgggaggtaacatccaggataagcttgtagaaggaagagactgtgtagtaggaacacagggaaagatatcaacaccagagaggaagagatgctttgcttgagggtgtactctacatttaaatttttctctttgagagaagaatcatgacaataagaaatttgatttattccatatttcagattgttttgaaagtggtatgtcactaatgaaaggagtgtgaagtgaatactgttgacattcctgagaaatgtatctggggggccttaaaatctgtaaatatcataaatatcatacgaatcctaagaaattctgggatttaaggatgagtgggagacttaggttcttggttctgtgttgtaagtcattctccaagtgtagcaggaccatagcactgatgaaaatgatttatacagtagtcttatgatccaatgcccatgtatgaacaaaggttactgttcctgtcttctaaattggggttcccagtgtaatacaggaagactactgtgtgctagtaaacagaaagcacaatccacatttgaccatattttcctcgttggatgtgtttatggatatattttattctgcttttatctttctgagattaatgccttatctggccttttttcctatgagtacctttggttataaagaacttcgcattgctacattatcaattttcagcctctcttttttatttttaatttctttgccacctcttcttaatacataatgctctttcttccttcgttcctccccctctctgtttcttccttcctcctttctttcttgctttcttctttcttttctttattctttctttttttttttttttcaaggtcttgacgtgttgcccaggctggagtgcagtagtgaaatcatggctcactgcagcctcaacctcctgggctcaagcaatccttccacctccgcacccccaagcagctgggactacaggcaagggccaccatgcccaactaatttatttttgtttttcatagagatgaggtctcactatgttgcccaggctgctctcaaactcctgggccaagtgatccttctgcctcagcctttcaaagtgctgggattacagacatgagccacctcacccaaacttttctttttttttgagagattcttaaactagattgtacttacgataaatgttgactgattcattaccttcaacagtgctttcagcctctgatggttcagagaaatgattgtgtatactttatatttcacctgaatcaggtttcggttgagacaataattttctgagtatgtctccacttcacaaaattaatttattttcaacttttctctagttttaccactgttttgataaataatcttacagtggaggaagacttattgaaacaatttcatcacttttttttctcttgtttgcctcagagtatggttgattcattctctccctaggttggagccattgcagaatcaatattttacttttaactgactccaaaatatatacattctagctaagtactttcagcactatgagttgtccttcttttaaagagaaatttttttaaaatgatatcattaaaaacaagccattccatgatttattgtataagagaagataagtacggagttgtaaacctgcaatagaataataccctggatatccaccttcactgatgagtttaactgactcattcttacctgttaaccaaatgcttttgagagtcaaaggcagggtctgagaggaattatcaatgaatatttgtaatgaatcattgaggtcgcttgtgaatagttgaaacttccaatattaaggctgtgtaggccaagaatctagttatcctttcagaaatttttttttctgaccacctactctgtgccttaagcaaaagtacctgcccttctttctttcttttttttttttttttttgagagcatggtgtggtctcggctcactgcaacattcgcctcccgggttcaagcgattcacttgcctcagcctcctgagtagctgggattacaggcgcctgccaccaagctgggctaatttttgtatttttagtagagacaaggtttcaccatgttggccagactggtcttgaactcttgacctcatgatctgcatgcctgagcctcccaaagtgctgggattacaagcgtgagccaccatgcccggtcagtacctgcccttctctaaaggcacttgcttgcagtctttggaggagataagctttgatcaactcatcaacctaatggcaagtatcatttgacttgagaaaagataagaaacagggttctcaatagtgtgatctacaagatagacagcagtcagtagacgcttgcttctctgaggaagtgactcttggaagaattagtaagagctaggtgggcaaattcgggtaagacagaaggttgagaaagatgttttcagagaaggctccacaggaacatagttcctctcctgctgtattatggagagaacatggagccttcagagatataaaaatgtcattgtggctggaatgcaaagatgaagggaaagagtttgaattgaggaagggatcagagcatgcaaggatttaaagattactttaagaatttggtgcattatactcattaaatgatgtttgccacttgggtcaacaaacattctgtaaaggcttagatagtaagtattataaatattgcaggtgatatggtctctgttgcaattactcaactctgctgttgtaagggagaagcagatataaacaatatgtatgtgtgagtagatgtttccataaagctttatttacagaaacaagccatgacagtatctggcatatctcctgatcagataaatcctcatgttgctgccttatttcccaatgtctccgtttgaactagtgcagggatattttggagactttagcaatgcctagtcagcaagcatcagtgtactttagacattgaaaatcgggttaggaaaaaaaaaatatggactgctttgattttcctttgaagtaatgtcacaagaagaaaacagcaagctggttcatttgccaaggaaggaagagcatgaaagacaaaatgaaatgccagtaactaggtactagaggaaaggagtgctaagaaaatgttcaaaagggatcttgaaaagcaaagatcacttggtagatgaacttgttcaaagtgttcgctaactcacctcttgcaagaacaaactatcttgcaaggctctactgcaacatgtctgatacacagcacctgcagtcaacagactctgtagttgcaaagtattgagttttgtgctcaagctatagaagttaatggactgtcataacattgttcagatgaaacccagcaaagcttaacagactaaggtggattttgcctccccttttaatccagtgctaatttctttgagtaatctcagaaaacttttttatgctaaagtgattcatttataaagttcttgtcaaaacaaccagtgtatttaaaatattttggaattataatacaggacacaaatgaaagaagatatttatactaggcagatgggctaggttatgctgcaataatgaacaaccccaaaatcttagtggttgcaaacaacaaacttttttctcccactcacaatacaggttcatcatagtcagcagggggctccaggaatcataattgctgatatagccacctgacagatcagtaacctcagtgtagctggtggccatgagaaaaggcgataatcatctttcatatcaaatattagaacaatgcaagagaaatatggtgattttactctctatatcaatatcacacacactaacacttggtgtgcattttagaatatcttgctggttcccagtaaatatgtcaactttttgcactatataccgcttgaaatgtcaatactgcacaaatacgcgtagtctgctgacagtaacctgccaggttctagacttccatattgattactgttagcaaaatgtgtaggtgaaatttttgtagggtacgcacgtgaccattcacagaaggcaagaggttctctttggaatttaattttctgtgtgaaaaataaatcacttttttgtgtgtgtggaacatttctcatggaataatgggtcatattaggttaagtttaggaaactgatgtttattgagctgtgcacatatctgctaaaggaatttcacatctataaataaataagcttatttttccatggtgtcagagagataatgagactttcatataaaactatttttgccagctgaaatatcatgattgttattctaatatttcctccacaaagacttagtgaactgcatgtccattttagaaagtaggagtagatattttaattttttcttgcttcttgagaactactatcaacaataaaaaaagctttgattttaacgtgtatatcttaagatttcttttgatcaatactaatgaaaataaacctgaaacgcgaatcattggacaaatgtgagatttttcctttaatttatacattaattgatgtaagatagtatttagaaagtttcaatcctttccagttacaattgtaattgtcacttacctcaaactaaacaaacggactctttcccatatttttctacttggtgaaggacattctaatcatctagatgcctaagtcagaaacctaggcatcatcccttcattctttctgttcctcacagtcacacttaattaattgaacgattttcggtccctacatacttcctgatttcctcccctgtgccctactgcttctctccctaactcagataatgatttctcgactatcctattttaagatcaggctattttgtctccttgcaatgatctctctataacctagtaatatcaagccctaatgaaaagtctttggtcggcttctgtcacccaggataaacgtgaaactcctgagagttggatctacttcctttcagcatctcacccttgcctgcacttctagcctccactctcaaaactctttcacacatcatttgaacctgagacattaaaaatgccttccagggcttggtgcagtggcacacacctgtaatcccagcactttgggaggccaaggccagcagatcacttgagctcaggagttcgagaccagcctgggcaatatgcgaaaccccatctctaccaaaaaaaaaaaaaaaaaaaaaaattgctgggcttggtggttgagcctgtcgtcccagctactcaggaggctgaggtgggaggatcccttgagttcagaagttcaaggctgcagtgagcagagattgagccactgcactccagcataggtgacagagccagagcctgtctcaaaaagaaaataataataataatactgccttccagttcctccaaaataacatgtctttccttggtaaatactcttcttactgctttcagcagacattcaacccacaggtcccaggtcgttgactcattctcatctcttaattgctagccaggcctttgggaagccgttctctagttcctactcagttaggcacccaacctctctgctctcatagcacataggctgtccctctaacatagcatgagtcacacgctttccaaactggtgtttacctgcttgtcttctttactgcattgctccttgaggtagcaaggatgtcttctttattagcttttttatactgagaaaattttaaaatacaggaaaagaaacatgataaaatatatacccacattcctaactcatagaaataactgttgacattttgtcatgttttcttttcttactagagaaagaaaatgagataaaactaacctgcatttctatcctacttttctgcctgtcttagaggcaaacaccaacacaggtttgttgtcaatttccttcccattaaaaatacttttacatacctactgtgtatctatagccaacagatcttatatttatgtggtgtttgcgtttttccaattttagaaatggtttcctacctttcttaacctacgacttctgacaattttatttcaaaattatgccaatatgtatagatctcaaaaacataacattgagtgaatatgccaataggtagaatgtcatgtaaagtttaatttttgtcaattttatgagtgaaaattgtatatcactgttgtttttatttacctttttttaccagtttttttccagttttgttttattattattttattttattttattatactttaagttttagggtacatgtgcacaatgtgcaggttagttacatatgtatacatgtgcctgctggtgtgctgcacccattaactcgtcatttagcattaggtatatctcctaatgctatccctcccccctccccccaccccaccccacaacagtccccagagtgtgatgttccccttcttgtgtccatgtgttctcattgttcaattcccacctatgagtgagaacatgcggtgtttggttttttgtccttgtgatagtttactgagaatgatgatttccagtatcgtccatgtccctacaaaggacaggaactcatcatttttttatggctgcatagtattccatggtgtatatgtgccacattttcttaatccagtctatcattgttgtacatttgggttggttccaagtctttgctattgtgaatagtgccgcaataaacatacgtgtgcatgtgtctttatagcagcatgatttatagtcctttgggtacatacccagtaatgggatggctgggtcaaagggtatttctagttctagatccctgaggaatcgccacactgacttccacaatggttgaactagtttacagtcccaccaacagtgtaaaagtgttcctatttctccatatcctctccagcccctgttgtttcctgactttttaatgattgccattctaactggtgtgagatggtatctcattgtggttttggtttgcatttctctgatggccagtgatggtgagcattttttcatgtgttttttggctgcataaatgtcttctttgatgaataatgagatttaactttttcccattgaccattcacatgttcccaactctgaatttctagtaaattcatgtttttccagagaatgaaagagtgaatggccactgtcttgaggaaatgggagtattctagatgcatagtcaggcagtgtgattagtatagtgcaagaatggtaggaaaggatggagaggacaatgggaaaacaccttgctaaaaagtttggattttgtcttctagtgatagaaatgtactgatggtccctgacatgggtaacagctgctttagagctgaatttcaagaatcagcttgtgaacaatgctttggagattaagacagtaggaaggagaagatttgaagcagtaaagtgatttagaaaactatttcaatggaccagacaagaaatggtaatggcctgaaatgagtggagggagtggaaatgaagtcacatggctgcagttgccatttattggagaaactgaatttcagggatttggatcaggtcaaggtatgttatgcacataaaccaaatattaatgatatttatttagtgtgcaccagtgatatttgttttttccttcgctaaactgaagattaaggcaatcagaacctagtaaacattgctgaattcaccattgtatcccccagtgctaatacacaaaaagtatacaatgaattctactacctacctttcgcagtgtggctatccttgcaaatttcaccctttcccttcctttcagtcattcttgtttccccatgctccatagatcatttagccaccacatctttttgtgttattttgttttctgcaatgatgctggtataattcagaactactagcaaaatctcatctctagcttcatgtgatattttcctgcttataaactacccatattcttgctgtgctatagtcaatatgtgtaactcttctgaggcctcctcattcattgcagatgtttgcaaacttacctctcttcttaagggcccattcgtatgtacttaaataggaagatcatcagagacaagtatccacatgtgaactcccttagctactgttcttttctctaaatttctctttttctctgttcaaaaaatttccaactttcaactttgtggacacttctggaaaaaaagaaagtcgtgtcttaccaattttgcagaattgaattacaagtttctcatactaagacatttttctatggaagaaacaaggttcttttgtagagatgagaatttaaatgatttttttttttttttgcaatgggaagagagatttctcactagtcttactggttttcatctgactttatagtttaaaattgatagccattttgatggcaacacacatggtttagttaaattttactccgtcctcagttttcctgagggagtgtcagctactgtgttttctttacaaaacaacataaattccatgtatccaccctgggaatcacttcactgcgttgaatctggataggaaataaagattcatgaatatttcacaatttactaggaaccatcactttcttgctcttccgtgtggattttctactaattagttacttggtatgtctaagatacgttatttttattatacaaagactgtatcactttttattcctttgatataaatcataatacagtgtctgataagtacagctttttaaaaactcttttcatagactgtcttattctttttagatttatgcccatgatgtgcatggtcctgaatgtggaatgggtctctctgaagaaaagtgggtcagatggttgcttgtgcatattggaaagaaactgatagcttcctggtctcttttgaagggtgctgttgtaaaatacagattagtcaaggtttacagtgctgttactagcctgaacacttcaaaccaccatgcagtttaaaactattcagtgcttatggcaaaattcaggtcttttgatgttggggcaggagtagacattttattggaatgtaaggcaaaaatagagatgaaaacattgaatcatttttggtggggggattgacttaccttaataataattttttatacctttaaatccagaaatgtcaagaaaatgacacacaagaacaaaacaaaagaaaaattcagtttagagcctgcttaaaaatctgacattgatcttccaatgccttaaaaatgtttttattatgaaaaaatttgaacatataaaaaatggaagatatggtataaggaaccctcaagtacacattacttgcttcaataattatcacccatcaactaattttttttttcatctgtaaccctaccaactgttctcctttcccactggaatattttgaagcaaatcatcatatcatataatctgtaatctgcaaatatttaagtatgcatatctaaaagttagaattctttttaaaatcataatctcagtataatgacacactaaaaaatgaacaataattatttcatcccatcaaatattgacaagctattattcttttactatatattggctagaattttatgtaaagaaaagcttttcaccattgactcttatttacctacaggtagaattcaaacaggaaagcagatcaaatacttgattctttctttttatttcccagtttttagaaaaaatgagttggtttactagtatcctttaatgataaccagtttgctttttgtatctctatgaactcatagattttaaatatatttgatatgtttcgattcattgcagttatgattcttttcaataatcaaattgtctcatctttggttggtaagagtgtcttcaacttggctttctagtcctttaaactcagttttccttaatgattctcatgcttttcagtgttaagatgtggtaggattgttttgcatatttcctgtcctggttttagaaacagtcatttcttggaggagccctggttccttatagtgaaaaagggtatttcaagaccacaggtcggtagggctgttcactgttaatatgtaggttgtttctaggtcttttcagtggatcaggtgggaaatatatatttcaaatagagaaaatacattatagtttattctgacatgcccatttaggaatatgaggcttatagttaaattcattaatttcatatttgtatcttttttctcatccactgaaagttttgattcctaataacttatttgctctatcatagctctctatatatcatttcataataataatagaaatattatcatatacaacatagtggctgaaatgactttgaaagatttcttagccacgattttatatttataaagcatcccactaggcatctacaatcaaattacctttttttaaaaaaaaatcacttgaaaaaattattttatggttaagccaccaaacaacttcatttgcttcatttgactttttgcctgaaagtattttaaatatttgttttataatgatgtaaaaacttttacatagtttcaaggtcaaatttgcaaaataagttatattcagagactagactctctagatccattcatcctgttttcttcctcactaatgtgtaaccattttatttagggttatctttccatttgttagaaatattatatatataaatagtttgtttaaacagtccgcttaagaatatttttctagtcttttgctgctacaaataatcttgcaatcagttgttttgtgcacgtgtcttttgctttttgtcattgcatctttaggatagtttgtttttttttttttgttttttttttttttttgaggcagagtctctctctgtcacccaggctggagtgcagtggcaggatctcagctcactgtaaactcttgcttcccaggttcaagtgagtcttctgcttcagcctccctagtagctaagactacaggcgtgtgccccacacctggcttttctttttttcgcatttttggtagagacgggtttcaccattttggcgaggctggtctcaaagtcctgaccttgggatccaaccgcctcggcctcccaaactgctgggattacagttgtgagctaccgtgccctgccaggatagatttctaaaagtgtgattactcagtcaaaaggtaaaagtagataaatttattagatgttgtcaaattcttctttgggagtaatgccattttccaatcctaagatcagcatgtgagaatgtgttctgtttccataggttctccaacaaattatattgccaaactttatgttccaaagctttgtggggatatgtctggtagttgattggggcagagaaaatgagaaaaacttagtatgaagaaaagagtcttaggcttgaaattaagacacaggtttaattcttgaccattgctgatcacttgtttcaccttagacaagtcagccaacttttttcatctgctccacagatctgtggtaaggattaaatgagatgacatccatgaaacatatgacagaataccttgccatagtggctactcagcatgtaagttttttgtttgtttctttgagacagagtctccctctgtcaccaggctggagtgcagtggcgagatctctgctcactgcaacctctgcctgctggattcaagtgattctcctcccaaatagctgggattacaggcatccggcaccaggcccagctaattttttgtatttttagtagagacggggtttcaccatgttggccaggctggtctcgaactcctgacctcgggtaatctgctcgtcttggcctcccaaagtgctgggattataggcatgaaccactgtgcccggcctagcatgtagtttttaaaaggcaaagcaattgaaatttgtaaagcatttggatatctacaaaagttatttgacgagaacatacaaggggacatctcttatggactggtaattttaggattgtctacttgatgttaactaaatatccttcctaatgccaaaccaacacatggggtaagaataagtgatgctggactaaaaaaaaaatttgatttctctatcaaatgtacttttaggtaaaaaaaaatatgcaaagtataaaatatttgtatgggcaaatgttttactaagggtgtttgggttattttctattgaacaaaacctgctaaaccagcataagatgcactgaactaaagtgcagcagagatgctactgtcagcaagagaaggattcaaagagaggaagcccaatccgagcattacctggacaattaaacagtcagttattgggattttcacaattcttagcttttttaactttcacaattcttagcttttttaactttgagttttaaaaatcatgatggagagaaatttagttcttaacttttattttctgggcttgatgaagattgaatttcatcagagatgagctaaacaaattaaaactgaagcatttaatttagaaaactcaaatttcttcagcctaaaattgttcatttaaacaagtttgttagattctcaaattaataggatactgaataaatatgaaattattctttcctggaaagttaaatggaaaaacaggacagaatcgctattttataactaatacatattaagtcaagaaatagtaaaggattatttgtcttcaagaaaacatcctgtaaagaatggcaatgttggtggtatatagatgtaaaatgcttaaaaagaatgattatctagaagatgttatacatgttataattatctttaagtctgccttctctaattctgtaagttaaacacaaatattgatactttaatttttaaaatatttttaaaagtagctgaaaatggggctccatccttcaaagttctaacaatacaatttatagtaaagaatatgtatgagaaacatttgttcttagaagttcagaaaaatcaaatatataatatgaagatagaataatgtagagaagttaaagaggagaaaggggtgactgattctgaatcaagtgagttttagcttcttttaagtgaaatcatgcatgctcctcacatatgctaatgtataaaacatcaatttatagaatagtatttgaattacctgcctaggctttgcaagcctagacctttgaatttgcattcaaattcttgatgtacattttctagctgggggactagaaagcaagacactttcctttcagtaccttgggctccccatctattaagtggagatcattaaaatctgccttgcaccgctgtcctaaggatttgagataaagcatacaaagggcttggcacatagtaggtgctcctaaatggtaactttattcttcacatcaggctttgcttatacttataaaagccagttttgtagataatttgctgaatagaactaagaatagttataaatattgggttagtttatttgagctgctatgataacataccataaactggatggattataagcaaagataatttatttctcacagtctggaggctgggaagtccaagaccacagcagtggcaaattcagtgtccagtgagtacctgctttcctgtttatagacagcacgttttttttctgtagcctcgcatgatgaaagggagcaagagggacctctttcagacgctggtcacctccctaaagccccacctcctgatatcctcacattggagattaggtttcaacatatgaattttagggggacacaaacattcataacatagaaaatacatattattttaaaatgctttcttattctttattatgaccactattaaaaccaaacagaaaactgtagaactagccaaggtatcttacagagatatgtttcagaggagtgtttattagattctgttgtatacactatttgtttagctttttctgttttttaggtcctcggcctatgctattacagaaagaatattactctcttttgtatttactattggtttcctgagggaagcaattattttaattattgattatttatggtttaatggggaaccattgtattctaactcacaggaataaaacaataacaaataggatgcatgcaaaatatctcataaatgtgtacctaacaaataaaacatacatcttcaaatacgaatatgcatttagagcctggcttgctgtctgaggtcttaacttgttctgtgcttcaactccctattataatggatgctacacatggaagctcttgggtcaccattggaggtaatagcgccctatagagttttgtgtctgggaagaagtggactttgtagttaggcgattaaatatttaccagcttgccttaagccaagtacatgttaaaggactattttgtattattattttgtttttaaataggcccctttctctcatatttatcttgccttaattagggagtttattgtttattaaaaagctttaatctgaactactttcattgtgtgggtgtgtgtgtgtgctgtttgaaacaaatgaactaaaaatgtttttaattgagctgcaagtgaagacttgtcaatacataaattatacagtattatatatctctatatatgcataaagaggatattttaatcagcacatgtccctgtatttaaaagttaaaagaaccgctctacagagctaagaatacaggtattttaattttttaaatgattataacgggggaaattccactgttgtttctttagtgtttgatgagggattgtaatctaatcagtttaaacgactataaacacagcgatgatcatttaagttggattttgattcgaaaagtaagttcttggaatttagggtattgcacaatctgtcccatacaggggaaaaaaaaatcacctacttgtgatttttactaatttttttccgtgagaatagaatcctgctgggaagcttattttattctcttagatttgcttcctcctttttttccccctccggagaacgatgactggtttacaaatagcaatttatatcaactgacacagtcctttttccttatactgttgatctcagaactgttctgcagtcctgaagtatgaaacactattgccattttttggtacagccagtgctctaaaaaatgtaaatggatgaaagcgattcaatctattatggaagcagaaacatcttcctatttgctttacaaatttttccgagtaaaatgcagtcaggtttgtaacattgcataaaaacttgttttagaattctttacactaaattaaagatgataaagcaatctgcttttcatactaaacagtgaagtgaaaagcattattttaaagaaatatttctgttttgttagtgtacgaaattctgtaatagtggctaacttctttaggaacctttttaggtgaaacttatgattgactatgaaatctattctaggacaaaataaaatgagaatagaattatatgtctaattaaatgatatatctaggcaaactaaccattcaagttttaatttttatgaaaactttctatgtgcccctgacatctgtacatgtgtttaatttccagtgagctcaaaatacttcaagtgatctcatttgagtattaactagggaaatacattcacagtccagcaattttcttttatgtctacattattttaaatcatagcatagattttccactgtgctttatgaccagaacacatttatttgcaaagtattttcacttaccttatattgtagtatgtagtataggacaattgatacggtcaactgtttaaaacgtcagatgcaatgatagagccttagcatttatagatgtagcattcacagttgcaactctttcagtttcagacatttgtgaggaatctcataggtgtgtaatatggtttgaaatttgtgaggacagcaattcgtgctctgactctagtcattggcggccagtgagcaagcgcaactgatcacccagtatcaacttcacaatgtggtttccactaatcggcaccttatattaatttttatgaaataataaaaaccttatttcatagcaggagcgggtacccaaaaagtagttaaatggctaatcctttacagtttttatgtttttggaaatttgtgatctcaagactatccctcaagaatgtcaaggttttgctgaagttaaagacatttgttattctgtggtcagattatttcagtagttgagatgtagtctcacattaagggagaaatctgcaaactagaaatggtttgcaaatggcaaggcaaagcattcaaataactgttacatgtgataaaaatctcttttgggtttcaggatgacaaggtacagggcccagggactggcatttaaagagaactcctatacacacacttaaattcaacaaaaaagtctgtattctataatatccaattaccttaattgtgtagtggggaaaatgaagagttgaatttctggttagctagactagggtaggaagacaccagctctttgtttgttttgtgctttgacatttcaattttcccgcttggctttgtccttctgtcttcccttgacattgatgattttgttgtaggtacgtcacctccttgaatctactgatatgaagagaaagctataactaaagttaagacaatgttaaagtaaggtccaattctcagttatctacagggctatccaaaagaaaaatggaaatttcatttaaaatagctgcatcttttaagtaggaatattttgggctattatatgccagactcatcactggtgctatttaatttctcctcccatcaatgagagctctccctgagacacattgtgagatctttctgaggatgaaatcacttaaccccagcaacgccactgattattttcagctacaacaaccacacttctatgcacacacatcaatcacgccaaaaaacattctgactaaaaagctcaaaagaaaataattaagcattctcttttccatatgaagatattactgaccagcagaaagtggaaaaatgtatacataatgtttatagatactgacttaacaatgagtgaacagttgcgtctcacaaatttcagcagcgttgtcttgacagtggatcatggtgcttctgtgttgctaggcaacccgaggggatggaaaatttaaactcaaatttacttatgtatgttagattttagacatattatattgagagtgtattacacatgtcattacaggctagttgtacatttctattctgtcttttatgtgagtttctcagtatatacatgaaagacactctgcctgtatccttgctcctctatttttgaaaattaacatagtcctaatatgcatttttatggttgacagtcgtggtatatgagagaaaatatgtagcctttgatgtaaaaagattgtttttaaaaaaacataaactttacaatatatgcttgtgtgtgtcagtcagagggggaggtggagagaggcagtgtttctgaaacaagagatctatgaaagaagggaacagtctgttagttccacctggttcttctcatttaattactataattaatatatgcagaagaaaaattaatagggttcttaaatccagggagatattaaatgtcaaaaatgtggatatttgaattaaagactaatcaacttgaacaatacattataatgttaaagaactggtagcatattaatttcaagtgagagttttaaacttgataactgcagtggttttgtgaatccaattttaagagttaaatgttgtgtcaatgccatgaatcagagaatagatatttataacaaaagatctgtatgaaatgatgcataatagatggtgatggctgaagctgctgaaaattgatggtctaaatcaaaaggatggattaggaatctttgcggaattattacagacctgtagttttgtgagaaaagcagagaatgtcaaggtcttttacttcaaggaggatttgaagtatttgggggtatacattattgcattagcttagtcagtttacagctagctagacagtgcaaacttgtgaaggaggatgttttcagtatatcacactaggatcatggcaccagtcctgaagaaatagggggaacttttgatctccatcataccatatacacacctatgtgtgggaatgctaatgggatagaatctgatacagttagggtctgaaacactacgagttcttatggtactttgattcaatatttagttgagtaattcttgttcacttatttgtattatcctcattagattgaacctgtataggtttatctttgaaactaaagattaaattgaatttaagttctactgtattttttatcaagattatttttaaaatagcttgtatcacaggaatcctgagtacatacctaatactatcctctactgtatagaaatttagtaataatgaaaaagtatactcctggatttggttttctgggcagagaaaattaaaaactttaagcaggtatcatgtagaataacatactcaacagatattattttgtgggtgacaatttttatagacattatatgtcagatgaaatagctaattaacattaattctattatatttaacataacaccctatatacctcggtgaataaagaagatttctaaaggatgagtttaagaggtattgataaggaccagatatttagtaaagaaatcccatgattccctagatttgtgactcttcagtgacacatttaattagttaatgctttgtgaatcccagaattctttgtatatactgtgatataccatatttttgtcatagtaacaacaatttaattctgattctcctatagatgaatctctgcgttctatctttcatgctactttgaattcggtttttaaaactgaatttaaatatcacagtacttatcatatgatattcaacaacctgactgttttccattttattttattttatcaacttttattttagaatcagggagtacatgtgcaggtatatatcacacaagatatattgtgtgatgctgaggtttggagtacaaatgaatctgtcattcaggtagtgggtatagtacctgataggcagttttgttttgagacaaagtctcactctgtaacccaggctggagtgcagtggcacgatctcggctcactgcaacctccacctcctgggttcaagcacttctcctgcttcagcctccatagtagctgggattacaggtgcctgccaccacgcctggataacttttttgtatttttagtagagacagggtttcgccgtgttggccgggctggtcttgaactcctgacctcaggtgatccgcctgccttggccttccaaagtgctgggattacaggcatgaaccaccgcacctggccccagtaggtggtttaaaccctttctccttctctctctcccctctgttgtattgcccagtgtctgttgttcccacttttatgaccttatatttttcttctttaaatcagtaattttttatgttgttaaaatcaatttttgcagagattagaatgtatttggcctaatttctcattcttaagtaaaacaaaataaggacataatttatagacttgacatatactgattttttggtatagatcactaaataagtactgaacttttttctttaggacgtttagagtttttgacaggtatatagtcaagccctgctctcttttacttcctttttattctctctgatgatttgtatatgaattcattctttattgatagtatcaacatgacaaaacatacaaggcctttgtcctaatggatcttataaatctaatgcaggaggcagacagtaactaaacaatataattgtatatgcggtaagtgctatgaaggaattaaacaaggtgacacaacagaaagtagttgtgtcgggcaattttagataaaatggcgagtgaatgctgtgcatggaggtgacatcttgccagagacaggagaatgagaaagagtttggcatgtgaagatcggggaaatgagcacatggggcagagggagggaaatgtgaaaaggcatgatggtggggagtgtttgaggggtgagagaaactatcatcagagtaacaggcaacctacagaatgggagaaaatttttgcaatctatccatctgacaaagggctaatacccagaatctacaaggaacataaacaaattcacaagaaaaagcaaccccatcgaaaagtgggcaaaggatatgaacagacacttctcaaaagaagacatttatgtggccaacaaacatatgaaaaaaagctcaccatcactggtaattagagaaatgcaaatcaaaacgacaatgagataccaactcatgccagttagaatggcgatcattaaaatgtcaggaaacaacagatgctggagaggatgtggagaaataggaatgcttttacactgttagtgtgaatgtaaattagttcagacattctggaagacagtgtggtgattcctcaaggatctagaaccggaaataccatttgacccagccatcccattactgggtatttatccaaaggattataaatcattctactataaagacacatgcacacgtatgtttactgcagcactattcacaatagcaaagacttggaaccaacccaaatgcctatcaatgatagactggataaagaaaatgtggcacatatacaccatggaacactaggcagccgtgaaaaaggatgagttcatgtcctttgcagggacatggatgaagctggaaaccatcattctcagcaaactaacagaggaacagaaaaccaaacactgcatgttctcactcataagtgggtgttgaacagtgagaacatatggacggacacagggaggagaacatcacacactggggcctgttgggggaggggtgggaggcaaggggagggatagcattaggagaaatacctaatgtagatgatgggttgatggctgcagcaaaccaccatggcacatgtattcctatgtaacaaacctgcacattttgcacatgtatcccagaacttaaagtagaaagaaagaaagagaaaagaagaaagaaagaaacaaagagagagagagaaagaaagagaaagaaagaaagaaagaacgaaagaaagaaagagagagagagaaaggaagagagggagggagggaggggatggccaatgtgactagagtgaagtaagagaggggaagaatagtattagtcaaagttgaaattgaagacacaaactggctattcaagactttatgcctgtgatgtggccaggcatggtggctcacacctgtaattccagcactttcggaggctgaggcaggtggatcacttgaggtcaggggttccagaccagcctggcaaacatggtgaaaccctgtctctaccaaaaatgcaaaaattggccaggcatggtggcacatgcctatactcccagctactcgggaggctgaggtaggagaatcacttgaacctggaaggcagaggctgcagtgagccaagattgcaccattgcactccagcctggccaacagagcgagactctgtctcaaaagaaaaaaaaagtttatacctgtaatgagatgagaagttcagattttccagtgtgtgttgtataaatgaaggacccaattttctcagacagaagataaaaggagttgaggttcgtaacgaggtgattttaaggatggatcatagaatcatcaagccaggaaggagagagtgaaatcaaggagaaggtgatggataggagaaaggaccctgagttattataacagagtccaagagtcagagagctgcacagatggggtgggatatgccaggtcaaggaaagggccatgggagtgggtgcctgatgcggagaggaggaaaagaggtcagcgaggaggtaaagagcctgggcacagtcatgttggtagattttacagttacataaggagaggtaggaaggaagatggcgaaccagaaagtaagtcattaataatggctggaaggtggttttatgagggatgtggattttcagagagaaagagaaaactgattaagaagtagcatcaaagaggagcaaagttgatgcacaacctatctctagatcttgaaggtcttatagaatattgtttctaagtcagaagtatgatgacagggggaggagccaagatggccgaataggaacagctccgctctacagctcccagtgtgagcgacgcagaagacggtgatttctgcatttccatctgaggtaccgggttcatctcactagggagtgccagacagtgggcgcaggccagtgtgtgtgcgcaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaagaaacggcgcaccacgagactatatcccacacctggctcggagggtcctacgcccacggaatctcgctgattgctagcacagcagtctgagatcaaactgcaaggcggcaacgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaagacagcagtaacctctgcagacttaagtgtccctgtctgacagctttgaagagagcagtggttctcccagtacgcagctggagatctgagaatgggcagactgcctcctcaagtgggtccctgactcctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacagaacaaagctggatggagaatgattttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatgaaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgttgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcatcatgacaggatcaaattcacacataacaatattaactttaaatataaatggactaaattctgcaattaaaagacacaaactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgacaaaacagactttaaaccaacaaagatcaaaagagacaaagaaggccattacataatggtaaagggatcaattcaacaagaggagctaactatcctaaatatttatgcacccaatacaggagcacccagattcataaagcaagtcctcagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattcctcgacacatacactctcccaagactaaaccaggaagaagttgaatctctgaatcgaccaataacaggctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggatgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaaacattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggagacaaataaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtacaaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgagtataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataataaaaaaaaaaaaaaaaaaaaaaaagaagtatgatgacaaatggtcattttccttaaaataaaatcatatatcactacttactgacttgcacctatatgtacttctgggaaatttagccagcatgtatttccacaatacagggatagtttttgttctgtggactgctaaatgatcacagcctaatgtattgccttctcagtaaacacacgttgacttaaatcagttgggtaaattgtaaactcaattccttactttgactttagtttgcaaattaagaatagtgtacttttcttattttcaggccttatttataattcctaatgctatacactattatgttacagcttgcacttgtattttgacactttctaattattgtcaaattataaatactactaattaatatatccttgattcttcataatattctattaaccagcacttaacacctttttcataaaacacttttcaggatatatatatagttagggcttgttgacactatttcatcttgatttcaatttatgcaatccgaattttcaagtaaaacctcatggaattatcagattcatcactaactttcaaaacttttataacacatctgctgagttttcagacattcattctggaaagaaaaaacatgctggaaagaaaaattttacttactctaatgtgttttattttaaataaaaagtcctataggttatgattttactgtcctctttttttttctgaaaaacattaaggtttctttcccaaagcttattagttaattgtcagtttttatgtaagcccatgaggttagacctatataaggcagtaatttttaattctccctctcttcccacccttccttttcttccctatctcctttattttcttccttcttctttattagtttttaaatatgcatatctctttttataggagaaaggatggataatgattgcagcattctctgaccactctaatatctcaccctagaaattttaataaatgatttactaacattctcatcaggctttttattataaaataatatcaaagaaaacctgctttttaaaaaaatatcttgatacttgtattttaccaaattcatgggtatagataactttttgatttctcattactttcaagtatcttcttcatgtaaaattttaatcaaatttcagatcccatgcttaacacataaaaattaataaattgatgttgagggactatcacattattttatactgaaaagttgttcaattattctaaagttctatatattaatccaaagccgtctctacttgggggaaaaatgtgtgtgtgtgtgtgtatgtgtgtgtataattttttggatctatctatctatgaggatgactgccttattacaagtttcagtacaatttatatatatggattatatctacatatatattttttggttatatatatttttatatatataaacgcttggccattttgtctatttacctatctacctataaacttcagcattttttgtttgggtaattaatattttgaagttttctctcttgttttccttcttgtttggaatgatctgtttgagactgtgtttttaacaaaagtatatgtaagtttgatatacttaaccttatttttcgctaaacaacaacaagaaagaccccctaattttgaaaagtgtccatcaatatcactgtttggcagtttatcataaagattcaatcagtatacagtaaatctataattgaataaataatgttagaagcaaatatcacaggctaggatcagcttaagaaatctccaaaatgtgagcctacataattgagaccaagtgacatttcatttggtgttaacatatactatgtaaaaatggtattatattttcagtgttttaatggaaattttaacatgctttctgatagtttaatatcttttaacttgtgccaatagattgttttagcaagaaatgagtgataatcttaattttattttcttttacccgattcaaacattcttgccttgatcttagaggctggagaataggcagcatgacctctcatctcttccgttctttcctcagccttagtgaagggtgtcccattcacccatttatccacaccatgagccatactgtggatcatccactcagccaccaactcctgcaggtgctgcctctttccaattttacagccactgccttcattcagaatctaaatatttctgcccttgatttctgaactgcctctgcagttagtcttctgctgccctctcctcattcctttcatctgtcattcctgcttaatactctcctagggctctccatcgtgtccagtataaaatcgtactgaaacttgtaatcaggaagacatcccctttgtaatcagatctccatcaccagtccaacttggtctttgacctcttctcactgacattttatgctcctgtcatgctggactctgcagttgctgggcagtgtacccgcatgctttcctgcaggctatcccatctgactctcttctcctaaacctcaccatatttgcatgggtaacatgtcctcaccttttaagaatttcctgaagctctccctgacatcctgattcctgaacaaccacccctttgtgctcacaaaggtctttgtagttacattatttatcatacagtgtttccactgaaagtttaagtgcctgttccccatcgtggctcctgagtagctatgcagagggcgtaggggaagcaatctggtgaaactgggccaaggagacttgtctctaagctacattggcagagcaatgttttacttagattatatctatttaagatggatttagggaggctcagggagattattggagagaggggaaatatgagagaccctaagcacctcttggcagcactgctgtgtttcctctactgtggagtgagctcctggaaaacagggactctgtctgtcatctgtgtgtttcctgagcaccacatagtgtgtgccagatagattgtatgcctgctacatagtaggctcttaataaataagaagtgaattgaggattctagatgctattcatcttcccatattaaattgctttcaaaatgtaaatcctctgtggcactgaagtctatttaaaatatgctcttctgccaaataaaatgtctcctccaggtgatttgaggaagacatgtgggctcaaataagattaaaccaaaccattgtcatgtacatgtaaatattgcatgagtaactagtcttacattttcttcactaatggggatttattctaaggaacttttttgttcagtattttctgatgaaggaatagtcagaaatatcaaaatccttcttactccattttaggctgccatttttttcctaagagctgttatacattgagcatacctaaattgcctttctgaaatacaggaacacactgtattgtcagtaaaatggtctgtgttgattagtttgtctttggggtgtacttgattcatcagatgatggagatcctgctggcgtttcatgcaacctgctatggtatgtgggctttattggcttcccagcagcgacactgacacaaattgtcagattttatgggcagttttaaacctaatgaaatacatccttgagaagcttccttcaccattttagtagctgtacaatttgaaagaaaaaagtcaatgtacaccacacagggtagttcactattgaaatcatggaggacaatgacaacacgcttattttgctcttgaacatgctgtcattaactgcacaatgggatactgatgctgcctcagaggctggtattaatctttgtgccaaaccttgcagaaactctgtgtgcatttactgacgtaagcattgctctccatctctttgatcttaagattactcctttggggatagaaggtaatataaggctgctgaacttaaaaaaaaaatgctcaaagtgagtgaaggtaagagatgttcattttcttccagtactgaaaattaagagtacagacccacatgctattatacaagagaaagtagtcctatgactgctggataatttacatacattatctaatttatcataaccctgggagagtggaaatattgctattcttattttactagtgagagactaagtgatttgctggtttttgatcccgggtctacatgaatacaaagctacatctttaattagttctctatagggtctcaaagcagtcattttactaaatttttgatctttattaaacatagatgcaaaagtaataataatatttccacaaataaagggatgttaaccaaaattaatgttcaagaatcctttcagtgtttctctacctctttaaatattccagaaatggtgatacagtcaggagcaatatattgccaggaactttggcaggacgagagattactttttggatagaatcagttgcaggaattttccaaacgattcacacagcatcaacttaatcttctggaaaacattttagggaccacaaatacatattgtacccaggatgtagtgtacttactgcagtgtggtctatgatttttcttggcatgcataattcaaagacccagatagaaatgactgattttagcacttctaacaataaaacaaaagctcttctacaagagaatatcttcattcatgttaaacatatcaatatctcaagtaagtatgatgaattttgagatagggatcatgccattggggtctcatctggtggtcatggggaaatggtcctctttcttggatatctttggagagtatactatttgactctttagtcaaactgaggatcagtattttaaaagtctataaaatacttaagccatcttgtagaaataaatagtcttcccacccagaccataatctctgaaataattattaggaattttctttttctttcaaacactttggaattataatttagattctttaaaaactgagttttatgactgttttttcaaaaaagcttcaaaattttggcaaatgttgcatttttttttccaattaggataagtaattcaaaaagtcacaacatgcttcagccaaaaatccattgtgaaaatagaaattagaaatgatctttcaaaaaattaagaaatcattttttgaaaaagtgtggagtcattaattaagtgtttgaccttttgtgccttctcaaatgtccattttcaaaaagacagatgcagttagaaggaaaagactatgaatgtaggttcagggccagaggacaaaaactgttgaaattgccttgatatagattcatagattgcaaatgagcactttttaaaatttaaacccttgaatatggtatctcaggcacagagtgagttctttatatatacaaaatgtgattcttaccgcctaccagctgtcttccgatttcaccagatgaccttccctataagtttgacacgtaactcataaaatgcatggctctggagaacaattatcatgacgggagtatgctttcttgattatatggcaggatcctctttcccacctctgcttttgaaggatattaaaggtgagattaaaaatgctccagttgttctgcttgtctgattgtaacagtgaaggagacaaaattgattctagcttatggctcagtgtttcaatgttattctgcagcacttgtttgccagcagctgttagggattattgcaggtttctttgtcaggaacagtgtggcaacaataataaatcagatttagactggctactgaaggggtttgtttaaaagatttaaaaatctcttcagagtcaaagatgttaattctacctggtgaaccagaatgatcctgcatatatcttgggacagacttatattttctaaatctgggtaatgatcatacatgcactgaaaagaagaccatcttctcccagaaatatacaacactgaaagattctctaccaaacatgcatgaaaagatagcaaaggtacaatatttctttaatttgtttctttcctctttcgtttaggtgaaatagaggatacagctctgatcattagaatttcatatggcaaacgctcacacacatagtggatttgaggaaatcaattttcactaatctagaaaattctctcctcaagagaaaagggatttaaaaactttcatgatgtatttaaattcaacatatcttttgcctactttaaatagggaaaaggtgactctaaggtcataacgtgaaattgactttacccttcctggtatagaatggcatttcacattgagaaaaactagggagaagcactgaagaattaatgggcagtggggagagaaatgtagttcattactttattatttgtcgtggtaacacatactttatacaatctatcactcctacttgtccaaatatgtgtttctcctgaggtaaaatttcaaaaattctagatgatgttttggaggttctgtagagaaggtgaatggtatagagctaaagcaaatcttgtatgatttttttatttaatatgtttacttcctatacctatgtctttactgtgtatacatatacacccatatccctatatattcgcgtgttcacttttgatttcaaattttatttgtgaaaaaagcagatttattcttttttttctttgagatggagtctcgctctgtcaccccctggctggagtgcagtggcttgatcttggctcactgcaacctcagcctcccaggttcaagtaattctcctgcctcagcctcccgagtagctgggactagatttattcttaatcccatttatccatgtggagaatatgtcaccctgctcatttcactttgcaaaccgacttactattctttgtacctctctccttctctttttgctctgtcactaatagagctttcagctactaagacacacaggagtcctttctagagagtaactgaaattaaccacatacatcattttggtggcaaacctcacagccaccagtcatttatagtaccaagtccctgctctttgggtaacagtggataagaaatgctacacaagctccttatgtggagaaaagactgttctcctatttggaagccttgtgcccatatccatgccctttgcacatttatcaaataaccgtgacttgtcctttatgttttttcaagcatttgtatcattaggcaaggctctgcctaatggaagagatttactcttactctgtgcccaggtggctcgtccatctctgggtattttcaagcattggaggtggcaatagtgtgcttagcctcaagactgagcaaagaaatgaactttccagagattactcttaaaatatcccattctgagagcacatgtttctcttagtactgtttactccggactttcagggtcagtaggcaagcttttcaacaaatttggtttcttttaaaaactatttttggtagttttgttaaatgtgtctggtaattcattttaagtggaaaagggatggagataaagggtaggtagaattgtaaatgtcctaagcctcttttatcatcctatgtttttgataagttttatctggtaacagacaaacattgtagaagcaagaaggggtttaatgttgttaaataaagaaaatgtattaaaagagaaaaacgaggcactgggctcttctactcttgtttatattcttcacccttgtgttccttctactcaggactccattgtaaatgctcaggattaatttttttgtcatttgatgcagttctatactgtaccttgtctttctgcaaagcaaagataatattgtagtttaaaacttggctatccaccaccatgagggaatatgcttctcttatttttctgcagaaacatttaaaatttcttcagctatattttgtacttacctgaattttaaaaatagaatatagataatacatttccctatttttgtgactcactcactgttattaatagttatttttctaatttgaatattatgctttgttaagttatttagaaccacttaccccatctgtaaataaccccgaactcctatactgtcatcacctttgtttcttctaacatgttgtaatgtaaaatcaaaattattaagttataattatttatgatataagaagtattctgtggataaagtatacatttattttggatatttagaataatttttgtttgtttttggcataattcctttttcttgactatttacaggaaatagctagttataggttttacctaagtctcattcaagctaatggattatgcaaataaagtttgctcactgaaggacaagaatattctgtatcttttttctggttcttcaaggtgatagttcataaagaatatgttccattgacaaagttagttatgttttttagcttattaaactaatttaaggacaaagaagagaaaataattttcaaacccactgtgcttggccctcactaattatgtttttgcctgtgagatacggattttggaggctgtatttgcaataagtgacacatacacaatttataaatgataaaatataaaatatttgtcttaaatagggagatgctgtaatgtctctttcccctcttcaacgtatcatattacagtgattcctcaatgagcagctgaatttccacctgttcttgacgtattacctatcaccatcaggctatgttatgaaactcacttttagagataaagcaaattgtccaaatgtcaccaattattgaatctaaatgtgggcatacaggttttatttgaagcagtctttcagcttttctatatgattacatttttatttaaaaattttgaataggctgggtgtggtggctcacgcctgtaatcccagcactttgggaggctgaggcgggcggatcacgaggtcaggagatcgagaccatcctggctaccacggtgaaaccccgtctctactaaaaatccaaaaaaaattagcccggcgtggtggcgggcgcctgtagtcccagctactcgggaggctgaggcaggagaatggcgggaacccgggaggcggagcctgcagggagccgagatcgcgccactgcagtccggcctgggcgaaagagagagactccatctcaaaaaaaaaaaaattttttttgaataaatagaataatgtgatagcaaatggctagacagctattaaggtggtcaaggaaaacccactaaaagaaaccagcatagtattttgtatgagcatagaaggtgtgggttagagaaatccaatgtctctattttagaaagaaatgtcatcaaggtggacagggaccagaacatgtagcactttgtaagccacgaaaggcattttcattttattcttgtagattttaagtagagatgcagctttcttctcacatattttagaaatatttatttggttaccatatagagccagttctcatatagagaatttattctctatatgagaatagagaataaatttggtgcaagaaataaatatcgggtgcaagatctaaaataggaagacaggttatgaggctgttggatccccattataatggcagcttggatgagataggtttcatgaaaatgggaaaaagcagacatgtgtgggatgttttaggcagctggaatcaatagtacttattaatggcccagaggtctgggtagtaaaggaaagaggagaaactttagataaggcagttagagaaggaaaatcaaggatagattctagatttttgtcttgagcaactgcatggatggtgatgtcattgaatgtgatggaatagatcgggaggggtgcaagatttttcatggagggaaggccagagaagaaacagttctgctatagccatactgaattttaggcaccttttagacatctaaatagaactattgatttaatatttggatatgtaagtctcatctgtatgccatctgttctggctatcttacattcggatcctgtgtattttttacactggcctggaaaagctggcaaaacctagaactgcatttgtcccctctgcgtttataccatttcagttgacaggtctaattttaagttccaccttttcataattgattattcatttgtacacaagtatttgttgagtaccagaaatagcatttagtcatttcaagctttagtttttcatcatcctattctccagatttcagcagcatcagaagccatataaacactgccttcggatggcccttagatggccaccaagatcccctagttacattttctgtgtacaaagcagaagaaagatgtccttcattctgtacacagtgtgctacactgtggtttagtttattattaaagagcataattaaaagaaaaaatatgctatttaggtttggattactaattttaagtttaaatgcctttatatcatatttctttgaagctagacatgtattcaaacctcagctcccccaataattagatatttgaacatggtggaaatagtgaacctatcatctttaaaacaaaggatataaaatctaatagagtggataacatgattataataaagatataaagattataaaatattaaaagttcaatattgtcattagactctaatcaataatgagtatatcacgtattatattttgacatgaagaactatttagccttagagctttgaaatataactaagaaatctattaaaataaattaaatagaatatattccaaagtaactaatgttttcccatattaactcagaataactttgtctgaaattaaactgaatatatatcatttatagatacaagcatagagtttaaattcaggtaatcttatttggatgtacaaaccgtgaatagagacattaaggaaaagtagtcataattaattatatcgaatcttcagagttcacaccattcctcttcctaaaaacacatacaggtttaggctgatcaagatatcaatgtctgctctgagatcatcaaagtaatgcgtccattctaagaagcactagtggcatatatgatcacggtagaagagcaagaaaaggagccctcacttagaaccccataagacaggaaagatacagcatcaacctctcctctccagtttatctgtgttatggattgtaagagtgttttgaaataatattttacttagtaaagtaatatccacaagcatttcaccatgaaaaacattaaacattttaagtatataatatgaaatataccatctctgatgattatttttattgaccatattcttgccaactctaaggtactctaacactagaattttaaacttgttatatttgttactttggtacgaatgtcaaagaaaggtattacctgtaagtattagagcattcctcattgttcctaaacaaagaatttctttttatgtagtctgcactaggaattggaaatgatgcacataaaatacagctttttaatctgtgagattgtttatgcatcttaggtttgcttagttttgcaaatgcgtgcatttaaaatcaccatttgtattttgaactcttctggcttttaactgtagtggaaatttggattgaagacaatggaaaccgtgaggtacaatatataaacttgcatccaaccgagaaaaaccactactcttatctgcacttcaatcagcaggaggttctttttcagtttgtttagaaaaagtagggcctgtcatctgcatggcatacaatctttacaaagaaattttcttttgccctttgtgttttaactactgagtgctgcagaaacttctgtctaactgcaaaacagtttaaggtatcatctatgacaatgttaaaagtaaaacccaatcaaagtttatattatcatgcataatagaccaagcaccattatctgaataccaaacggggccaaataattctctatgattcagatgagacataaaagtgctttaaaaacaagtatgtggtaaaaatcactttggaaaacctttggcattatctaatgaaattaatatgtgcctactctatgatgttgcaattcaacttgtaagcatatactcaagagaaataggtgcacatgtgtacaaagacatattcaagaatgctcataacagcactattaataatatctaaagctggaaataaccaaatgacatcgctattggcatgaataaatatttcatagtatcataatattaggaatactataaagcagtaaaaatgaacaaacaactgttatacccaacagcacgggtgaacccttaaacataatcttaaggaaaagaaattagacataaaagagtatacagtgcctgattccattcatataacattcaaaaatagatgcaattcaactttcatgctagatagaagtcaggatactagttatctttggaaagggtagagatagggaggattcttagtatgggcaatattctcttttgatctatatgatggttacataggtttttatatgtaggttattaaaataatatactgataatatgatcatacattgaggtttttatttattacaataagttgagattattcaaaggtacatttgttcatttttctatacatatatacattatatattacatatacatatatataccaatttttaaaatgttctaagagaaagaaaagctcaataaataaaaacaccccatttccttgtcactagagatgaattactattatgttcaaatcgtatatacagcatattttttatatatgtatctaaaatatgctgaataagcaaatcaacaactacatctagacttctgcatcgcaaaccagaactacatttaaatgcattttatctcacacttaaagaattaaaataaaactcttttctgaacaatcttccaatatattgaccataagtaaatgtaatatgagtcaattattttaaccgttttgtaactcaatgtctgttggatttatcttgatttttataaagttcagcaattcaatttccacattttcttttgtttctatttttgtgaggcactatagtttttatgtaataaatgttactgatatggcctcctacttagaaaatgttattcatgagagtatattgattttagcaaaatttacatatttacatatgtacatccacaggtttgcatatgtaaaaatatagattatttacttactattgaaaaagtgtattatggaagataaaaggttttcatctctgtcagatacgacaggtgaactttggtaacataaggcctagcaaagttttattgatcttacatatatatatatataaaatggtttttcataatttcatgggatgcatcatccaagagaatgatcacagtgatactaattactgccattgactagccacctgccacatgccagacacatggtgacatggctgatgataacatgtgataggtgtttcccaagagagtccctttaaacaaggtttttttcctgtcttcatattgatgaagtgttttttctaacgccattatttcatttattctatgaaagacaaaattggcattttaaaagtagaacacggtcttttgatacctgtcatctgagatacccaaaggattttttttttaagttagcatcaagggtaaataataacaaatgaagttattttatgttagatcttgtaggtctaaatatatgcacagcaatatttaacatcctgaaatcagaaattttgtttctgatggcatctctttccattatgtgatttgaaacattttagggatattttcctgtctactttgcatggaaaaaactacagactttgtcaaatctagttgccttggaagaagaatgaataagaggagatgtgttaaacaatacaaaatatttttgctatttcaagtttgaattgattttgaaataatagtttcaggctaaataataaactgtctttttaggaaacaaaagaagtattttagaaaaagacattaaaaagactttattaaaatagaggacatgatgatcttgtttgttgctttaagcagtttatgtagtaactttaaggtggtagaaagtgtcaggaaatcaatttgaaggcaaatcttcacatatgaaaagaatcagaaatgttaactcaggtcttaaataaaaaggaagaattaatatgatatattaaaagtgatacgaaagtcaaaggaaagattgatgagacttattaatatgaaatgaggtttcttcaataaatatgtaagtacaaaaaagttaaattgtattaagaaacttgagatttaaaaaaaaaaaaaagcgaagtatttaaactacccctcttgagctcccagccacattcctcttagttgtctaataataacacttcttggctatttcactggatatttctaaatgatagggtcctattcatatatctcaacttgtcaatttttaatatcatcaattgacattccttttttagaaatcatgacttagctacttatactccatcttcagtgcttatccttctaatgtaatactatcataattttatttaaatactatatgtcttttatgacgtaaatattgtctaatactaaaacatctactattccatgtttctgtgttttatcttaagaggttaattttatttgtttatttttcctgggtctttagcttttcttgtattcttgtcctatttgccattattatattattttcccactaacatttcaaaatattagttattctaaatagtctgacttttctttagagttcttcactcaaagtcctctatgttctgcctgaattaggattgattattccctatgcccactgtactgtttttctacattggatctaccttgtcagggatccacaccttcctctttcttggtttactttctcattttgctggagcacatcctcaaatggcttcttaagaaatattacatgggcagtgaattttctgagtccttccagtttaactcattgcaatatacaaaatggcaggcccattcaatttatatacttattccttcaagttttggtaatttatctgcattattattaaataatatattaatatattacttaaaatataaattaaaacataaattccttctaatttctccagtctacttttttgaaactcccatgagtcaaatttttaccttgttgtattggtgattgatattatcatttctctcatattttcagtatttttttgtttctcttttgtgggtgatgccttcaacttttttgtccaagagtcatattaaaactttattttaaaagatttgtatttttccctttttaatattattctatttttcttcttgaatctcttcaaaaatattaattagcagtttgcttttaaaaatattatcagttttttaaataagcatttgtcctccagattttttcccctgtttaatgttgattcttcttttccatgagggactatttacgcaacaatctacataatctttattccctactaacatttaactgtgatatcctaaaatggcctgattgaggaactgattgagatgattaagagctctgtagcagggcgcagtggctcacgcctgtaatcctagcacttctgtgaggctgaggcaggcagatcacctgaggtcaggagttcgagaccagcctggccaacatggcgaaaccctggtctctactaaaagtaccaaaatcagccaggtgtggtggcaggcacctgtaatcccagctactcaggaggctgaggcaggagaattgctaaaaacttgggaggcaagagttgcagtgagctgagatcgcaccactgcactccagcctgggcgacaagagcaagactccatctcaaaaagaaaaaaaaagaaaaaaaaaaaaaaaaagaagtctgtgtatagggcaggacgaaaggtgatttggtagaaagctagctgttttgccaggcagcattaaatgtaagaatgtgcagattttttcctctgggatcctgtcatttctccagaatggtaatctccatacttattcctggaggagaggtggttacaagtattctggggccacaactattcttggccttttgtctacccctgaagtttccatcactggaataaactggacagttagacagattaacatgagaaaaggcatacacattcattacacgcacatgtacctggaaggcaacaaagtatgagacttaaagaggggccagatggttgaaatttagatagcatctggagatacggaaggaaggaaataaggacttaaagtctcttagtaggtggtggcaacaagctgtgggagtgtgaggagaggaactgcatggcaagcaaaggttgtcatatcatgaagataaagtctctaaggtagcaatcctcagaagaacacgtgaaaaggtgtcccaggcgtggtgtcccgggagtttcctctcctgagataggatttaatcttctctagttcatgtagattccagggaaggggttcatgacaattacattccttctggaggaacttcccttagataagggggaacttcagagaaagcctctccctgtgcttgaggagaggcagaggggcgagagatgggagtggaaggcaagtcagagagaacttggttctaaggtggcttctttagtccaaagtgctcagctcctcaaagcgccatactttggagtactattttctgagccctaacagccacaaatggaagaagtattcccctgtacagaaaagtttgcattacttttgtcagattatgtctcttaatataatcacattttatgaataagttttatttcacttaacagatttatttattttttaaaaccacaactttaattcccaagtaactcttagaagtttctcctttttggattttcattttgatgtttagtaggcttaaattccagtgtttaacacaacccccagcttttgagtcacagtttatttcattatagtagacccctgattgccaaattacaatatcttatgaaccgggcaaaatgttgacttatttaggacattatgttacctatttattccaaaatatttcatttgaaaatcagctacattcccatgtagacttttctttatacaaaagttaaaataattacagaaaggtaaattattctgatgctaaaattagcctttcattgatttcaagtagattgtaattggctaggatcaaatacatgctttatgtaatacagtttatttcttaaactgatacagaaagtgcacataattctggaagtaaaaatgttcaaaagctaagaagctctcatgttatttttcttcaatttgctacaaacatatatagagtgtagttattttctagccataagaattagcagaagctttggagagaaaaggtaggagactgaatgccctgagcatccctttgaatagctcaggcaagaagaggtgctattatcccaggaggagactgtaagtgacgtttgtgtaattcaagtatgtcctgcctggataaggacttgtgggtaaggaaacagagtagtaaatagccaaagggaagaaagtcagaaaagcttgctgtgttcctccacttaaatatatgttatttctttagggactgcaggttttacaaagagatgaagactaattcggaatgctacttacctctgtttccaaaagaaaaagactcctccagaatgtggttttaagtaggccatggaccaaaagtaggccacaaggcatggcaggcagctttatgaacttcaaggttctaggaaatttcatccattggagagttctccagtgctttaaacaatattagaaagaaaacagcggtacaaatcaaccatgctagtaaaaatctctcctgcaagacattactgagtggtgaagactaagtggttttgccattgttgttgtattgttggttggatggtttgccttggatatttgcttgcttcttttttgttgatttttagcatataaataaaatttataagcccaacaaaagaaaagaaagcaatctttcaagaggctttaagataacatcatacattttcgaggtttttaaggctgagattctattttgttttacttaaaaggaatgttacaatgctgttaacgtttttgcttattctacatttttgcttattcatgaaactcgggagaaattctgtctattggcaggctctcattgtgtattcatcaccacactaaccactcatttactccgaaattaagtgctcagtgatatgcatgttataaattcattctcagttgcaaaattttcttggtgcttaagaaattgtactttaatcgcttttagccaaaaagtttagcaaaaatagtactttgacatagtactgacagcctgtgcttagattttgataaatgtggacaaaatcaatagatagatgcataaggagtgcccagataaaatcatcatacttcaaaagctttttctaacataactcacagctgtagacttttcctttcaataataagcaaaaacaattttcatagctacaaaccgccgacacaactttctatttaaagaggacttctttgcaggaggcagaataataactcaacaaaataaatagaatctctaatttcaaaatactattatccccaaaagtaatgggaattttaaaaattatttagtgtttccagtttagatatttaagaacaccactcacatctacatgccaaataaattgactccaccctccacccgttatatcagggccccactccatccattgtcttttttcttagttatatcttgatatgtcaccctattagttttttccttgcagcatttcacttgcttcttgctttttttaaacaaaaatttatgcactaccctccctgcatccatgttcctgctgcctcatattcattcattcttcagctggtggcaatcagcattcagtttctctccataaaactgttattaaatccaataagcctttcatttctgaatcaagtgaagatttttctctatctttgctgaattctttatggcatttaacatgtcttttcactccatctttctttggggactctcttccatgacttctaagacaacactttttaattctcttccaccattttaggtttgtctttgtaggtaacctttatagattcttctgtgtaatccttacataccaatgttctgaattccattctgctcctctttttccattccatagagtctgattgtgtacttgcaaacacttccatggtatctatttcaagtgtattttgaaaagtctaacatctaggctttcaacttgatctgttgtactttctgtattctatacctgagtgtcagcaaagacgcctgggagctgtctttgagtcttccttctctcttacctccatatttaatggattaccattctcattgattttaccttcttaatttctcttaaattgattttctttctctatacctaatgttagtacctttccgccatgtttctatctggtttacattgctggaacagcacctgatttgctatcttgttcttagtcttgccatcccaacttagtccattcctctgatgtcttttcctttatacagttatcataccatttatcaatttgcattatatatctgattttatttacttataagtcatgttctttgttagctcattaggtaccaattttatatcaatattatttttctgtttgtcattcagtccatttttgttgttgttgttttggtttggttttagagacgaggcaggtgaataggtatagactgaatgctcctaagctagatgataatgaccaaatgattactgagacagggatgagcgatggtcagtgaaattgaaaggatattttagcagctgctttaacaagtatctgggaaaagtccggtctcttccttgcatttctgaacgttaatttgtattaaaagcagcatgactcagaaattttatataaaactcaaataaaccttagaattggatcttatcgagtattgtgttatacagagaatatggagaatatgtgggataaatgagtcaaatggtatgttaaaaaaaaaagtaggaagcatgatagactcaattcttaattcctagaggaaacagagttatgtccaaggaacatattcaacccaatcactgtacagctgtagctttttcttttctttctttttttttttttttttttttgagacagtctcagtccattgcccaggctggtgtgcaatggcatgatctcagctcactgcaacctctgcctcccaggttaaaacaattctcctgcctcagcctcccaagtagctgggattacaggcacctgccaccatgccagctaatttttattttatttttttgtatttttagtagagacgggacttcaccatgttggccagcctggtctcaaacccctgacctcaggtgatcctcccaccttggcctcccaaagtgctgggattacaggcatgagccaccgtgcctggccaatttttctaaataaattaatatgatgatgataatggtatatccaaatagctacccagtttttgattaggcagaagtatgcttatggtcagtcagagtaaaaagtgagaccagcatggtggcatgcacatgtaatcccagctacttgggaggcggagacaggaggaccctttgagcttaggagtctgaggttatagcacactatgattatgcctatgaatagccactgcactccagcctgggcagtgtagcaagaccctatctctgaaaaaagaatcaaaggccttaagaaatattttatttttacctcagaaaatttaaaaattaacttagagctaaatagtttgggtttcattatgtgtagaaatgaatcttgcaacagtaacagtttcccattacacattataagtgtctgttttgagtaaatttgttgaggagtctaatttagtttgaatcactgggaaaagacacaattgaggttttataaaatgtaaaaaatcaaatgaactctgtacttccacttttttacataaagtacatcttccacttctagttacaaaaaattttttttttctcacttgagtcgtttatctgtagtaagtaaatttgggaaaagtgcaagtattcatatacattgttttgcatttaaaagaaaagtgataatgttcaaacccatgctatttacaaaaatcaaaagctcaaatcatgaattctgtttgtgttaaggatttaaaaaaatagtggcgtgagaatggttattgctcttcaataaagatagagataccacgttttgctttaacatatctagaggcaactttttcatcgatagctttattagtaggtcaaggagaaatcatacctaagtagaaaggtccgtggagaaaagagacaaaccatatcagagttaaaattaaattgaaaaaatttaaatcaaggaaaccattttcacttctttcgatatgatgtgcaaaatcatgcattttaaatgggaaatgggaaatttcatagcttcttagcaatgatgtgagctctgtggtctgggtggatgcagggcatgtgggtgcttttgctcatttaaggaaattgcatttgaaacattctcaatacattatgtagccacaagaaaatttatagtgatttctttttggtggaacaaagtatatgctcttttccagctcaggatccttttccagtcttcctacacttaacagccagtacaaacttagtccatagaacgtatttgttgtgcacagacctgcacaaacacacacacatgcaaggtttcacgaatcaggtatgtattttgtgtatgtgtcaaacttagccatcaactggaatttgtgttttagtttggatgctgatttacctcatcagtaaaatgcccttcacttactctccctagacatagactattttccgtaaaatatgttagtgatttcatatttaatgtgatatggaatagaatgagaggttgtgtgaaattaaaatcatgatatcaattatctttctgtcatgcagaataaaataagtgttttgacaagatataaaaaatatttatggtaattaagtacattcatactgtatcagctaaatttgtagaatattgatttctgtattaaattatgtaacattttaattaaaataaatatattgtcgagttgtgagcagcacagtggtaagaatattttgcatgaagatggttacataaatatgcactaaaattgagtctaactgcaaaaaaatgaatgcagtagctacacatttagaaagaagttctaagaataaagcagtttacaaacaaatagtatatatacatgtatatgctttgttagaagaaagagaatttattgtgagtgggatactttaactctttcagatgttaaggattctatttcccaaataacttcattcatgtaagaagtatatttcatgtgagtcaggttttattctctaggtgttttctaatgtgggaaagtgaaatacaagggtttgaaatggttctggggatgcagtctttcctgtcagattccagcagatgctgatataatttaatattcgtggaagacagggcaaatatagaatagcatcaaattgattttgcagagttttcaagccagatgtcccttggcatttacatggaagaagtctactgtgtaccaagttgcatatttttgtgtgtaagttctcagccatggtatgtagtcattggtgttttgacagccatctgctcagacctttatttctctgttcagccataactaaaattgaacatttttcaaatgttccaggtagtttcaattttaagataacagaaaactagtattcaatggttaaaaagaaaaaaagcaatacctatctttggcttagtaataacccctaaattgaaagttaatttcttataaatagcagtgcaaaatgaacaaactttgagaacagaggcctcaccttattatcaaatgagtttgttttaatcatgtggaaggctctcagctagacactgaggaagttatagaaatgggtaattccaaggtgaatgttccaaggatagctatgtcttatacataacaagcacttcatcattatttgctgaatgaatgcgtatgttagaatccatatgtaatagcttgtccatttgcacatattttcaccccactgatagtttttaatatgtggaggtacacatacatatctctgtgttttttgtgggtgagatatgtaggctaacatgtcgtaagtgaatgaaactgtgtttgataagaactgtcaagtgttgactatgcacctattggtgtgctagacattctgaagattcagaagaagtatacaacattatttctaatgttatgattacatctacagacaaagaatcaaacaatgattctttttaatggtaacttgtgttttttaatgttaaagatatgggccaaatgataaagaacaggaaaagatgagtttttttctctatcagaaggatagattttgagctaatcttgaaagaaatactaaatttagacttatggagaataatttaggaaagcaattgaacactacccaggggaggtgggaagtgagatgctgtgttcagagtgagataaggaaataatttgaccagagcatgggattttaattgagaatattaagagataaaattataataaatgtagggaaggtgtatcagagtgagattatgatatactatacttgaaatatctaaatgaagtatttatgtttactctaaaagtcaagtgagagagattctggagtgagacaagaatgtgaggaatggggacttctgtggagtttaatctatagtaatgcacatgaatctgataaattattataatctttgcttttagtagaaatggggatttagagtacatcagtacaggtggcgaaaaatgtgaatttaaaacatattttgaaaaacaaggataagaattagtgtttaaaagctaaaagagaagaatttgtgtcagctgcaaaataaagtaaatacacatacacatacactacatacatgctcataatttaaattatgaactattttatcacactctgctgtgtaagtttttctaactcatattgtatatcagccatgttgtattcttgcattaattaatgtattcattaaatatgtcttcagtacttttttgggtccagcattacattaggcagatatattattcagcaagttttcaatttagttcagggaaagagggatgataaatattattatgagtgtttagaaatattaagaacccgaatccatttatcagtttcataacaatgattttcaagcttgtttcatttctcacagggtagacaaagacaaaatatatatctcataaaagtaataatctaccaggcatgtttgttgtagccaagcaaatatatagaattctaaaaatattgtttatagctcttgtttcaacatgcttgggacaagttaatgtttacagttttgtgagtgaatgaatctatatactgaaaacatttcattcaataagttgaccttcttgaggtttgaataaattttggagcctgagggaatcaatatggtttttaagttgatctcctaggtatgtctaagtttaagttcttaatataattatcaaccctttattattttaatatttcattacattaattatcttttggaatattttcactgatcagtaacttctagtcataagccgttctggtaccaatcatcaaatttcatatttgtaagaaaaaatgactagcctttggctgtcttgacatgcccaaatccaccaagtatatatctcacttccaaaatagtctcaggatatgttttctagatatgatcttagatgatggagtgtattgttaaattaacaagtagtataaaaatagacaaaatattattaaaaatacaaggagaaaggaatatgttagaaacaagtaagaagttccatatggaaaactgataagcaattttttagaagcaaaaatctcatgacgctaaaacaagatgatgaagaaattactctgtgtgcaagtgtggagaaaaatagcttgtgataccatagtgatcttagagctcattatacatcagcaatgaagagctttaactaccatgcaattaaaatactagagagtataaataagattgtaccatgtgtatgtggcagcatataaaaactcagaagtggaaggaattttagtcaagtgttactcttgaaaaagcaaacggattaggaatatttaattggagaacaacatagacaccttctgtaatattattcaagtaagaatgtctcattttggacatcttacttatagtcagattgattctcaaaacactttttaaatgtctagaaatatttacaatggtatttatcctgagaaatgctaaaaaaaattagaaaatgtaaaggtgactgaagttaggaaataacataaaattggtaatgatgagcaattttcttaatggctgttcataactggaaaaaaacagatatgctccgaaatatatgaattgtgagataaactgcagtaaaagaccccaagaaattgagggaaactatggaaatgattgtagcaagtggtagcaagctatttttgtttgcattttgaaagcagtttttagaaatttctaattttgaaaatcttaaattgatttttaggaattctggggctacttttttctcagacctctagggcaaccaattgtagagacttcccccttctgttaattgactcagatctgcttacatattaaaggccacctctggttctcagctggaaaaaagagttcctcccttttgaaacagttgactcagaatcagttccttcctttcagatccttatctttaattactttgtcttctaacctggggtcctaatctttgcctaggaatttaaagtaaagattggccgaatcttatttctcttgacttgtatctacctttactttagctcaccctctgggcgtggcctctagccagtctcactttgagtatctttgaaactctctccttattgtcaaccccttactttgattattttttttaatttaatgtttccaatgtagaaatacatctcaaaaattatgcagaagttctatcatataatgttcttgcatgggtctgaagctctttgaaggcaagggtccttgactatgttgttcattgttgtgtaattactgcctagatgagtacttggaaaggtggagtgattcaatgaatatgtgttgcatatagtttaagaagaactgggactggaattagaaacacatgttccgtctttagcaaatcacccatcattactaatcttccattattttatctatgatattgagcaagtaatgcctatcccatctatattatagctttgttggaagactcaagggataaagtgaaaatgctttgtagagttcagtgctacacatttattatggtcaatgaactgcattacccaaaccaacattaattgtacataacatgtgacaaagaaaggcttatggttttggagtttgtttattttagaagaccagataaactagaacaaatattttccatgaagaagttttttttcgtgttagaactcatgtgattaaattgattcacaaaatttgaggtcatttattaattttatgaatattttactgagcacctatatgatgtcagtgactctaattgtctctgaaaataaaaagattaataaatcatggcttctgccttcaaggaacttagagtttagtggttatagaatgttggtttaaaaaaaatggcaaaaataaaattctgacaaaaactcataatatctgagagtttatatgtgcttgctaaatgaaaagaattattagcaatactatgctgaatgactgtaaaatgctgactttttacttgaaatatttacaagaggaaacagaatatttgtgggtttccctgcatatttatgtgtgtgttcaaacagctgctagagaacaaagtgttttgctataaacactgtcaaatctcactgtgaaaaaaatttgtctataaaacaagtattttcatagatatactaaagctgcatagaatttgcttttatagcataaaacagaattagatgcttgagtcagctatgaaatactttttcatgcaacactcattctaattctttacactatgcattaggctgaggcctggtgtaatttgaaagtgataatgcaatagagaaattccagaagctgggggtggggggaatagactggatattgcaaaatgcatcagttagtcaatcaaactcctaatttatcaaccaaaccaacctaatcccatagagaattcaaagtgactcacgaaaagacacacaaaagaagaaatgttttgtttattttccaagatggaaaatgtaaactatccagaggacagtggtatgggtttagaaagacaattcacacaataaattttaaggaaataatggttttagtctttgatgctaacattatttctgggcttccaagtcactaaaacaatacatacatctttttaaaatgttatttttgttgtgttgtttggttttgtgttttagtctttttattttctgacaaaagaaagtttgccatgtctccagaacaggcacacaatttatgtactaaatcctgatatgaatttcttttcttttcttttctttttttttgaaatggagtcttactctgttgcccaggctggagtacagtggcacgatctctgcaacctctacctcctgggttcaaaatgattctcctgccttatcctcccgagtagctgggattacaggcatacactaccatgcctggccaatttttgtatttttagtagagacagggtttggccatgttggccaggctggtcttgaactcctactcaggtgatcctcctgcctcggcctcccaaagtgctgggattacaggcgtgagccaccaggcccatcctctgatatgaatttcttattggagaatccctttatgtgtccagccctgtggtaggctctgagaatatagtaatgaacaaggtaaacaaaacatacatagtctctcccatcatgaagcttacgttccagcaaggaagctagaccttcaatagataattatcatttaaaattataccttgtaatcagtgctatgcaagaaaaataaggcagaattaggggctgtaatgaaggacctgtttacaaagcattaggaaagccctcatggaggaaataagacaaggaagaaacacttgtgaacaataggaaggtatgtgaagtgaaggagcgttaaggaacagagatttctagacaagccctaagcaaggaaaaagcagagctttattctagaatcggactaaaggcagtattcgttgaatgtgatcagaggacattgtaagccaggataatcattttgaattttaacctaggtacaattatgatctatttttaagaagactgacttgatcagatttgaatcttaagaaaactcattatgtaaaaaaagggctaaagaaaggataagggtagtcagcaggccattcaggaggctattgcagatgtccagatgttacaaatgcttgtgacttggccccaagtattggcaatgaccctggagagaagcagatggatctgatatttatttcggagttagcataatatgaaatgatgcaatggcatcaataacgactcccggttttctctatgagacactgggtgggtaaactaagatgtgttgagcttgagagaattcaggagtagctaaatctgggtgtcccttcgggtggggattagaacgctgaaaaccacgaactctactttggagagtaatattaaatttgtgatgttcctgagacgtctaaaaaaatggagatttaaccaggcatttggatatatagctctatactttcagaaagatacctggtctggagatataacttgggagttattgactctacagatggtgtgtaaatgggttggaagtgggtaagatttggggaagagaagaatgaaataagaaaatgatccaggattaagccctgaggaacgataatagttactgataaaaaaaaaaaaagaaaagaatgaagtaaatgaatgtgacttttctgtttcattttttctaagtcttttaagccagagaaaacataatgtggaacagtgtttttatgtgtgttttatcactagagataagaaattgtcaagctgtccttaaggaccagggagggcccatggggaacagcatctttcctgatgctgttgtattcatcaaagcatagatgagtctcttctgatatttttgtttgaggaacatgaatataagctcatgctcctagcatagcaattagtttagagatttatcattgttttatttttattttttgaattattaactgcagacaaagccctaaattttttttgttttctatatcacaagtacctttttttggtttaaggttctaaatttcattttccgtgacttgaaactgttttgcacttcctctccttgctttatattttgagtttacacactaacctgccaaagagacatctagtttataggcttgattttggaagaaagacagaagagagcagatactgaacatatgttccgctgatattgatgaagtgaggttggaagaagcttggaagcagtctatttctctccaactgccaccccctctatgaatattttgggtacccttatgctggaacattccaaataagtgccccagctatgggttttttttttttctcataatgattctgaaagcctttgggatgatttaggattgttctacaagtggaacataaaccaaaacaaagcagttcgtggactctaattttaaatgggtgatggatgagatttcaatgcaaattgtaaagactgaaaatgatgtgaccagagaagggacccctagatagtaagtactcaataaatgacagaagcagggtatagtatgaacctgtttcttgggaaaatagacttgaagttagacaagaatctatttaatcaaactctagatatgatgttttgctaacttttgttttttgttgctttggttttttggagtttttttgcacttcaagaagtctttttgatctgaggtagtgtagtcaactctaatttattaagcatgaagtgattggttacaggtattttaacaagtatttggaggagtttggggaagttgaagtacgaacacattatttgaagtcactgttacagaggtgcactattttgtccttcctgatgtagccattagtgttcctacaagaaatctggattatcatgacagtttttttttcttttttcctttttctttttttaattttagatttaggggatacatgtgtgggtttgtgacatgggtatattgtgtaatggtgaggtttgggcttctactgaacccatcacccaaatggtgaacattgtattcagtcagtaatttttcagtcctcattcctctcccagcctcttcccttttgtattcctgggtgtctattatttccatctttgtttccatgtgtatccattgtttagctcccacttagaagtgaaaatgtcatattcaattttctgcttctgagttatttcacttaggataatggcctccagctccatccatgttgctgcaaaggacatgatttcattattttttatggctgcacagtattccatggtgttcatataccacaccacattttctttgtccaaccaacacatagattgttgagcacatagattgagtccatgactttgctattgtgaatagtgctgcaacaaacacacaaatgtaggtgtctttttgatatagttagttcttttcctttgggtagatacccagtaatgggattgctatatcaaatagtagttctcttttttgttctttaagaactctccatattgatttccataggggttgaactaatttacattcccaccagcagcgtataagcattcccttttctctgcaacctcaccgatatctaatattttttgactttttaatactagctattctaatttgtatgacttggtatctcattgtggttttaatttgcatctccctgatgattagtgatactgagcattttttcatttgctttttggccacttgtatgtctttttcttttcttttcttttcttttttttttttttagaagtgtctgttaatttcctttgcccacttttaatggagctatttgtttttttcttgttgatttaagtttcttatagtttctggatattagtcatttgtcagatgcacagttagcaaatattttctgtcattctgcagttgtctgtttattttgttaattgtttattttgctgtgcaaacgccgtttagtttaattaagtcccatttgttcatttttttttttttttgcatttgcttttgcaattagtcttagtcattaattctttacctaggccaatgtcgagaataatttttcctaggttttctttttatggtttcaggtcttgcatttaagtctttaattgatcttgagttaatttttgtatatggtgacacatagggtccagtttcattcttccgctagccagttattaaatagggtgtcctttccccattgcttatttttattgactttgtcgaagattagttgtaggaatatggatttatttttgcattctctattttgtctcattgccttatgtgccatttttataccattaccatgctgttttagttactatagcctcatagtctcagagcatagtgtgaagtcaggtgatgtgatgcccccagcgttgatctttttgcttagaattgctttggttatttgggctcctttttgtttccatattaattttagaattgttttttctaattctgtgaaaaatgacattggtaatttgatagggattgcactgaatctgtagattgttttgggtagcatagtcattttaatgatattgattctttctatccatgagcatggaatgtttttccatttgtccatgtcatttatgatttctttcctcagtgttttgaagaaatcataatcaattcctggtagagatcttttacctccttggttaaatgtattcctaggtatttcacttttaatagttattttcttatgtatgtctaaattttaatcacagcaaatttatggtgtaatcctatcttaattagatggatgatgtcctttgttgggaatttaataaaatctaatactgcttagctggaccaagtggataagatgacatttgaatccatagtggaccttgtagcccttcttttatttgggtatctactatatagagaaaacattggtattctataaacatgcctaagatccattggagtatgtatggttagctctgtttattttctttttggttacaataaaaatacttaacattttcactgtaacctgtttggaaggaagagagtaagcaattttaaaaattaattcaacagagaaacatgtactactttttctgattaaaaaaaaaaagaagaagaagaaaagagcccacagcagctcagaagcctccaaaaatactcttttattttagaagctgaaaagggcagatctaactaatggtacaagacaaattgaaagtcctataaacaggaatagaatacttactctctttggttttgtttgcttctgaacaactggattcaaccttctttctttccccccagctcttaggcattgttgtgtcaggacagctatggttcaaattgggctgattttccagttctattaaacccttcatctgcatcgtggatcaaatacattaactagctgtctgcagtgcacagctggaaatcattctcttccacattttgctttgtgccatttttgttttataccaatatgctctgacacacccacatagctcaggatttcagcagtcaattatctccttttcttccttgataggtcttagaacattttaaattggtgtattctcttttgtcttttaaatattgaatcacttgcaaacatctctgcttgcatgaatatttttcaaaatgctccatagacctagaagctgaaatggaaagttagaatcattcaaacacaaattttgattttattcctttgagagatggtaggtgattggcatgaaatagcaggataaatattgtctaccaaaagtaagatgagagagagaggaagacagagagacagagacagaaaggataaggatcagccatgtattattgtaaacagtatatgatatcttagagattattttaaaatgaatatattgaagtgaattgttgcattgactgaatggcttttccatagaaagactccagctatcatcagttatcaattacattattggtggtctttacaaacttgactataaatgttgagacatttttcgagaaatacatacacatgtgtgtgtatgtgtgtgtataagtatctattggtatctccgcatgttagttaaaaatataataatatgccaagtacggacaatgaagacagctactccacaatattcatttaatttaatttttttttttttttttgagacggagtctcgctctgtcgcccaggctggatggagtgcagtggcgcgatctctgctcactgcaagctccgcctcccaggttcacgccattctcccgcctcagcctcccgagtagctgcaactacaggtgcttgccaccacacctggctaattttttgtatttttagtagagacagggtttcaccgtgttagccaggatggtcttgatctcctgacctcgtgatctgcccaccttggcctcccaaagtgtagtttaatatttaagctgataaaacaagaaaatatatttaaaaaatttttgctagactacattagaaagattttctttaaagatgtgagctagatagaggtcattttaaaatgatgatttatcaaattttacacagttaaagatagtgaaaataaagagcacattaaaaaataactagatggaaattttcactgtgaaacagaatttctgaagtgacacggtgttcacttctgatcatggtcattgtacaaccattgagtctttgtataattgctgtgagtagtgtcactaccattttcccttcactttttttctatagatatttaaatgaagcaactgtatacatatttattcattttgtcagttataatcaagttattctatcctaatctttctatcttcactctgtgtgtgagtctgtgtgtacataacatgtgatatttatatccatcttccttcttgatcatgagcaacaggaaccaccaatactattttacttaagctgaaatacatttgaaatataccatataacttgcagagttgatgggaaaatttgaaaaccagggtgagaagatggcagacatcaaggtcatccctaggttttgatacctgtacagaatagtcattgcttactgctgccgccatcactactttctctttcattcctctgatatgactatctctactcctatcattatctgattttccttatctctctagtctgtgcttcacatgcttaatattcaaattcctaggccaaagtcacatgtacatgccctaactgctatagggtagggagaagaaaggtctcctctatttacatttccttggcaggaggtaggacactgcataccctcaatagtagacacaatgccaattactcaagaaaagaaatggaggatgaatgttggacagccaagaaatgatgaaggtctgccacatttttcatataggttggctttttctttgaatgttttcacttagctagtgtaccaaaacagttctacatttccaccaaattaaaggtctgattagtttaatgcccttcatttgccatatttttctcaagaaagattatacagtgcatgaactcattcttattcagtaaatttaaatttgagtggcattatattccaactagtgctatccatgccctcagtaattttatagacttgagagccaccgtaaaaaatactaaagttacagtatgatgagggttctactaaatatcaactaagtaatatacggacaccaagaaagaaacagaaaattctgtgtggcaaagtcagaaaacactttcacagagcagggaatatttgagctatgaaagatgaacatgcaacaaaaagggagaacattctttgttgaagggacaagataatgtcatcacaaagcattttcaaaatgcctgctatatttgtaaataggaagagatcagttcactagatgtataagaaggcatgaaggaggatagcaacagatgagttcagacaggtagaaagcaggcctgattataaatgtttagatcaccaaggagtttgtctacgacactacaggtgacaggcaactcacaaaagtctttaaaaaagaaagtgagttttagggaagataatttcaacaacaatggggaagattaatgggagtagagtcacgcaggaagactaggaagggcagtggtgctcaacctgtttggcaccagggaccagttttgtggaagacaatttttccattgacagggataggggtggatggtttcaggatgaaactgttccacctcagatcatcagccattagattcttataagtagctcacaacctagatccctcgcatgcacagttcacaatatggttcacgttcctgtgagagtctaatgctgttgcttatctgacaggaggcagagctcaggtggtaatgcttgtttgccagccactcacttcctgctgtgcagccctgttcctaacaggccacaggctggtactggtctgcagccctggggttggggaccccgggttaggatgctactgtaataaatgtaaagtaaggttaggatatctgaatataaatgttgatgtgtttgtgtggcggggagcggtgtgtgtagctgaatttgaggtagagacaaaaagtaattaaactggaagcagaaatcttagaatggggaaaagtaaggcatatttgttcacaaagtatcttttaacattttctggtttctgtggagtcacattttattaatgctggttgacatttatctacctagaaaaaaatgacagaaatttcaggaacaaaggtgactatgaattaggtaccaatatttttgtggatgatcttcatgaagtcagccaataatggagatgagtatgtggaaaggatggattatttggactttttgaaaagaagttattgggtgaacatgatggctcatgcctgtaatctcaacagtttgggaggttgaggtgggaggatcacttgaggccaggagtttgagataaacttgggcaacagagcaagatccatctttacaataattaaaaaaaaaatagaaattagctgtatgtgatggcttgcacctgtagttctagctactcaggatgctcaggcaagaggatcacttgagcctaggaggcagaggcttcagtgtgccatgatcatgccactgcactccagcctgggcaacaagagtgagaccctgtcttaaaaaaattaaacaaattaaaaagaaatgaagttattgagtgacagttaaagaaactgatttgcaagtggccttcaggaggcagaagaaggctacttgtctttccccagtgattttatgaatccattgaggagatctgcagaagtgttgtcactgctggagaaaaccaaggcttcacttgcaaaaaggagtactttcttaaaactgagaaatttggaaatatatcataggacttgtaaagctatgatggaagttagcccatgagtgtgtttacagaaggcagagctagatggcataagactcagggatgatgcaggaggtgataaatatttttgtttagagtagtgagaagagtgaaacacagtagatctttaataataaaattttcactcatttggaattatgaaaattgtgtttgaaaaccagctgtgccatttaaattctgggtatatgtttcttcatttgtaaaattcaagtttgaactaggcttctttgaactaaattcttcttgccaccagacaacaaccttcttcttcatcacctagaggaacattgcctgaagcctaaggaagcagccttccctgtgccacacagaagaccccttaattgttcaatgaatttctcattgacttgtgtagtgcttcaaaagaaaacacttacacatcaaacatgattctaagtcaaagttcttcatttatatgagattaaagaactggaaaactgtacaagagaaatagtcacctgctgattgcaggcctgtgggtttcttggaaaaactcagcaattttgcttatccaggactatctttttgcccagttcctctgattctgaaggaagttgaaaagatagttttcctttgctgtatccaacatccttttctacatttgatttaagaaatgtcaatttaactttttattgatactgatattgaaaatacataaaatccaaagaatgagataaatcttacatatgtgtcatatttctatagatttttttgaccaacattttattttgaaaattttcatgcacttggtaaggttgaaagaatcatacagtgaacactatgtactcgaaatctagattctaaaattaggccaagcatagtggctgatgcctgtaatcccagggatttgggaggctgaggtgggagcattgcctgagggcaggattttaagaccagcatgggcaacatagtgagaccatgtctctaccaaaaaaaagtaaggccagcacggtgctgcatgcctgtagttacagctactcaggaagctgaggcaggaggattgcttgagcccaggagttcaaggttacagtgaagtattataatcatgctattgcactccaacctgggcaacagaatgagaccctgtctcaaaaaaaaaaaaaatagttaatgccaggcgtggtgactcatgcctgtaatcctaacactttcagaggctgaggcaggtggatcagttgaggtcaggagttcaaaaccagcctggctgatatggcaaaaccccgtctctactaaaaatacaaaaattagctgggcgtggtggcaggctcctgtaatcccagctactcgggaggctgaggcaggagaatcacttgaacctgagaggcggaggttgcagtgagttgggatcatactactgcactccatcctgggcaacagagcgagactccatgtcaataatagtaataataataatgataaattaatttaacatgtttgagtagggaggagatatgtgctttatcacatatctatccatctgaacatatctacccataaatccattttatcttttaatatactgcaaacctcattcctatacacatgatcatgaatatcattaactggagttaaatactgctaatttttttcaagctcaaatttatctacattgaaatgcataaattatcaccccgtgtaacattcactcactgaatgtaatatttaattaacaaatacatacaccattataatacaaactgctatcaagaatattatcatcatcccagaaattttctttatgcctcttcccagtcagtctctgcccccaagctcccaaaggcaaccatttttcctgttttattttcctaaaagattaggtatgtttaaaaagatcatataaatgaataatagagtatccactctttggtgtaaacttatattatgtggcataatcctttttggagtcatcagcattgttgtgtgtatcagtaatttgttccatttttatgttgaatagtatttcattgtttaaatacaccacagtttttgtatcatttcccccattcatggaaacctaaggtgtttccaggtttggctattatgataaaaacttctatgaacatttttgtttaggtctttttaaggacatgtaatgtcatttatcttggatatgtacctaacaggggaaaatttgaaggacttttatatttattaaaaactacctgttttctaaaagggttgtgctaatttacattcccaacagcaatgcagcagacttttgattgttctacaaactttttaatatttgatgttgtcaatctttttaatataatgccatttaatctaaaacatgagaactttgtcaatatataggtccagttactgtgatctctcacccaccatttctttattatagttgtcatatatattctatttacaaacatatgcaatgatgtgattttttgccttaaatattaatatgcatttaaaagaatttaacagggaaaaagtctattgacatcaaatgtacttatactgtcttttatcatctccaattttctattaatcacatgtagtggatttttttttcattctagatactgtgttacatttttcagtcacagaatttatattcaatattttttgttgttaccatttcttttttgctacaagaattttcgtatgtgtgtatgtccttgagtatagtttaaaagctgcttgaagatgcttgtttgcttattccaacatctggttgatctcagtacaatctccgttgattgctttttctcataagtatgagttactttttattgcttccttgtatgtctagtatttttttttaattgcaacctggatgtcatgaataatagcacattgtagaaactctgggttttgttatgttcctctgaagagcactcacccattcttttttgttgtcgcatcagttggttaacttgactgggctcaaagtcccaacttttttctttcctgtagagtgcagaacctaaaatctctgttcagtttttcagccctagctgggctacttggaatctgactagggcaggtgtaggtctggcatcagtgagcaatttggacagagtttatgcacagattgaggctccctttctgtggacctctctttacacctgctgtggctatttttagttttgttcactagttcttcaagccagtaaaactgtgggtttctatttgagttttagccattctggagctcatccagtgccttttccttctaagtattcatagtcttcctggcttacctgttcttaggtgcactccagatatctggtgtttgctgtgtgtatatatatatatatacacacacatatacatacacacaccaaatatatacacagaatttatagctgttatctctgggagctttgctccaataaaagctacttcacaattattaaaaatagaacctccataagtagattttaaaatgtttctgccatttgaaaccaaaaagtgggattttgagaatgtagatcatcaaaatcatgccaacatgtgtgaacatactacattatttgagaaagcaaatatggtataaacacatccaaataaaaacagtggaagttaggtgatttttttcaaatgtttgccatattgtagcagaatttcagtttttcaaattttcacatgatatacacttagcctttttctagatatcctattaccatatatatatatatacactatagaacagaatatattattctatatataatatgaatattctaatctctaataaaatacatagtataaacagaatattgtttgatttttgttcagacattgttccttataaccagaactccaactaaacttatttagtctagtgctattcagaaaaaaaatgtcaatcatagttgtatggataatgatcactggcttttatgtcattaacattacaggaccttaagttgagttaagaagatgtaagtcaatactctctaaaggttcatcagctatttatagttaatttacactcctaatgtttacataatcttaaccaagtaacacatattgaatatggaaataaatattgccctggtgcttttgaatgggaataagtaggcacagcataatagatttaacatataatgaaaatgggttgcaatctataataagacatgctgaagattcaataaaagctcagatattgattcattcttcaaattggtcattcattagcaactaattggagacctttgctgaccaatatgcttaaccgatttttaaaaataaacagcaaaatagcaatgaaatttcataaagcaactattccctgaccataaaacaaggcaattaaattgtgcaaaggttaattttgagcacataatcagtaactgtaatagaaacaaatcaaagaaaagaattgaaagatcctaaatgtaaattttattagtgtctttagttttatggttagaaaactctatgaagcaacaatggcatggtgagggataagttatttgttttattaaagatttaaataagctttaccaaggaccagattttggttctactttaggccctgacaagaagtcttgtaagctttttaaagagctcacttcaaatcatagttatcaatcttactaattcataactttgtacatatcatttatcttctctgagctgcacttccttcatttttataaagtggaaagaattaataaaatttatacaatgggttatatgggaattaaataatatgaagaatatagaatagcttcagaatcaatgtttcttgtactctgtaatccctttgtagctgtatgcttttgctctctttatttatttaattatgtgggataattggtacataatccaattctatattttctgaacatacaacataaagaaaatactttatccctggtctcttttcttggcttcctcccatgattgctgaggcctgggaaagtacaggcctggcctgctccaatcaggtctttcagggcagaccaaagcagggcacagggagtcttacccatacctgcaaaacaggaatgaggccatggtcagggtcagaactagtcagtgctgagggaggaggcaaaaatccgagagaaaaagtgacaatgccctggtgaagttttagaaatgttagcacctgcctgagatggcttttgtgtaagtaagctggctgtctttgaagggggcagatggagctagactgcttaaactcatcatataagcgagcaagagaagtataattttgctctcctttaaacagaattcccagcatgtctctttgttcttactacttatttttctatactgtaaattaaatttttaaagaactggagaaaagtccactaaaacaaattactaacagtgacaaataagcagtgctttatgttaatatgtaagtgcaccattgtattagtccattctcatgctactaataaagacatacccaagactggataatttatagagaaaaataggtttaatagactcacagttccacatggctggggaggtctcacaatcatggtggaaggcaaagaagtaacaaaggcaggtcttacatggtggcaggcaagagagcatgtgcaggggaactgcactttataaaatcgccagatattatgagacttatttactatcacgagaacagcatgagaaaaacctgccctcatgattcaaatacctcccaacgtgtccctcccacaacacatggggattacaggcgctacaattcaagatgagatttgggtagggacacagccaaaccatatccaccattatgtttattcaatgtgtaacctatatgtatctgtatctatagccacatctatatccagacaattacataatcttatatgttgaaacaattacagattcaagtactctgactcactcatcatttacataagctttcagcagagagaccatacttatatgccattccctctgcctgatatgtttgttttttctttcttcattttccctaacagataaacttctatttctccttgaaaattcagctcaagattacttcccatgataagcccatcttagtaatatttttattctcagatcctttactgtctggcataatatgtgctcaaaacatatttgatgaaggaatagttgtaccgttaaatgcaaaatggtgatgaatgacaaaatagaaagatatacagacaaactttatttaatcgcatatcatttattaacctagaaaataaaatgtctaagatagataatggcgtggagaccatctaattatttttaaatttgtaacctgacaaacgtcacaaaattgttaggaagttttcactaaggcttatatcatggaaaagataaaaaaaaataaggtaaaaacttttaaatggtactctactttttataaaacattacattttctaatgaaataaataatactttatgaatgtttaatatttctctaaccaacaattacattagctttccttatgtcacactgacagaatgtctcattgtgttggggccagagagcacagagatgaggggggaataaatgtatcaggaacaataaatgagatagtgattaagtgaaaaagtaagtaccattggcaaatcaggaaaaattgggaacctcaactttcagctgaagaaaaacacaaggcaggaggccagatgagagttgggggtcactattttggaggaacaggattaagggatttttaaagacatatgtataaggagggagaaaagaaagaaaagattctttgggggcagctctttgggagatcttaagaatgactgagacaagaactgagttgtcacttgatcttttgaattcatttacctgtggaattttttggagtgattacaataaagatttaaactatttataattgcaatttttactgtactattatctttttttaacagaaaagaaaacttaatagtcaatacatactctaataatcaaatattataaaaatcttcctaatttactttcttttttaattttttgtttctttcaatgcaattctaaggccaaccaggtccgcaaggtagcactagatctatgctggtttcataaaacattgtagatgccattcagtagagtgattaagaggatagactctggagccagattgctttggttcaaatcatagctctgctacttgctagctgtaatcaggagcgagttacttaacacctctctgccttcttaataaaatagagataatagtggtatgaagctcatgtggatgttttgtgtagcaaatcattgtaggaacagtgtctgacaatagtgcttggcacattgcaaacattcaacgatgctggctattatgattataattattattattatatgcagatgatacagacaaacatttatgagtccaatatttataatctaattattcgtttattttacaaatacattgagtgcctactctgtccctactatgtgccaagctttgaggataaggcagaaaatacaaattcaagatctagagatcttggtaaaaaaggcagaaaacacaaactcaagatctagggatctcagtaaaatatcaagccatgagatttagtcaggaaggtttcttttttcttttctttctttctttctttctttctttctttctttctttctttctttctttctttccttccttccttccttccttccttccttccttccttccttccttcctttctttctttctctctctctctctctttctttctccttccttctttgcttccttccttcctttctctctctctctctctctctctctttcttgacagagtcttcctctgtctcccaggctggagtgcagtgatgtgatctcagctcactgcaacctccacctcccgggctcaagcaattctcctgcctcaggtttccaagtagctgggattacagatgcccaccaccacgccctgctaatttttgtatttttagtagagacagggtttcaccatgttggccagactggtcttgaactcctgacctcaagtgatccgcccacctcagcctcccaaagtgctgggattacaggcgtgagtcaccacacccggcgaggaatgactttctatcagaagttgaattgatatagacctacttggcacatatatagagctgaaacaacctagatggtcggcatattttctccataaatagagtcaaattatctgtaatttcaaatgtactttctccaagaacagatttttcagttaaagagtggcttttgatgagtgactttgctatactgttattgaaaaagggtctataatatgcaaatgctagacatgtatgaagcacaattgacattaacttacaggaagaaaagagactgaatttggttctcagagggaataaaaaaatctccccagccctacacttagatggacctctgagatcgtatctatgaaagttaaaaacttctattatatctaagacataattactggtgtatgatcatggaccactataatggcttgtttctggcaatatattgctttattatattgctggatggcatggaaagcagtaaaaattggtattccaaagtaaacattatctatcttctctagtctgggataaagaagttttaataattatttacactgaaggataattagagcatgaaatgaccatgaaaaaatatatttgcatagttgtgcagaaacattaacatgcaattatgtcttgatactagatataaaatatctgaaatggaagatggaagatttagtgggatcttttaccaataacttcaacagaagatttgtgttttagaatgtgtcctagagacaggaccttcttcctagctaaatattagagataaaaaattaaaaagaggcttaaagtccatacttaagacccagaaagaaaaatagtattcttttgataacacatagtatttatgtagtatactgaattgtcaggtatttatcattaattatctcatgttgggttactttaatgctccgaaaaatattttatctcaattgcttttaaaatgtatcaaaatcctaactttgtttctggtctacacaccttcatttgtccatctttttcaggtttattccctgctgtcctgaatcttgcttctaatgctcttatcacgaccaatgcaacatgtggagaaaaaggacctgaaatgtactgcaaattggtagaacatgtccctgggcagcctgtgaggaacccgcagtgtcgaatctgcaatcaaaacagcagcaatccaaaccgtatgtattttagtgtgtaggtgtgtggcgctgggtaggatctataattgtgagatgttgaggccaagttgcattaaattcaagggtttgtaatactaagaattcctagaattctttttaccattaagagcttcttcctggcccctctctgtcattcagcaaacattattggagttcctgctatgtgctaagtacagtgattggagatgattcgccagctgaaggcctgtggcagtcattgggtttactaactccagataccaaagtggtttctgagggtgtggttattaactcaggctgtcatcattcattggtaatttatgtgccagatattgtgcctgagatccaggaggaataaggtaggatatcgtctttgagctactgatatatagtgtggtaagtacaaaggaaagaatgagcacagcgttctgcagaagagagaggatggccacaaaggcttggtgtaagtaaaggcttgccagaaggagcgatatccaagctgatgaccaaggacatgagctaaacaagggtatgagataaacaggtaaagaggtgagggaggggaagaggagaagtcatgccaggaagagaaatcagaattagacagaaaatcctagttactcggggagctacaagtaggaatgactagaactgaaagtgccaaagggcagagagtagagatgagactagagcaaaaggctggagccagattatgaaggcatttaacaaccacaggagaagtgatttagggagaggcaccatgtaaagccctctttccagcctctatgaaccacagtgatacctcagactcattgatgtatttattcaacaggcctttgaacacctcctactagcaaagcattgtattggagcataatgttaaattacacataacccctgattcagaggacctagaggggaaatagaggcaaaagaaaagtaaattcagtgctaaaataacatgaatgctccatgtagatgctaaagtcatctaaagatttctggctaagaaatctttatatctatatatctctatctgtatctatctttctgacatgccttcttctcttctcctcgcttacctctctctctctgtatatatataatatatatataaaatatatatagcaggtagatatatacttatatgtaatctacataaaggtaaaaatatatattatttatatttatttatattatttttaatgaacagatatattattttatttttattttgtttttgaggcagaatctcactctgtcacccaggctggagtgcagtggtgcgatctcagctcactgcaaccgccatctcccgggttcaagcaattctcctgcctcagcctcccgagtagctggattacaggcacgtgacaccatgcctggctattttttgtatttcaagtagaaatggggttttaccatgttggccaggctggtctcaaactcctgacctcaagtgatcacccgcttcagcctcccaatagatatattttttgttaatattatttcatatataatatattaaaaggtagatatatattatatgtagagagatatattttacatatctatagatcgatctatagatatctatatctatagatcgatctatagatatctatatctatagatagatatatagaggccagaaagtaaatgaattgatggattattagtttcaggttcattaggcaagatgataaagcctgatggagggaaaccaccattggttcagagactggtggccttgaaaatttcatgaagaatatgagaaagcccaggggcatgaacggagttgtggggaggaggtgcgagtgtgtagatgtgtgtttaggatgggctgtgcagacggggagaattagagagataaaatatgtaaaaccataagtgtgtgtatatgtatgcaggtatatatatatatatgtagagagagagagagaaaggaggtaataacgtgaatacttaatgccaagtgaggtgaactatgatgggggtaaagcttcacaattatattattttaaaatttgcttagtatttcttctcctttttttttttttttttttaggcagagtttcgctctgtcgcccaggctgcagtgcagtggcgcgatctcggctcactgcaagctccgcctcccgggttcacgccattctcttgcctcagcctccccagcagctgggactgcaggcgcacgttgccacgcccggctaattcttttttttttttttttgtatttttagttgagacggggtttcaccgtgttagctagcacggtctcaatctcctgatctcgtgatatgcccgcctcggcctcccaaagtgctgggattacaggcgtgagccaccgcgcccggccttttctctgtctttttaaatagaccttatttttagagcagtttgaggttcacagcaaaattaagaggaaagtacagaaattccccatatttcccccgccccaacacatgcgtggacttctccattaccaaaatccccctccagagtgctacatttgttacagtccatgaacctacattgacaacagcatcacccaaacttcatagactgcattagggtttacttttggtggtgtaccttttatgggtttggacaaacttataatgatatatatctaccattagagtatcacgcaaagtagtttcattgctcttttttttttaaattataaaatgtataaaatgagagctttttctcacaatttacattttttatcccaaaaagaaaattgaaaggcattgtgccttttttcttggagctggttaaagagaggcatgcatagtcccctcattatataatttaggaatgcagaaaacattactatatttcagcaattgacacttgtttgattaaaattagtggtcgtgtgtatcacagaatatcagaaaacatgttaagacaccaaagaaggcaaccaccagaaacctttcctattaatgactctggttaatttctttcttttttgttttgttttgttttgttttattttgagacggagttttgctcttgttgcccaggctggagtgcaatggcacgacctcggctcaccgcaacctccgcctcccgggttcaagagattcttctgcctcagcctcctgagaggcatgcgccaccatgcccggctaattttgtatttttagtagagacgaggtttctccatgttggttaggctggtcccgaactccagacctcagttgatccaactgcctcggcctcccaaagtgctgggattacagacatgagccactgcgcccggccgactctggtgaatttctcggatgtaagttgttatggtatgtgtgtaggagtggggagtatagttgcatacccatgtgtttgctagctcttgtatagaatgtaagaggaaaggacatatgtcagagccctttgcttttatgtaaaagccaagggagttcaggtaaatggagtcaaggcaataaagggaaacagatttcaagggaaaaaaatcaggaaaatgaggcattaggtatgtgatgaaggaaagaatttttaggaagaaaaagtaacagttttaaatgcttcgaagataattgagtaagaaaagcataaaataggtttcccttgcttttgacaacatggccatccattgaacacctttctaaagtactcagcagattcatagtggcaagaggcacactgaagaggtaataaatgaatgatgaagaagaagaggggactatagaaatattctgtcaagtatccttgatgtgaaagagaatgaaggacagaggaggttgtggagttgcaaaggttttcaaagataagagacatttgagttggtttagatgcttggggggaaaggcagggaagttgaagaccaagtggtggtgggcatggtgtctctctagaagtaaaaacatatgggtcattaagcataggcaaaaaccttatattagaagatacatacttttaactcaccaaatcagaaagaagaaagaatgaatagcagcagtcagcagaaagtgttgggagaaatttcttatttgatgatcttgatttcttcattaagatgtaaatctgggttacctgctgaggaaagaagcaaacatttagattatgagcctctcaggggaataggaggggatcactgagccgtaatcagaataaagtggcaattccatatggagtaaaataaagaatcaaacgtgtggactgatactcttggagcattacagggaaagtagaatggaaagagaagatggcaagaaaattgaagaaaaggtcagaaagtaaatgaattgatggattattagtttcaggttcattaggcaagatgacaaagcctgatggagggaaactaccattggttcagggactggtggccttgaaaatttcatagagaatgtgagaaagcccaggggcatgaacggagttgtggggaggaggtgcgagtgtgtagacgtgtatttaggatggactgtgcagacagggagaattagagagataaaatatgtaaaaccataagtgtgtgtatatgtatgcaggtatatacatatacttatgtatttattaaatatttaaattaaacatgaaatatatgatatgtaatataatatacttatataatattaaataaatttatataaataatatacacatataagtataaatattatgtatatataataatatgtacctatgtgtatataatatttacactagaaaggcaagaaataagaaaatgtatccaatcataaaaatgggatggaggaatgatgcaaagattggggtagaaaataatttagttctccactcaattatttttattcttggctggaaaaatggatgagatgcattgtcagattgagtccaaaagctattctgtctttcaccctcttgaaagttctacattcagagtatcttttgtctcgtggaagataaatatattcagccaatactatccatgttttcacattgaaaccaaaaatgaatcaattatttcagtaaagcaaggtgtatataagttatgatttgtatttccccatttttatttacctgtagtgttttctaaaccagtcacagtctggatttactttacattattattatttattattattattattattattattattatttgagatggagtctcactctgtcacccgggctggagtgcagtggcacaatcttggctcactgcaaccttcgcctcccaggttcaagcgattctcaagcctcagcctcctgagtagctgggactacacgcgtgtgccactgcgtctggctaatttttttgtatttttagtagagatggagtttcaccgtgttggccaggctggtcttgaactctcgacttcacatgatctacctgccttggcctcccaaagtgctgggattacaggtgtgagccaccgcgcctggcctgcatgattatttttaaatgaccagattcattccacatttccagattatgctttgatactagaaatttagaaagaataaaaccccacaagaataaaaatctagcaatcaactgcatgaatatattttagtaaaagttggagcaacagatgataaaattccacaaattcagtgaactctgagaataaatatggaaggtccgcagttaattatcctgcaaagaaaacgaaccttgaactttctgttaatagactttgcttcccaattaaaagctagcagtttgaaaggtttacctcatcagcgattccctatccagttttcagatgcagttagcccttggattgacttgcatatttatccctgttgaggatgttatacgtttctatctccttttaaataagggaactttgccaacaattcgtcagtatttgcaaattaattatgattaaactttcataatagggattatggttaattgttgattcatctcccagtcctcctttttgtgactaattctcttatcagtttgacctgaggtggcagataccacaatttcctattagacaacttctctcacaattacctaagagccatgaatttgatttagaaatggggttgtatgtgtgtgtttttctatcacatattaaacgcacaatctgtaaaaaagattcaggaggatgtttgggaaatgttttctgtgatatttatttttcttcagaagaagtgccaacaatatttcatttatggttttgattccccatatgccaatttcagcaccctcttatttcaccagggtcatttatttggtatttagttatgcttctgatatttgctgtcatcataaagacctgacatcttccctagcttcaaaagaacaatttgactaatgctaacatttaaatatattcagaaattttacttttcattaatgagacaggaagcctcatctctatggactgctaacatgatgatttggtggaaaataaagtccagccagctgttaagttgaattaaaaaatttaccaataataatggaatatttttgccctgtcttgtacagtcatattaagatttgcaatatgaatatccatatctggaataggactataataccataaatagcttaaaacatagtcttcatgttttcagtaaatgttatgacagtgtattatatattaattataaattaatatgtaatacaaatcttcacaaatctgaaaatgccaaatttagtgaatattcagctttttaaattttgaaatggagtctcactctgtcacctaggctggagtgcaatggcgtgatcttggctcactgcaacctctacctcctgggttcaagtgattctcctgcctcagcctcccaagtagctgggaatacaggcacccgccaccatgcctgtgctatttttttttttttttcatagagatggggtttcactgtgttggccaggctggtcttgaactcctgacctcaggtgatctgcccacctcagcctcccaaagtgctgggattacaggtgtgagccactgcacctggccaatattcagcttttaataaaatttttcttttaaagatgattttactttctatcagattcctattgcattgaggacttagttttgctttatttttattgttttttcaaatgttttaccaagtacaacttgtctctaagattcaaaacagtgtacattttgaatagatgtatcatttattttatgtatatgcataataatggttagaatgctcacagttatactgttcatcagtaaccctgtgaatacagggttcacatccaagatgttctcactggtccgtggcaaagtaagaaaatgagaacaactttccacatttttcataaaaatagaaaggatacaatttaaataattgtcctccattttgatattatgggttttaaaaactaatgatggtttttaaatgccctttgtttcatgaaataataatgatgctttattaaatgatagaaatatattggaggttattattacttggaaaaactaagagctagaactcctatatcaatttcacaaatcgatcacacatttatttttaatttcatattttttctctgaaaattatgaatctggaaaccactgctgtgagcggaattttgttattcctagatcagagatgacacataatgttgaatgatttgtctgtggtcagttacgtactaagtggtggagccaggaggaatatcagctacccgtgtgccagcacctcatggtccccctctcatcaccattattattagaatacatggctagattgcaatattaggtaggcaaattgagagtccatgtttgttcctcatagcaatgtgatttgttccttatgtgaggtattccttcaaatttaaaaaggattgtgttctaatctaaaaggtcattcataagccactcattcgaaacatcttcccagatacttagttttatgaaattctcaagactgacaccccaaagcatccttaatctataataaacacaggagtacagggaagctcacctccactttgtttacatttctatgggcaaatgtgccgactttctagtgagatgtgaggaatttaagtgcccttactgcagccttgggaatagaaacaggatcatcaacagcctccactcctgccatcctcacccatgcatgagcaaggcctgtttagagagggagaaagaaaaagaccttatattacttggaaaatgagaagcaaagattttagacaagaaccaatgactgggaaccaaaatgcaatgagggcttggcagcccaggagtagtggctgctgttgtgagacacatggagctaaaatgggagagatgagaaactgtgagctttgaggattgtaagaaggaagggagctgcaacaaaggtcacaggtctgtggggttgccacgcctcctattttctatctctaatctcccttttgattttcacaattggtcctgttcttatatgtctgggtgaaagtaagggaagatctgtggtttttggtaggatagagtttcatgtgccatcatctccttccttgccattattgtaaagattcctccactagagttagtgatgatggcaacagacaaatgccggatgagaggtttgggttatctctcatattattaaatagtgatagaaaattggcaagttaaagactggccgcaaaaagcttctgtaagggccaagggaaaacttctcttttgccctctgaaggtttgctgaaaaatcaactgaaaaaagttagcttggtaggtgaaaggcatacaaaatgtattttaacatgcatagcatggaagaatcacaggaggatgattacccaataacccaataggagcatagatgtagatatacccttcttcacgggggagggaagatggggaaaatatggcaatttggaaaatagtaaatgattttttaggggaattcaagaacctacaatggcctgggacaaagtctgttgggcccacagagcagatagtggtttgtaacaaaagtctgttcaggtgtgccgacagacttcagtctctcttcatgtgaaatgagttaaattaatgaaaacttaagcaagagggccagaggaaacttttcctcctggtgggatcagactgtaagtagatacgggagtatcagagtaaaacttatttcagcatttgctggtctccaagagcctttaatttaaaataatcagcataccagcatgctatattttcgggtattggtttctgagcctcaatatctcatagaatgaatttaacagcattttatgttaaaaccagatatatattggactccctacgtcttaataataatgaatgtgtcagaagggcaagtgttcaagtgtatttcaaccacaagtcaggattttatgtttctgttaacaaggttgatggcatactagagctgtctcaatagttagttgttgcttttttgaatgattgacaagtcaattagattttaacattatatctttacacttaatttctgtagttacctttaaaattgcccattttggttaatggccagagtgctgaccagctcattcccctgcagcctaagcatttaaacatttcctgctaccttgtatggtgctatgagacagctgtcattgaagaaattctgttgagaatctgaattactctccttctgtattattttaatgtttgatattcacatgatggttgttttaaccatttttttttactttaaagaaaaagctataaactagttatatgatcttttcttcttcctttcatatgatgctgctaactcaatagagagacacccgattacaaatgctattgatggaaagaacacttggtggcagagtcccagtattaagaatggaatcgaataccattatgtgacaattaccctggatttacagcaggtatagttcctctttttttgtcatttccacttttgaaattgcattttacatttgctatttgtttagttagtggtttgtgggtgaaaggatactctttcttatcactctccattgttttcttgataagatgaacaaagggtcctattcatatagcgtattgttatttacgagtattcagcatttaattataaagcacaattcaaatggaagcacgtgaagagcttagaaatgaattaggtgctaactctgttttagctagctggacttaatgatgaaaatatggatcaataaaattttacataacaaaaatataatagtatcatttttaacttttaaaataatacattgctcccactgtgctgatggtgtgtgcacttaaaggttcttggataacaaggctcttgagcaaattgcctctcattactgagagctgagaaagttttgacagttgctttcaagttaaacttgggtgactaaatgaagtaacaagctttgtagttatacaaaattgatgccggaagttgttcaagtttgtcttgcataggcctgggtgccttctatgcttaatctctttcttccttctcttcacaatattcaggtcaggctgaagttattaatcaggaatcgccagcacctcaaattatttaggcttgcaattaggatggaaagtggacaaatgccacattccatcctatttgtatgcctaaataatgtgcaggggtgatggtcaggatagttaatgacagacaccatacactgtaaaggtcatggtttttataagttatcactgtgtggggaagcccccagccagtgggccagatcagcacaagacattttcctaatggatgccatttgccaccagcatgagtacaatctccctcctccagtgtctaggttcattttggtgagggctgcatatattcaagagccacagaaagctggctggagcaaacaagctggtggattgcacggtagacctgccttccacccatatgggcctcctcgggatatgaggaactggtggcggcaggggctcagtgctgcagcttatatcaccaaatggcatggacttatttctaccctcactaatatacagcagctgaatgtcagtcctgagttaataatatttctcaggaagtctcagagcactatcagagaatggcagggcaagctaccacactgatcaatcatgctttaggaaaattaatcctgtgcatgaatcccctggggatcttagcctcaaaatggactgcataccactcctgataaagacaactttgtcctttattggtcacaagagttctcccccttcatgtgatcattgaaagtctagtctcccaatcaagagtgagtctgctgtgcattgactcaggtcatctccagggacaggcaatcaataaataatgatgctttattgttctggtttattctccatttattcttttagattgcacatagaacaatggggtcaattattaatataatttgcacaaatcacttatagtactctttgagctgaacagcaatattatttacctgttatcaaacatggcagcatttttcccctcctaatttacaactggatggcgcaaccacaagtttttactaaatcatttctaacttgcctgtttttatcaattcagcaagtcaaagagtttacctgaaagcctatttttcagtgatgtcattgatattttcctaaatttactttgcatactcactcatccattcccacacagtatcttaagaattatgtggatttgtcgttctgttttctcttcctcccatttagtttaatggaggtaagatgagtgaatatgccaagacatattttatgcttcattcatcataacaaagtgccagaattctgtatataacccaggtctacctgactccaaagtctgaaattcaccaagtggaattggtacagagcatatgtgttcaaattgtcccatattccaggatggtgtccatccatatccttatttattccagctttctatttcctgaaaatcaacctactgtgtgtgtagaagaaggggaattcaagtaatctctaaaaatgtaataaatccttatttctacttgactcaagattttaatttagtcagttatttagtgatgtgaaaagttaaacaggttttgtaatcaagtttcgtgatggaacttctcagacaagaaagagcttcagacttccaatttggcctcaggctttggaataacaaactgtgagacatgtttataatacttattcagctatggatggtatattgtactgcactggcaacagagaaaatgtggacattcttattatgtaactcctcacaataatcctgaataaaccagctaatattaatattcctattgcatagttgaagaacactgtgctttagaaaagttcagtgacttggccttctttctaaagcttattatgggcagggctggggcaacatgaatagtctgaatccagacccaaatacactatcttttctaatgggtatctgaagacataatcctagggagctcaggataatttttattatatattttcaagggctccaaatgtagttcaggttcaagaaatattgcactatcttctcctggcttctatgggataatatagccaacaacctgtttcgttataaagcaggggactagaaccctcattttctagtatactctagtgtgcctctaaaatggcaaagcttctgtcttttctacctaccgcatgaaggattaataggttattcaaaataagatgagctattatccaactgggattaaaaggcagtaaaattataatgaataggtaaatatcactaaatgtttgtttgtcatttattcagcaagagacttgaccatttattagttcttcttttgtataaatttcaacaagtgccagtattgttgttgataaatgcttggctcctctgtgacacattttcataaattagtatcttaaacataacagaaacgattgcatttatttgattaaatcactatagattacagtgggtttttttttttttttttttacattttaacattcaagataagcactagaaaaaatagcaatttgtttggaagaaagtagctacttattttataagtagattgttcttagatacgtattactaagggattattaacttttctcattctatttactcatagcatattttgagcaagtgatttaatcatgctgtgcctcaacttctagattagcagactaaatattacaatatcttggcaagaaaattaaagtaatgataatggcaatatagcaactaaattccatctcacaattacagctattaaaaggatctagagtcagcatgaacttaaagaaaagcttaactgttccagtgacgtgtatataaaaactcaatataattgcgaacaaaaatatacaacaatttaaaggagacagtaatagggactcaaacgttaataagatgtctaaaacattctattttagtctttttcctaccagatttcaccagaatatgtcattatgtctgattttatttatttcttttaaaatctagccattatctccgtcatgccctttgatttgtttcagaagaaagctgattggcaggcggggtaaaacagagggaggcagcttttcagtagacttttcaaacacatattgaggtgatactcactcctggctaatccaggaatgccattaattagttaagctcatgtcttaactaggagtcttctcctcaataagcaattcacttctcttcctggtctatccctcaaaactaagaatgcgtttaccaaacaagattatcttacagctacagagatcacactccacatattcttaacctaaatattttattcactgatcttgcagagaaaaatttgtttggacaagttaacagttttaactggaatttatgttttaggaggaggataaactactatttctatgcaaatattactatacttttagaatccatgtgaatagtataaaatgatttttctctaaagcctagaatcattaatgtaatggttaaacatttctgcaataataaaacataaaatacgtggaaatactttatatattcaagttttaacaatcatttaaacatattaaaggtgatccaattttcagtcttgaaggaaggtcattattctttcatgtcaattctttcctcatgctcttcttactgattcctgattactgattaaaggatgtgttgtacaaggagggaattttggaaaattcacaaatacatggaaattaaacaacatactcccaaacaaccaatggataaagaaaaaattaaaagagaaatttaaaaataacttgagacaaatgagaatggacacactaacactgataagaagaagcaaaagcagttctaagaagaaaggctatagtaataaatacctacgtcaaaaagaagaaagatctaaaattaacaacctaaggttacatttcaagaaagcaaaaaaaaaaaaaaatgaagaaaagataaaagaaagaacaaactaggcctagaagtagcagaaagaaggaaataataaaggtctgggtagaaataaatgaaatagagactagggaaacaatggaagagattagcaaaactgtcacttgggttttggaaaatataagctaaattgacaaaagtttagctaaactttctaagaaaaaagatcagaattgaaagaggagacattactactgatacttcagaaatacaaaggatcataagtgactactctcaacaattatatgccaacaaactggataacctagaaaaaatggaaaaattcctagacctactaacactgaatcatgaagaaatagataacatgagcagatcaatgaagagtaaggagattgaatcaggaataagaaataccctatcaaagaaaagcccagaacctgatggttttactgctgaattctaccaaacatttaaggaactaataccaatccttctcaaaatcctccaaataactgaagatgagggagtacttccaaacttattttatgaggccagccattagcctgataccaaagccaaagacactgcaagaaaagtacattacagatcaatatttttgatgaacatagatgcaaaactcctcaagaaaatactaacaaaccaaattcagcagcacattaaaaggatcattcactgtgatcaagtgggatcactaccagggatgccatggtttaacctttgcaaatctataaatgtgataccttacattagtagaatgaaggacaaaaatcatatgatcatctcaatagatgcagaaaaagcatttgacaaaattcaacattgtttaatgataaaagctgtcaacaaattagctatagaaggaatgtacgtcaacataataaagactgtatatgacacatcctcagctaacatcatactcaatagtgaaaagctgaaaggtttttctctaagatcaggaataagacaaggatacccacttgcaccacttctatttggcataatactggaagacctagccagagaaatcaggcaaaaaaagaaataaaattgtcatcaaaattgaaaaagaaaaaggtaaagtgtctctttttgcagatgacataatcttacatatagaaaaccctgactccaccaaaataactgttagaactaataaacaaattctgtaaattagcaggatacaaaatcaatatactaaaattagcaacatttccataaactaacgaggaactatctttaaaaaaatcaataaaataatcccattcaccatagctaaaagaaaaataaaaaatttggtaataaatttaaccaagaggattgctatgatttggctctgtgtccccacccaaatttcatcttgaattgtactccaataattcccatgtgttgtgggagggacctggtgggagatggctgaatcatgggagtgttttcccccatgctgttgtcgtggtagtgaaaagtctcatgagatctggtagttttatcaggggtttccgcttttgcattttcctcattctctccttgcctgctgccatccatgtaagacaggactcctccttaccttccaccatgattgtgaggcttccccagccacatggaactataagtccaattaaacctctttcttttgtaaattgcccagtctcaggtttttttttttttttttttttttttgagacgcagtctcgctctgtcgcccaggctggagtgcagtggcgggatctcggctcactgcaagctccgcctcccgggttcatgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctcaggtatgtctttatcagcagtgtaaaaacagactaatacagagatgaaagactggtacactgaaaactgtaaaacagtgatgaaataaattgaagacacaaataaatgggaaaacatcctgtgttttgtggaataactaatattattaaaatgtccatactactcaatgtgatccacagattcagtgcaattcttgtcaaaattccaatgacgtttttcacagaaataaaaataaatcctaaatattttatggaaccacaaaaggtgctaaagcaatcttgagcaaaaagaacaaagctggaagcatcacactatctgactttaaaatatactacaaagctgtagtaatcaaaacagtatgctgctaacttaaaaacagatacatagaccaacagaatagaataggagcccagaaataaatctaagcatttatggtcaattgatttttgacaaagatgccaagaacacacaatgggattgaactgtctgtccagtgaagggtgtttggagcagtagatgtccacatgcagaagaatgagtatagacccttatctcatgccatataaaaaatccattcaaattctaaatgaattaaagactgaaactgtaaaactactgaaagaaaacacaggggaaaagttccatgacattggtctgggcaatgattttttaaagatataaaccccaaagcacaggaaacacaataaaacatagacaaatgagattacattaaactgaaacacatctggataaccagggaaacaatcaacatggctgctcttcaaatcactgaatttattttgttggtactatttgggtcactgctaaattggtgaataccaaactaacacagaagagattataatatacatgttccaaatgtagattataccttacctgagtataccttaagtacaacagaatatagttaaaatcacagttctttacctgttttaattgtatatagatttttaagatcatttgttcagtatcacaagtagaatctgtggttaattagaaaatatattttccctttaaatgaatttgtgctgacttttaaaattattaataaaggtgacagctagctttggtgtctatattgaagaaaatgttcatcctaattggtttccgtttgtctaccctttggtctgctttcaacacagcagtcacagcaatctcattagtacagatcacataacactttccactaaaagtggaaatcttattagtacagatcacacaacactttccactaaaagtctctactggttttccatcacattcagtgggaaaagcacaatgacccacaaggccttaaggaccttttcctcacctcttttcatctctggcctcatctgatctctcttcctcagttgcccagctggtcatcccgctatgtcttgaacactcacacctgcctcagggcctttgcacttgatatttcttatgtctagaattattttcttcaatttcaatgtagcttgtttcctcacctccttttggtttttattcaagtgttaccttctcaacaagggcctccttgacaactctatttaaaattgcagctcccagcctgtccacttcctaaaccactttcctgctttatttttctccataaaatatatcaccatctaacttactatgtacatgttactgttcagttgaatatttatctttctaaatgcaatttttttgtgcgtggagctatttgttgttgtaatcattgctttctaagcacttagaatagtgcacaacatataggaagcattcaatgtgtttgtattaagttaataaatgactgaatgaataactagtacaaaccaccaatccataatttaagaatcttattgaatctgagaattaaaggattaagtgatttcactgtgcttcttatgataaaacacactgcactttttctaattatgaaatttcctttaaggttgaatggcattgttttagtctatttgggctattataacaaagtaccagatgaggtggcttataaactgcagcaatttatttctcatagttctggaggcttgacgtccaagatcaaagcactggcagattcaatgtctggtgagggtctgcttcctggttcatagatggccttcttcttgctgtagcctcacatggcagaaggggcaaataagctttctggggtttcatttataagggtactaattccattcttgggggctctgtcctcatgacctaattacctccccaatccccatcacctaataccatcacattaggggttaggatttcaacatatgaattttaggggaacagaaacattcagtctatagaaagcgtgaagtaaattttcttccagttcctatgcatgttcttactctgcttttaagcgtattctaaatttcagttgtatctgtcactatgtgactttaccacacttacagctttatttaggaaaagagatgttaattattttaactcttcttttgtaacagagaagtctgggactgtcattttttgttttttgcttgacattgtattttttcctcatagaacaaaagttagtataaaagaaagggaaaaaaggccatacaatgatgctgtttaaacaagagtgtaaatgtaggatatgtattttgatctaaaatgttgataaaccaaattctagcaataccatgaaaatgtaaacattttggagacccagatcctatttcaaatagagtcaagatgactgccctagaaaatgcttcttgaagtcatggaataaattagatgattgtttatttaaaaaaaaagaacaataatacataggagatctgttaaaaaatctgtgaggaaagagctgttaaaatgttgaaaccacatgaattctgttatggaaagtctgaacaagactttctaaaatagattgaatgtgggcagttttcacagctgcctgatgacttccacacacaaaacatccacatttcatccttttggtggaatactgtgtattttccaattttattcttagagtttaattttttacttacatattatgcttatgtatatcatatttgttatatatattatatataactaatatacaattatattatttatttaaaaataaggaattaaaaacaattatattatttgtttttaaataaggaattacaaaataatgaagagaccgtatttattatagatcttgaaactgtgactaaaaaccccatgcacagagaaaattcttgagtcaaatggcttcattgatgaatagaagttagaatactggttattgttacaaggagagggaagataatgactgggagagggtatgaggaaagtttcatttcttatttttgattatataattgtacaataataatgtgttagtacatagaactaatataattgtaaataagtgtgtttatatataataaaatatacaaaatatagataatatattgtataatgtataattatatacaatataataaaaatgtgataaataatattgtataatatataattatatacaattatattaattatatgtactaatgtattagctatatgtatttatatgtacctatatataagactttttctagaaattgactacatatttgaattgtgagacagcatgtatgttttgattcatagataagatatgtttccaatattacccatatctctaaaatacaaacatggcaaaaaaaggctggagtgagactaaggagaaaggaggagctataagtgtgcccagattccatttctttacctatgacttatgcgttggtacatttaccttaggtaacttgtcccacttttatgctcttcaatttggtctagtgtaaaatggagcaaataggcccacttccttattacgaggcatattataaggataaagtgatgtgttataggcaaagagcatagcacactgctgcactttaggtgatactcagaaaatattacttttggtcttccacattgaaaataatggtgaatggagaataaatgggctaagttgtaatgtgaaaaatggaaaataacaaaacaaaagctcaaaaatgctttaattactggatattgaaatgatacctatgaggttcactttgtatatcacctaagaatattattttactcaatatatttttagcactttatggacattaatatttctatggagaaagcttaaaaagtgtcacttgtgcattgaaactcttttgtaacagcttctttactcttctgttgttgtcatgatatcctccagattacttaaatttttaaccaagaagtaaccttacttattactagtatgctctttccttaaaagcttttctgatttatgttattttaattatatcaatcttgttattatgtacagtttttaattattttaataatttcaacctttctgcaactttccattttagatatgtctcattaatggcatatagtgaagttttgacgttttgtctagtttggcagtgttggtcttttaatgaaacatgcattttcagtggatctgtgtgtatctaagtgaagcatgtacacagaaaaggtgacaaataaaagtctgagagaatttttgctaaatgaaccttcccaagtaactactactgagacaaaaataaccagcaacccagaaacttccctcatgccttttccaatcactatcttgccttctcccctaatagtaaccagtattctaacttgtattcaccagtgaagccatttgatctaggagttttctctgtgcatgggttttagtcacagattccatatctataataaatgtgggactcactggagttttcatttcttatattttcagtttagttgagttgggcttttcaagaaattgatccacttacctaatttttcaaatatatcgacatgagttgttagtgatattatcatcttttaatttacaatgatctgtagtgatgccctttttttattccagatattgttgtgtaacctttgtttttcctttacagctttaataggtcttcataatttcattagtctttttcaaatagccagttttgggcttgattgattttctctatcgtgaaattgttatattgtattgaatcctgctcttatatgtcttgttttttacttctcgttattttttattttagtttactacattttcttagcttcttgaaatggatacctatgttattaatatttcagttcttttttcctaatatatttattaacgcctacaatttgcctctacatagggctttagttgcctcctacaagtttgatatattgtatttttcattatcatttattttaaaatatattctaattttcatagtaaatttttctgtggcctctgagttatatagaagtgaagtgcttaatttctgaacaattgagtatttttctaatcgttttgtttttgttgttattcctttcctcactaattccactatggtcagtgtattttcaattctttgagactaaactttttgagacttgtttttatccaacatatggcagtgacttgaaaacaatgtggaccagttgccctggctcactcctgtaatcccagcactttgggaggccaaggcaggcggatggcttgagcccagaagttcaagaccagtgtgggcaacgtggtgaaacctcatctctaccaaacaaaacaaaacaaaacaaaacaaaaccccaaaacaaattagctgggtgtgtgcctgtagtcccagctattctggagtctgaggtgggagaatcacttcaacccaggaggtagaggttgtggtgagccgagattacgccactgcactccagcctgggtgacagagctggacatcagaccctgtctaaaaaaaagcaaagaaaagaatgcagattctatagttgttggttgcagtactacaaatatatcagtgagttatatttatatatattgatacttttaaattagagacatacaaatttaggattattaaatttaataatttaaattttgtattaactcttttgtattaaccacctttttaatactactgccagcagtacttctatctttagagtgtacttttgtatgtagattcactagcttccttttttctctgtgtttgcgtgatataggttttctcatatgttgagtgtacttatatttaaggtgtatcttctgtgagcagcataaatttgaattgtttatttaactaatctgataatcttttcctttaaattggatacttaattcatttacatttagtgttactatactgatatatgggttcaaattaccatattctcatctgttttctgtttgtcttatcttttgctaatttttcttcctcataactttcttacttttggaatactgaaggtttttccctatttaattattccatttcttctttcattagcttgtcttctgtgaagtcttttattactcatactaattaccataaatatggtaacttgcgtccttcatttatcagaactttgtaatattttacctcagtcccacctccccatcagatttaattctatagttctcatatgtttaattctatgtatatattaaactccataggaagtaattgttaccatcataaacatgcagttttcatctaattttaaacacctttaacttttttgtttattttttgttagtatactttgtttatttatttatttctgttagtaaacttccatcaagaaagtatcccatttcttttctgccttttttaaatgaaagcctgctagtgataaatctctcatcttttgtttgttttttcacttttctttacttttgagacttattttccaccaagtataaagtagaatttcttgcctggttggaattttgttttgttttgtttttttccagcactctaaatatatcctatcattattacttgtttttcattatttctatcatgaagtaagcggaaagtcttattgctggttcttggaaacaagatcatttttcctttcactccattgaaggctattttttttaattttgcttttggtgttcaggggtttaccacaatgtacttaggaatgattttattggtattaatactatttgggattcaaaagcttctagattctgtggatcaatgtctttcaccaatttggtaaaattcttagccgatattttctcgaatgttgttactgtccattctttctctccactctccctgagacttcagtcacatccctgctagaccgtttgccgtgctcattatgtattctatggcttcttttcatttgtcttctcttcttttgaggtttctcagtctgtacattttctgggtgacctgttgtttggtataaataatcccttttttctgctggattcaatcttctattacatacatttactggatttttaatttttgtatttttattttttagttttagaatatccatttgatactttaaaaaaattagactccaaatatctctccacttagtcatctggaacatattaataacagttattttaaattatatgtctgataactctgacgttggaaacaactgggagtctgtttctattgtcttttcatgcattcctgttttatgacaagcttggtcgtttttgattaaataatgtatgtgtctgaaaatgtataaaaattctggaagatgttatttttctcttaaaatgatttattttcattctgtcaagagttagtgtagaggcaagttgctttgcttcagtcagcaactcaaatgttttgtagcttagttagagattctgatggttgtttctagtttactcttagttctagggatagactttcaggactccagtggaaaccccgacttgtttaccacactctttccttcttggctgactcttaactccaaagtttgtcttcccaactctgggagacttcccaaggatcttcttagtttttcacttctcatgagttcatttttgcatgatgtttatcttctggctccttcaccacttagaaattggcaaatctcttgaaggcaaaagctgtgaagaatgtaggtctcatttctctatgaattatggtccctcacatcctagctgacttcatagccctgaattctaatgtttatcttcttatcctgtgagattgctgaacacactaagatgtagctttctctataacctcctattcaactgtcagcaaatcaataaaagtaccctgagaggaaaatggctagcttaccttaatttgcttccctttacttaagtctggctgccttggttgcttgctgatgccttcaaactgctgtttttagtattttatccagcttttatggttgttgtctttgagagaaaatggaaagggaaaaaatatttattttatttacagttttaaaaacaaaaatcagcatattatctgataaaattattattgctttttgtgaatttaaggaatgttctgaattattgcttcaatattaaaacaataattattggaacattttgatggattatgaagaaagaatatgtaaaattgggatcgtgtggaaaatctggtatgcatgaaattggcatataaagtaggcctaaacaaagcaggtgctattcttagtaagaagcttcatgccccttatggcatatctgccctgaataatacataaagaaaataatttaacaatatgcgtttgaaaaatatttgttgagcaactactgttttttaagcagtgttctaagcctgtaggtctgtccatgaaggagacaggagtccttgcattccagggttttcaagtaaacaatttagaatagtgcaagttcatgaaaaaaaaagcataagattataataagattatagacggtgatgaaagagctaatttacatgtatgttctatgtatgcatttttcaggaagtgatatttgagctgagaattaaaaaccagaaaataccagtcatagaaaaatctgggtagagtttattaccagcaggaataaatgtggggtgctgaggaaaggaaagaaggccaatgtggctggaacctagtgatcaagagcaaaggtggcatgagatgctgtcacggaggtctccaggtcttcttagctcctgaagggagtagtcagtcatgataaacagtttatattgaattctgggtataatgagaaacccgcagtggtatttaagcaggtgtaacatgatttcctttatctcattagaagtaacattctgctaaatggagaatgattatagtgagataagtgtgaaaactaggtggcagtcaggaaaccatagtacttttttagcaaagagatgatggtaacttggaatagagtggtagtagcagagagaagtggcaggctgagatttatctggagttcggcatcacccgaattgatggtggaacaaatgtggagagtggggccaaaatgttgactcctaggagtttggcctgaagaaattttcctgaaatagtatggattaaaggaggagcagaatggagatactgggtggcaattaagggtctgttttaacgtgttatctttgaagcattcgagtggtgccaggcatggtggctcactcctgtaagcccagcactttgggaggttgaggtgggaggattgcttaagcccaggtattcgagaccagcaaccagcccgggcaacaaagtgagacccctatctctacaaaaaaaagcaaaaaattagccaggcatagtagtcccagctactcaggaggttgaggcaggagaatcacttgggtccaggaggtcaaggctgcagtgagccatattcatgtctctgcactccagcctgggagacagagcaagacgctgtctcaaaacaaaacaaaaaaattattcaagtggaaatattaaagggacaattggatttatgagtctggagttgagtgatgtgcactgggaaagagactgtacttaacagtaaaggcctgtttaagatcatttagaaagcaggtatagagataaaaagagggcctataattgaatcctaggcacttcaaatttaaaggtggtaagatcaaatacatcaagaaagagggaatcttcagctatggcaatgcagatgctgtgaggtacaaattaaaccactcaggtcttggaaatacctaaacatagggggaaaaaacacctaaattgtaatgagtatatgtgtgtatatatatataaatatatataatatattatatataatatataatacatatataatatatcttatatattatatataaatatatatatataatatatataaaattagagaatctttaataagaggtgaatggctccaaacacagatttaatttggaagctcccaccctagcaatacctactggtgttcattttatttatgtaaacacacaaatgttgactatgtaatttttcaattaaggaaatagccaataaaattgtgtggaaaaaagatagcggtagcagataataacatcttttacttactaaagagattgtgtctaaatattaaaagtaatacattcccttgtcaaaacacttcatttttgtttgttttcacaaatattttaatgtggattttgagtcaaattttctgtaggaaggtcatggtagattaatgtcaaattagctgaaacaataaacacaatgaaaagaaaaatcagccttgtaagacagtacaactaaggagatcagtttaaaacactaatgaggagttgcctctcagcactgggtcattatgattatactaatataataagttaggttcaggttagaaagcaaagatgaataatcttcaaaaggcacagtaaatagtcaatttagttgtctaccttcataatatttactatttccatactaaaagcttacagttgtgggctagaatatatgatattcacgtaataatatttaaattgaatttcatttttttgcttcttcattatccttacctctaccctcctcaataaattcatctcaaatgataagattttccatccatcattgtgaagaataatttatttacttaatgattctggaaatatgggaatgtttataaaacgaaatacaaaaattaagaaatggagtgggcaagtaaaaagacattttcccactgattttagaatatactcaagaaaattaaactagtgacaaaatagatttatttaacttataagctaattcataaattaatggcaaaatttatcacagtatacataactgagactttgcagatttttttgtaaatagataacattctgatacaattaacagatctccatcagctgcattagatttcaagttgccctgctaccactgtatatatgcacatagataaatatgtatatgtagtgcaacacagatgagaagatataaagttgttttattttgttcgaatatgtattacagagaaccctatgtgctgtatagcaccttatatatctttcttttaagagaacctcataggacttccaaattcttcactgaaatagctcctacttcttatattacctttcgatatgtcagaaagattctttttctggaagctgttgttctcatccacatcattgcacaggctgacaatcaagacactatttctcactttctttaaaactaaatcaggatttgagggagtggagggatgactaggcagagcaaaaggatttttaaggcagtgaaaatactctgtaggatagtataatgatgggtacatgtccaaacccgcaggacgtgcaaggccaagagtgaagccgaatgtaaactataggctttgggtaattttgacgtgtcaatgtcatttcatcagtcattacaaatgtactactctactgggggatagtgataataggggaggttatatgtttatgggggcagtgagcgtatgggaaatctctgtatttttttttttttcttttttgagacaaagtcttgctgtgtcgctcagactggagtgcagtggcacaatgtcggctcactgcagcctccgcctctagcattcaagcgattctcctgcctcggcttcctgagtacctggaactacaggtgcgcgccactataccccgctaatttttgtgtttttagtagagacaaggtttcaccatgttgcccaggctggtcttgaactcctgaccttaagtggtctgcccatgtcagcctcccaaagtgctaggattacaggtatgagccactgcacctggccaaaatctctgtatcttcctttcaattttgctttgaacctaaaattctccctaaaaaataaaatattaaaaaataaaagaaactctatgtaccctactgactctttgtcaaagattatctattttttttctcaactcatgcaatgtttaacactttggaccatattatcacttatggttagcctcttataatatggtatggctatttttttaaaaagtcatggtaaaatgacataacaaacaattttttatcttagccacttttaagtgtacattgttgtgcaaccatcatcaccattcagctctacaatgcttttcatcttgtaaaatttgaaatactgcacccattaaataataactccccattctctctcccccagtccctggcaaacactattctaccttctgtctctataaatttgatcattctgggcacgtcatataagtggaaccacacagtatttgtccttttgtaactggcttatttcattcaacatagtgtcttcgagattcttccacgttgtagcatatatcagagtttccttcatttttaaggctgaataatattccaatgtctatgtataagtagactcacacacacgtacatatatggcacattttttgtccattaatccattgatgaacacaggttaattccaccttctggctattgttcttaatgctatgaacatgggcatatgggcttcaatctttaaggtttcagttactcatggtaaactgaagtctgaaaatattacatacaaaaacattttaagagagagagagggagaagctacattcacataacttttattatattatattgttgtattttttattagttattgttgttaaatctcttactgtgcctattttataaattaaacttcatcaaagatgtgtgtgtatagaaaaatacattgtatatatgggcttcacgcattgaatgagggtcttaggatgtatcccctgaggataaggagggactactataattctactgttaattctttgaggaaccactatattgttttccatagtggctgcaccattttacattcccatcggccatacacaaggattctaatttctccacacccttgccaacacttctttttctgtttttttttttttctttttaaatagttagcatcaaatgcgtatgaagtggtggtggttcatattttcagtcatcgtttcccagtatttcttgagacaattttgaaatattgtaagagatataaaataactttgatgttggaaagaatagcagtgaagaatgcccatgtaaaatttgagaatcttgaaacatgacagatacaacattgcattaaaggaaattaaatcctggacaattttgcttagcttgtaagtacatatacaacacatatacaaatacatgtacctataagtacatataaaatatatcctttctaaatttggctatattgtcagatacctgagaaaattattatctttatagcctctgtgatatgtcgccaatgcaaggcccatgaaaactcaaaaagagtcagttagtaaatgaactcttttattatttgtataaattatagtttttataatttaaatgtaacatatgaatacttgtgtctggaattacaatagacacatttttatctccagagagttactactggcactttttgaaatcctgttttgtcctagacactggacaaaatattttacataaattatcttatagaacttttcaactccgtaagaaagatactattataattagtacattttgtatcacagaaattaaacaacttcctcaaaatgacacagttagaaaacaatagagcacaagatgaatccagttctttctgatgtcaaagcctgccgtgtatactccagatgacctgaaccttagagtaactaaaagcatcagggcttctctgatatataattgtgagaatctcactaaaaacaagattaaattactacagaggagtcttagaatttaaaactctaaaaagtgaaacttaggatttaccaaaaatgtttctaacttctcatatacatgtatggatgtaacctgaaatgctgggttgattattgaaatgtccatatgaacttacaaatttaccagaaaaaaatcaaactaccccatcaaaaagtgggcaaaggatatgaagagacacttctcaaaagaagacatttatgcagccaacagacacatgaaaaaatgctcgtcatcactggccttcagagaaatgcaaatcaaaaccacaaagagataccatcccacaccagttagaatggcgatcattaaaaagtcaggaaacaacaggtgctggagaggatgtggagaaataggaatgcttttacaccgttggcgggactgtaaactagttaaaccattgtggaagacagtgtggcgattcctcaaggatctagaactagaaataccatttgacccagccatcccattactgggtatatacccaaaggattataaatcatgctgctataaagacacatgcacacatatgtttattgtggcactattcacaatagcaaagacttggaaccaacccaaatgtccatcaatgatagactggtttaagaaaatgtggcacatatataccatggaatactatgtagccataaaaaatgaagagttcatgtcctttgtagggatatggatgaagctggaaaccatcattctcagcaaactatagcaaggacaggaaaccaaacaccgcatgttctcactcataggtgggaaacgaacaatgagaacacttggacacagggtgggtaacatcacacaccggggcctgttgtggggtggggtgaggggggagggatagcattaggagatacacctaatgtaaatgacgagttaatggatgcagcacaccaacatggcacatgtatacatatgtaacaaacctgcacattgtgcacatgtatcctataacttaaagcataataataaaaaaagaaacttaaaaaaaatgaaatgtccgtatattttcttgattttttccaaatgttttgaagaaagtttttgtattattaaatgctattcattggtcaatttaagtaatcttcttttaagaaatcattcagaaattgtaggtccttgatcgtaattctttttgggtaatttcaattgcaataggttaaacactgtgctggaagatttgagaaagattatcattggtccattttgtcaaaatcatttccagaagtttaagtccttttttcttcatttttagtgtgattcattgattttcctaaggaagaacatttaacttctctcagtattcacaaggaatacctgcttgaatgtttaagtaccaacagaggatttaaagttcttattacttatgagcattaaatgaattcaatactccaaattttatagaagaagcatttctgaagatagaaaataaggataatttttaaacacaagaaatcacatgcttttcatatcattatcaatgtggaaaatgctaaaacaacttgctattaaaaaccatttatcagaaacttgtttaattaatatgtcaaatatctgggtttttaaatcatgtataacaatcaaaatattcctaaaaacatattgagaactttaacaaaacattttacagttggaatgaaattagtactggatgattggattaaaagccagtagaaattatatattatcctatttaaatgtaggactatataagttattggtaatcctttttcgtaattttattactttttccagtacctaagtggatactggtgactggtatataataagtaaccaatgaatagatattgaataatgcattgctttgctcaattttctcatctctgagctttcctgtctgtgctactgcaacattactttcttaattatattctctcactccactgcaataatattacagatgttattccctgattaagaatagtataaattgacaatccaacccctcaaatgaaattttttggtgatccaaacgttttaaacatccaataaagatataacatgctagttctctagtaggcacccatttccaggtttccaaacgtttcaacaaaaacatttatatatttctctattgattgcataatgtggagattctgttttgagaatgcacataaagtatattatattctgaactgtaacaaaatgagactctaatttattcacagtcctttttaaatttgtctgtatttttgttttcctgagaaaaatcttatctttatagcctctctggatattgaatatcttgagactagctttaattctcttgatttttattaaaacttctaattccaactttattcgtgaactacatgcttatataaaagtacgtttcatcaaacagctttctctttatctctttaaaatcattaccttttattattttcagtatgctttaatgctttaaaattttattcttgaaacatttggtttttccattgctactttcctattgattgttttcctcatatgtatcttgagattttagtctaggttttataacaagcatagctatatttacagatattttttctataaagttttcaatatagattctgatttttttatcttataaaaaatagttaacaccattaacgtttggatttatttctgtctagttctcctctgctcacacacacacacacacacacacacgtgtacacacaaatacatatatataaaatgggcagcacactaataaagataaaaataaactttataaagttttacattttgtaactggatattatattgtgaacatccccatgtaactgtgtagtatttgaaacttagttatttaaaaattaaattgcaaatgtatgatcttatagactattttcctgcttccaagacttctttggaactgtggactccctgaaatgccagggtaacataagcgagacagaacagctagcagaacctcagggaataccactgactttatggtgtcagccagtatcatgagagcccacaatgttgcctttcaaaccaagtgatacatttctatcaataattaaataaatttgaaagtacactgccattgcatttgcaatcttctttctttgttctttattcattgcaataataaaaacaaacaaacaaaaaacaacaccaaatcaaatgactgttgatgggggaattataagaatagatgggagtgaagacccaagctgactttacctccaactcaaagatttttgtccactaatctaatttctctttctctctgtgtttgttaaaagtttcaaagtagatgtaggttctcttgccaagttgatactcgtgttctttccttttcaagattacataaaaagtatagcttagatccaacgtatcaacctggaataggtgaaaatatcactattgattataactagtatttaacgaggcttaatatggaccaaacactgatctaggtatttcacatgtattatgttttgtaatcctcacaactttatgaaggaagtatatgtgtgagaaaagatacacacgattagattttgagagccagtgcaaactgcaccgcaggtgtattgcctgttcaaatttttctttaccactctatattaacacctaagttaaaggccggcacaataagcaatgtgttgcttgataatatttgtaaaacaaatggattagtgaacaagttaatatgtcactctgtggtctttaaaatatatatggaaatgcagaatattaaaatctgcaatacatattttgaaaaacaaaggtgagagtaatgctagccaaagcaggtttgactgcaggcacaactgtccttcccactcttcttaattgaagagtcacctcaatccccatttgaatgttctcttttcaacctcctaaaaagattactgagaatgtagatatttaaatgtattctgttcatctttaaataatttcatttatgtttaagctgcaaaaattgatctgaagttagtctggtatattgtgtactttaagcatgtgatacatttctaaaatgttgttcatgtcaagaatatctacaattcaaatcatgaccttcttttggcttgtattctaattttgaagtttctgacctagacacaaaaatgattaactgaagaattttaatagttgtactgttgttcttcacttctatcagtgatgatatttgatagtgtaatatgctgagcaggcaaacaatgaaaaagtcccctccatgcaaaatgtatgtaaaatcagctttcaataagtgaacagtatttactacctgctgttccttttcaccatttgcagtaccattcttagactcactgcaggcataaaccctgggataaggaaaagttaagcctccattcttcatacctctaataaggctttgccaatggctgcaatcattttacaaccatccacttatgtttaggtttaacagagtcttggcttcataatgaaatacttcattaaagtatttttatgatatctgtttacacatatgttcatagtagaattacatggtgttctgttatccagtctttgccattcacatggactcagtttatagtgtctggttatgctactgaagatcttcctgctttaccatttgctgttaagtaattgtagtcagacagactgcccaggaagccccatggactcagttttatcccttgggtatcacaaatgaggaagagtttgattccatattggtgaaatactacttctgtttcctaaagatatgttgttttctaagatttgcttctagattttgtgattaaatgttttattggacagggatttaagaatcagaatttcatgacattttgtcctactttaaatggaaatgtctatagacttttctagtgaaggcttttacaaatgttaagggatgattgaatgctcacagcaggacacatggcattacagaaagtctccaaaattattcatccttttggggacaactataaccatgattttttgtgacactcataacctgttgaattggaaaaatattaatgttagaaatctgttctcatgtcacttttaaaattcttctccttttttgcctcctgtagcatgagtcctagtttgattaaactagacacttgattttctccaatggtaacatgtttttaaaaaaggacttttactctgttggaaccaattaggccaatgtgaggaactttggaaggaacatgagcagccaaacttgctaacagcaaaacgtatttttctgaaggcagcatgaaaaggacggaggagttctctaaggactgtgagttccacgggtccttttgagcttcagaaatccagctctcagcacttcataaatcatttctgacctgatgtcactgaagttgtattattatgtggttagtataaaattcagaaaaattgggagaaaatacaaggagaagaatttgcagggtgattgttgtaagatttttatcatgtcctcttaaaaatggtagcttttcagaaacttttgttaactgctttgcattccatcttgagaaaatgtctgtatagttagatgagcatcatctcctctccttgtttttaaatcacatccaaaatgacatcaggcttgcagccgtctcattttttccttttatttacactcttcacacttcattggcaattgaggtcaccactttaaaatttagggtgaaggctaaagaccagcttgacaaactgttggcggaatgctctcttttgcaagtcttcgttttgaagaaagaatgtgtgatttagaaatatttaagattgtcattttggtagaacttctcatctatcaatgcagggtgcagcatccctatttattaatgttgtgttggttagatatgttcacccattaggtacgtgcagaggtacctgaaaccatctgagaggtggtatcccatttttcataatctattcaattgaactttaaaaataactgagcatcttttatatacaagacattaacagacatttatattctatggtatctactgctagcaacttataacagttttggtggtaaaataaaggcaaacttgcttcataacaaaacaaaattaaattatcaaaaagaaatgctcagttgttaatttaaaatataaaatgagacatgagaataaccttaggttagaaattcagatgtagaaaatatctgtataaagaagttagttgaaatactcataggcatgaaaggtattttgcaaaaagcaaaagtaggcaaaactggatctatgaagttgctccataatgtactagtcaggtgaagtagcacaaattacctagtgtatcagttttcttttgttaacacaacatattaccacaaacttaatggcttaaaacctcacaaatttatctcacagtttaataggttagtagtctgacacaagtctcactgagctaaagtccaggtgtgggtagtattgcatttctttctggaggctctaaggtagaattcattttctaaaattcattcatttaggatagaagctgaaagaatcagtttctacaggctacctgcatcctttggctcatgaccccttcctccatcttcaaagccaggaacaggttgaatccttcgttgtaccaccctaacctcttcttttgcctccctcttatacttttcaggacccttatgattacattgagcccagtggattatccagggtgatcctttcatctcaaggtctttaactgaatcatatctacaaagttccctttgccataaaaagggtcatattcacaggttccaagaattaaatatagacgtctttgagggaccactgtttactctaccataactagcctatctcatttcaattttctaatcagttactacctgtctcttagagttcttgttagcagaaacaaatttctgtgtaataaagtgcctggcaaaaagtaggtcctaaataaaatgttattttccccaagggaaagattattaggaattataacattgggacacacctttgtttaaaaagctctaattaacaagaaccacagcaggggcgcacatacaggggttggagagaaattcagttagtgctgtcttctggacactccttctatcttcattctctcctctgccattgttaaccttccattttaggcaaggagctgtattaggaaaatgtggtttccttttattaaaagaaaatctctaaattattaatagatattacttttccaaagaaaatttcagaaaggagaagaacaacataatcaaaatctgtggacactttaaagataaggatgatggagaaagactgaattttgcaagcaggttataataactcctgagagtgattgtaatagggtgattaggtcatgcatggactacaagggatcaagtagaaaaggagtggtaaagtagtaaacagcagagggtacaggctactcttaagaaagtccctagagaaggataagaaaatggggcaatacataagcttggaaatagatgatgatatttcttttttttttaatttaattttatttatttattttttttattaatcattcttgggtgtttctcacagagggggatttggcagggtcacgggacaatagtggagggaaggtcagcagataaacaagtgaacaaaggtctctggttttcctaggcagaggaccctgcggccttccgccgtgtttgtgtccctgggtacttgagatcagggagtcctgatgactcttaacgcgcatgctgccttaaagcatctgtttaacaaagcacatcttgtaccgcccttaatccattcaaccctgagtggacacagcacatgtttcagagagcacggggttgggagtaaggtcatagatcaacagcatcccaaggcagaagaatctttcttagtacagaacaaaatggagtctcctatgtctacttctttctacacagacacagcaacaatctgatttctctatcttttccccacatttcccccttttctattccacaaaaccaccatcatcatcatggcccgttctcaatgagctgctgggtacacctcccagatggggtggcggctgggcagaggggctcctcacttcccagaaggggtggccggtagaggcgccccccacctccctcccagacggggtggctggccaggcgggggctgccccctacctccctcctggacggggcggctggcagggtgggggctgcccccacctccctcccggacggggtggctgccgggcggagacgctcctcacttcccagatggggtagctgccgggcggaggggctcctcacttctcagacggggcggctgccgggcggaggggttcctcacttctcagatggggcggctgccgggcagaggggctcctcacttctcagacgcagcggccgggcagagacgctcctcacttcctagacgggatggcggtccggaagaggcactcctcacttcccagactgggtagccaggcagaggggctccttacatcccagacgatgggcggccaggcagagacgctcctcacttcccagacggggtggcggccgggcagaggctgcaaactcggcactttgggaggccaaggcaggcggctgggaggtggaggttgtagctagccgagatcacaccactgcactccagcctgggcaacattgagcactgagtgaacgagactccgtctgcaatctcggcacctcgggaggccgaggctggcagatcactcgcggttaggagctggagaccagcccggtagatgatgatatttcatttgcaatagctaaaattgactaagtgttaagtgactctgatctgttgaaagaattcatgaaccaagatcagaaactttcttctgtctttgatttgttattctactctgttaacattatacttctaacacttcccatcactacaaatctttgctattagtccccaaatgctttgaactagagtgattcatttatgtgtgtaatgtcataaattggagaatgtgtaggttcatcttaccttggtaaatacagaagcacaaaaaacaaaggcaatgccaggtatttctccagggtgaataaattttagaaggcaaatttaaactgtcatatttctgattgcctgtgattcacaccattgttgtactctgtgacagtttcattgaaaggactgtcatgttccatgaggaactcagcctacctgctcttttaccagtagctggtgggaaagccatgctgtgccaatgacttattcacaggaggcaggtcaatcttttgaaaccacagattgtttcaaatgagagaaaaatatgtgagaagagaatagatgtcaagggtagtgctaaagacaaggaaaatgcttgcctgggttttccctgcagctgacgttgttaaaaatgatagcaacttaatgaagcatggcgtactaaatgcattaataagctgagggaggaccttattcattccaatttggactctgctcactcgtgttactcgttttcttaagactggactaaaattgtgagaccttatgggccaacgataccctttagagctgataattaatttgaaagaattattaaagcatatttcttgagctaagaatgcagtgtattcacagtaagaggcagagttaaccatttatcaagataattaagaaaatgcattaaatgtttgctccgtaagagcaagcactaaattaccagtagtagtaatattattatgtgaaagggaatcaatagtttgtttactaaaatgagatgcattagcaagcttttttattctgatataaaaattttcaaatatacacaaaagtatagagaataccgtggactcaaatgtacccaacacccatccataagtattaactcaggacccctcttgtatcagttttcaacccatccacatcctactccacccctccagattattgggaagcaaattccatatgtattactcgctttgtaactacttcattatgtatctctgaaggataagactcttttataaaggaaaccattgtcacatctaaaaattaatactattatactgattctttaatattaacaaatatttactcagtattcaaattcatcacacctgcttccaagttttttaaaaacagttgaatcaggattcacaagaagtcacatactgcatttgttcgatatatctaggtctctcaatcaataacattttaacttccttgcaacttatttttttgaagaaaccacgttgtgtgtccagtagtgtttcttacatcctgcattttgctacttagggttcctgtagtactgtttgcatatttctctactactatatttcctgaaaactgatagataaatttagagagttactctgattcagggttcatatttttggcacaaccactttatagattgtgctatgtgcttccatcacactgcagaaaatatctgggtgtctcttttttggggatgtttctggtcattgatcagcattaatggccacaggtccatcattttatgggggctcccttcatagtaaactgcacagtaaactatacacagtgaaccttgtggtaaactgtagcatcctgtgtactatagcaatttactccatgttgcttttttcatttaacaataaatcccgccattcattgctcttccatctcagggttttcttgcttattattgcttgttaaaattcttccaaatcacatttataatcaagtcgttcagcactaaggaaaaaaaataacattttcatgaaaaaatgaaattgcattacatttatatattctcttagggacattgaaaataagtcttgctatttttcagagctagactttgagatttgcttttttgcagagtgagatagagaagtccttcaaatactgtcccttgaagagttaggcattgatttaaacccttttgaaaaacaatttcaacaaataattgaaaatgttctcttcaaagtattatcattagtcatccagttagattattattattaggaattctgaggtggtggaataattcattttccaatgtgttaacttctcatgagtttaatgtgagtataaaaagtctgttttaactgagggcagagtattcctttttctcttataatacaggagccagttacaacacaggaggtgaaatggcctgtttgcttacctgcaacttcaggaatttcatgcttagcaattaattgcagtacacacttgtgggggtaggggtaggaggttggataagtgggttgcacttaataattcagtgacaattacaaatcgtttcactatatgtgaaagtatttgaagtaaatttacctgaagatagaaaatatgggtgggcaagctcctcctgaactccccaccacattattctaggtttattgaagtaaatgtaaacttataaggggacataaaactcacacagaaaataataattagacatatttccacattaatgtttttaagtttaaaacatcatttaaaaattttatcactgatgcttgacttaaacaagtccacttatagcattgtcagaatctgtataagtatctcttcagggaatttttaagatgagagtgaacaattttctgagattgcctacacatttttgttacacagtaagagccaggttctatgtggcttaggtggggatggggctttgagtgaatcctctgttgtacacagacttaatacattctccatttcagcccacttttcacctctgttttcatcagacctacctcggtgaggttctagacttctgccctgctgcagctactcagtactttaggccatgacctccgctctccttcctcagcaactcaccacagaccttccagaaaaatgttaaacccttctcatccttttcttgttattggtttctattttctttctttcttttttctttagcgtcacaggggaagagctgataattgtattggctatatgtatcaactcaaacagagagacattacctgcagttctataaagattcccagattattccaatgggtattaagcttgaaaacatgatgtctatgatcctttctggttctgatattgtataactctcatcacttaatgaaagccaccgttcctatttggataaataagagaattgaaaaacgcactattagaactgagagtacagatgagctttccaaatatattagagatggcatcacagtacatggaaatgttaaaatccataacatgggcaagagcacatactagaaaagtgcagaacctctttagaagtgaagcattttcgttccatgcacatcaatttgctataggagttcagggacaaatagcaatatgggaaggaggcggagctcaacattgagcagaaattagacacatgctgttctcttgagagattaagaaagaataaatagaagagagtaagtcaggtcctatgagaaggataaagcattgtcttccatagagagtgaccttcattaatattttttacggcttttgtggagatcagcctaaggaaacagaagtcctatggccttattacatcattacagaatcacactttggctgggtctcttaactgtgtaacagtggtgctcaaaagtctctgtaaatctccaaaacacaatactctttagtagcatttcttagatttgtgattcttctggggacaaaggatctgggatacaatgggttcccgagtgcagtggtgtgatctcggctcactgcaacctccgccttccgattttcaagcgattctcctgcctcagcttccggagtagctgggattacaggcgcccaccaccacccccgactaattttttttttttgtattttttagtagagacggagtttcaccatattggccaggctggtctcgaactcctgacatcgtgatccgcctgccccagcctcccaaagtgctgggattacaggcgtgagccaccgtgcccggccgaggatttttttttttttttaaatcaagacttagcaatgcatgttctagaaactgattctggttttcagacttaactaacatgggtataggtgagctaagatattaagctgcagggaagggtctagagtagctagagttcctgggctgctcacttcaagctatgaggtctcctgaacactggtaaaaaccccagtgctgtacaaatatcattttatcttagccatgatgttcaagattggaaagcataactctatgtgatgatcattgtccgttgcttattattttgagactaaaggattcttaagaaagaccctattctccatttccacactaaatgagatcaagttcttaatactcttcttattataggaggaacatctaattcaatgctacatcagtaattaaatgatattttgttaggtgacatgcaaatgagtaacaaatggaatatgaaatagaaagttccctttgttatgtaaattgtcaaacacttgatattgtttttaaagttatttgggatttttttaagacaccaagtttgtaacaagtgcccttcaacagaaaagacacttggatatcatgagatgttctcttaggttcctcaaagcctagcagtcatagcattttaatacttactagtggggagtctgccttccctgctgcacaccagaacagactggggtgggggttaatcatctggaaatgaggtattataactactgattttgaagagtctttataatgaaaacaagacacagttaataaaagtagcatagaaaacattagagagttattttattagggccattaaatatttggagtacagtacttagaaaatcactgttaaaattgttacagttactctctgaagcctgctaagaatactgctatttattacatttttaataatgctattcactacattttaaaagtttactcaaaaactacatgactttcaagtcatttaagaagtccaaaagaaattccatgccaacaaatttaattaattttgcatggaatgtgaaagaacccatagaaaataaatgaaagagggatattgttttgaaatgggactcattcagtcttctgtaaggcggtgactgcttttccgtgtcactgctggcagttatgttgaattatagaaagagtctgtggggtctctagtagaacttctcttcgtggattatttttatctattattccagagccaacacaggagctatgaagtcataaatccacattgtagctgcatgagaacttggccttatcacatatttgcatactcagtgctttctaagcaaagttctttatccataaccttagtgtagtcttatttttcttagtgggtacctgtgatctctaatatgctttgctatctctctttttgttttatatctttaaaaaaatctctatgtttttattttttctggaaggaaacaggctcacttggaatatttacctagattctctctttcacaagaacacgcagtattttgtattcattatctcattatctcttccctggttgtgtctttagaaaagaaacaatggataacagagggtaaaagagtttcagtaattttctcagctcacagagacctaataggacaaatactccaggaacgtatgccttagttcctgcagatgacaatatatgctaactgggattcaagctctaacaaacaggcaagaccaatgtcaaactaataaccataacgtggaagcacattacagtgattttggctatccaactaaatgtaataaatatcaaatgcccaccatttcagaagaattataataaggaatatagcatctttaacccatttctcatttgcctgaagaatacttgcagacagcatttgtggcttaatgtttaccctgagataacttgtggcttactgtcctaaccttatccccaaagtttgccatgaaatatctcacttttattattatttttgcataggtctagcatattgactttggaaacaaaagacatcattctatttgtagcattctgtgtttgatagtagtatttccatatacaaaatatagtaattattgattgctgaaatcaaatcctagaaaatacagcattcctatataaaaaattattaaattctgatcatcatatacatttctgttacattaggattagagataagttttatttagaaataactctaagaaacgtttttatattttattttcacattgaaaataagtcagatttgcttcagcctcaaaaaatgtgtttatgtaaaattaaatgagagctggcagtgagctgtacattttttttcctaatgggacatgggttatgggttaaagatgtacaagctggccgggcacggtggctcatgcctgtaatcccaacactttgtgaggctgaggcaagtggatcacctgaggttaggagtttgagaccagccttaccaatatggtgaaactccatctctactaaatacaaaaaaaaaaaaaaaaaaaattagccaggcgcagtggcacctgcctgtaatccagctacttgggaggctgaggcaggagaattgcttgaacctgggaggcagaggttgcagtgagccaagcttgcgccattgcactccatcctggacaacagagcaggacgcagtctggaaaaaaaaaaaaagtgtaaaagctagaggccctggcctccacaagcccacaatttagttattcttcttctttatgattttaagaccttgtcaggaatactttgggattatcagtagttaggaccaagatatttcatattttatagcagagacaactctatctgtgcattttataagattaatccattggtatgtttcttgttgaatttctatataaagacattctacgtgatgagttgttcaatatgaactgtctaaaaaacaattccttatgaataatacctaaaaatgcataagtagcaaatatcttttatagtggttgatgtaacatattctatgttgttcctacttttgccctttctctgttacttattttactttgtctttattttaaagataattttatttaaaagtaaaacatttatgttcatacaaaaaatatagcagaatacgggatggaaaataaaagtcctcctcttttcttgactcctaaaggtggcagctttaatatgttcacataattcctctcccaaaatgtcttggcatattcaagcagttacaggcacatacatagatatgtgtgtctatctgcagttatacctatctatatgcctttgtaaatataaattcatcagtatttctcacctgcagtgatactcaataaaacagaatgctcaaagcccagacccctcaggacaaatatcttggctgtccttgctatgctggggtcaatcagatggtctcaggggagaggaggcatttgggaggttgggcagcagtgatttgtcaacaagtacagaagcatttcagtattttatccactagttgttccacaactgtgcctaaaaggctaatactaaccctactttgactcattcgatgggtgatttcccctccatggctctcaagcatgcatgcattcaagtaaacatcttgaaggaatagcatcagagccacctgtattaccgcattccataccaaatttttatatttttaaatctagtcccttagggtataccatagatcctatacacgtatgcatgagttaccatgtcaaaactatgaagcagataaaatttgtttctagagcatccctttcaggattccctctgtagctcagcagtcctgttaatcacattgtagtgagcctgtcctcccaattgtgccccaccagtgacctcatccacttagagcttagagctgccaagctctcatacctcatagcatttactagtcaagaacatatcatactgttttattattatagcacttttcatttgtctcattattacaatatattaacaacacattgatggtggaatagtaatttaaactaattcatatctgtctttctacctagaacattgtacataaatgtcattccataatgtttcttcactattcttttggactacattggtaaagacacagatatgcactaccacaaaacatctagaatatttctttttttacgtcttcaaattctatataaatttgtaaatagagcattgccacattcctctccattgtcactctgttaacagtaacaatacctctttatttcaccccttttcttgcatgtttaccttttgtaaagagaaggtacagaaacccttcatttaatgtgtttcaggttcaatccgttgtcttcataacactggaatttctcctccattattttctatttggggatgtaaaggaatggacatttattgaggatttactgccacaatgctagaaccacaatctgaacataggaatgtgtttatgttgtttttgctgtaccatactaactgcctctaaatggcacttttttgaggattatgtgatataagtaaacaagttttctaaactatcaagcactattcacactgggaatttctagcttgtattttacagtctttaacacagtaaggtgagtaaattggtatgtactattaataaatgttttaggtggtaataattataatggaactttaaacatcaggtgaaatgttgccaatgagttgttactaaaatccagtcttaatccatttcttttaaagccatggttgtcaaaacaaaacatcacttcttagcaaaaaattattagatatgaacctgtaatagtaaaatcatttcagagaacattataagattatagaataaaatctgaaataaaatctactgtagcatttagacttatatttgacataaaatgatgagaatatttgggaattcaatgttattgttgttgttatacttccctaggtgttccagatcgcgtatgtgattgtgaaggcagctaactccccccggcctggaaactggattttggaacgctctcttgatgatgttgaatacaagccctggcagtatcatgctgtgacagacacggagtgcctaacgctttacaatatttatccccgcactgggccaccgtcatatgccaaagatgatgaggtcatctgcacttcattttactccaagatacaccccttagaaaatggagaggtaagatgagaaaactcaccatttaagcacatttgatacggtgaaataggcctgtcagaaagacctgaatatatcagtaattaatgtcagggagattttaaaataggatttagcaaaagtacatttaaatgagttattaaataaaaaagaaaaacctgaggtgattagaattttaactaccttcatgtgtctcccatctccagtaaagatcagagaagaggaaataggtttaatctggaaagtcaatgattaattttacatataaagagactttctcaacaatgaggattgctaatgattagagaaggattggagaccttaaaggtggccttacatttgagtgtactttggtctgaagatggagacaaaagaaatgaatttgtgaagaaatgtaatccacatgaaagacccaaatgaaaagtaattctttcaatcttttgatgtttttctgctgtcaccacatagggctacagtggggtttcttccctgggtcaggctttgtggaacagtaatgtgcaggaagtcttaggttctcagtgatgtgcaagctaggttacgtgcttagttcaaatatgttcttctccagtgtctgtcatcctgtggttaagattttagattcattcattgattttaagccacatattctaaccatggcttcagttgttattagtttattagttgtatgtgggggcggggaggttttttttttgttttttttttttttgttttctggcttagttgtgtgttcttgatccagttacttaaattctctgcacctcagtttcatcgcccataaatcaggaataataatagttcttacctcatataattgtcaagaggattaaatgcattattgtatttaaagcattagaacaatgctgaaatgcacactaagtactctgtgctatttttattgttttgttgccattaaggaaataataaccattactactattatttttattattatccttagtcttctctcaaatacccaaactttgacttagtgactctcttgaattattcaatatttctttagtatgtttccctgacttgtctccctttagtatatgtgacccacctcctttcatgctacctaattatgtatatctccattgatactcatgtctgatattctctcccacatagtccaaacatctgaagctagtatcatcatttatatttacattttcagaaaacccatattcacattctatcatgcccaccccagccaatctagggttatctctcaacacttctagggaaaattagggttttggcataaatctgtcagaccctcattaggcactatttttatattaatgtataccagtgcttcactatattttaaattccatgttcaaaaataccagttttggggaaaaacattccaaatggtactctcagcagaaatctcaatctgccaaatgacaaggactcaaatgcagtgagtcaaacagctgttcaacctgctttgtgcctagaggcatccaattcctggccagtttggcctgaggatatgggagtagggagtgcagaaagagttttgagttgaatttttattattttttatcctagattcagtttacataagactaataattctcaaacaatttaagactattctatacctttaaaaatgattcaattcagaaatttattaagcaatataaaatacacttcggcaggtatgtaacatgcgtgtcacaagcatataccctacccattctctcccttcattaataatggttctccattccttaaaccaagtcagcctgccaatatgaaacaaaagacatgtttattagttaattagttagtttctttaattggctatattgttttcactcctaaacaacacttactaaaaactgcttattgatggtaactattaggagcaactgactgaactgtctctgtgacatgtttccttacgtctatttgtcactcatggggaagtgaatgaaataaggaacagaaagtaattcaaaatatttgccatagaatgataagactgaagaataagaattaaattcagacctctcctaggctatctattcattttatatagcttactttgtggaatatgttacttttttgaatagacaggtgatatcctccaagactctcagctcaatgataatataactgaaataataattgaggtctctgattctcaggtaaatatttcatccataatctggtaaggattaaaagttgacttttaaaagttgacaatcgctaaacttaaaaatggttcagaggagatacaatattgctggatctaatgtaagtagaaagaatcctaattctgatatatcatggcatagaaaaagacacaaggaattagaagacctggattctggtactggttccagttatttgtgggaccttggtcaaatgatttaatctctctgggattaaatttctttaatagatgaattagttcaatgcccagattgttctaaggcagcatggtattttctaaaataatatagctttggctatcatacaacatttgaggatattctaaaagttttggatacttttctctaacattatccagacaaagtagctgtggaataaatctcactcgtcagctttagttttaaaattatgtactttcacataatccctggaatacaattattaattgtttatgttcaaaactttacagagaagtgacagtcaaataagagaaacaaacatataaaccagtaaataaaacatgattgcataagtactgtaacagtagtgtatacagagagcaataaatctccccctgcttgagtggaaggaggcacattgagaagataacttctcagaatatgggaaaaccagcaacaactcttatctcaaaagtctcaaagccaatatgcaaattcatctccaataatgcctatgtgttaaactcggtacatacagaatttacctccattgttgagggatattgttatcagatgtagaattctaggtttgcagttattttcttttggcacattttattgttttctgatttccattgcttatgtagagaatgcagctatccgattactatcttttggagtgacttttctctgatttatttaaatatttttttctttgttcttcagtagttttactatgatgcttcagatcttcactgcccactacaatagccactagccatatgtggtaattcaaatttaaatttcagttaatcaaaattaaattaaaattccatttccccattacactagccacatttcaagtactcagtagccacatgggactagcagccaccacactggattgggcagaaagcaacactgccattattgcacaaagttctgttgggcaatgctactttagattgtacctttttattttctacatatctgcaaagtgatgtctttcatcagttcagaaaactgttcagtcattacctctctaaatattgcttcttccgcattccctctgctctatgattctaattaaaaatgacttggaactttttactgtatacactatgtattttaaactctcttctttagttttcatccttttgtctttctgtatcttcattctaggtattttcttctggattacttctagttcattaattctcttctcagctatgtaaatattgctattaaagttattcataggattcttaatttcatatatttttcagtttctaaatttctctggttcattttctttttttctttctttcttttttttttttttttgagaccgagtctcgctctgtcacccaggctggagtgcagtggcgccatctcagctcactgtaacctccgcctcccgggttcccgggttcaagtggttctcctgcctcagcctcctgagtagctgggattacaggcgcgtgccaccatgtccacttgatttttgtgttttcagtacagacagggtttcaccatgttggtcaggatggtctcgatctcttgacctcatgatctgcccaccttggcctcccaaagtgctaggattacaggcatgagccactgtgcccagcctggttcattttcaaatagaagttgtttctcattttacattgaaattttatatttatagtaaaattttaatttaataatatgatttattctaaaattttcaatattctatttttaatctccttgagcataaagtaaaaattatctttaaaagtttttgtctgataattctaatatatggcctttttggatatattttattttctgtttcatctgctgattctttttatgctgtcttacattcttgtgtgcctgattatctttgtataacagaagttgtatttgaaagagaatgtgtagaaataatttgagagctagtatattgtcttcatcctgtgtgaactttctgatgctactgccaggcaatggaaatctggatcatcttaattcaattttagggattcaaatttctgggacattcagatgattcaaagcattgctataacccagtgacagctgctttaattccagtatacgctcattcccatgctgcttatctttggagtccaagccagcgtgtgtgggaattacgaaagtcccacccatgcagtcctggaatccaacttttgtcctcctaatacagcagggctgtcaaaagagctgctcagtctctcagccatgtgtctggacaggaaaatgctcacaggacaaaagctgtcacaacgtaccaatcacctgtctagacatctcttttgtccttgatgttgagaaggttatcttcactctcttgatagctctcacatggctttaaacatatgtttttgtatatttatccagtttgtctagttgttgtcattgagagtgttgactcttactgtataatctaccataaatagaagcgaagttgcacatgcatttaattttttttattttggaattatgttaagtttacacacatgtatgaagattatagagaatcctcacattccctcatccagctatccctaggaataatatcttaaataatgacaatgcacatgttaaaactaagaagttagcattgatacattattgttatctaaaccacagaccttattcaggtttcattcattttaccaatttcattttttctcttctgggatccaattcaggtactattttgcatttagtcactgatctgtgacagttttaagagatattttaagaaatattttaagagatatttagagatattttatagactattattcagtttgggtttgcctgatgttttttcatggttaaactgggcttctggattttgggaaccaatactacagaggaaacagtttctcattgcatcaatcattttttattaatatatgcatatttttttcttttttattggtttatggggcttgtgcttctattaataggtagatttttaaaatgtttttaatttttatggttacatagtaggtgtatatattttagatagatttttaacgtggacagcagtatctaaatatttactgtgatttgtaatgtatatttttcactaagcattgaatggtcattttcttccagaccttcaaaatattccttaaatatgtcagaaataagaaaaacaagtccctccctctctgccttcctcccttccttccttccttccttttttttctttcttctttacaaacaggttctcattgtgttgatcaggctagagtccagtggcatgattatagctcactgcaggctcaaactcctaggctcaagaaatcttcctacctaaaaaatcagcctccagctaattttttaaaatttttttgtagagacagggtcttgctatgttgcccaggccgttctcaaactcctggcctcaagtgatctttccaccttagtcttctaaagttacagtcttctgagattacagacatgaaccaccatgcctggcccagaggaatttttaaggcccacccatgtaacaaggcattatgaaataaacatgtctcaattgttacacactagttagacaacaatgttcatgttttaggcttagaacattaataggaaatagttttcttgtgactaatgccaaatccactgagtctaaagtttattacatttccacttgtctaaagaatttttgagacatgtgccaaaatctttagaacattagagctgaaagataccttaggtaaatttctcatcaatctattaaaggatattcaagcccccaatttcagcctctgtatccaaacttcaatactgccctatgttcatatcatcactggagaggtctggcctttccttatggcctctttaatcttaattgcatcatctctgatgttttatttggctttgtttgttactccagttactcccacctgtttcccttcatggtttggtttggccccttctctgccctccactccacattgatttcaagagatcaacaaatgttagagaactgggttcaactactaccaagaaagagcttaaccctgaaacctagcatcctaggcctgcacccaaagggagaagagaagcttattctgagctatgagataatcgtaaggtatcaagtctcagggcctggcaaaggagggataatggaggatataggcaagataataatatgactgggtatgtcgttatccaggctgcaaatagaaggaggctttgagcaaaagccttaaaacagttttattttagaagggcaattttctatcatcaatgccaagagaaggctcagcagggaccctactttgtcctgctttgagcaaatgatactgagctccctaataggagttgcagggtatgaagcaacagactgcaggggcctccattactttgaggccaaccacagggtagagctcttgtgggaacagctacataacatgcatgtccagcagtgccccagggaaccaagccatcgagagctactatcacagcccaagtgctgcctctgcagaaagcagtagcccagatgctattgagaactgcttacaagaactgccacttggaagcaccctgagaacttggctttacttggaaatcacctaggagcatttgaaaaatagctactcctgagaccagaacttttaattcattatatttgtcagaggctcattaagccctatgtatattttaaacaagtactcttggtgattcttatgtctgtattcctggcttaatgttcagctatttccagccttttaaaccctgtaggagaacagggcaccagttatttagggaaagaatattggtcattctaactacttccaactgaagaaagagactaactttttctgtcaacaaatgtgataggttttggtggactgagtctcttggcaggtttgagttgagcaaataaacttcgaactaaaactaggttattgatggtcaaaggggtatctgagagaagaatcacagtaataatattgaggaggacgaactttctagatggcactgctttagagatcctagaattaaaattataatatttttctgttgtatgagacttttccctttctttgactcacattattgcttttaatttatttggattgtcactagactgctagctaaatattcgtggttaccatagtgattttgcttccatttcctcatacagaggcctttaagttatttacatatgatttcctttccttcttaccaccaccttctcactctcctggactgcagctcaatggaacttagattcactttgattctgctttgaaacatggcaggcttgtataaaaatccctggagaaaccatcattaaatcttgaagacacttttttttttttttgtaaactgtatgtagagctttgatattattttgatttcctatgtgacagaattttatatatacagacagaatatttttcttcctcttttcatcatctgacattatggtggtccttagaattgcaaatacaggagaaggaagacacaaacccaagactgtattaaaaaatgtttcagaaattctcctttgatataacattgttaaggttataacatgattttgcatgtgagtttgtatggaaatgagggaatggaaatgaagacctagcctttctcaattacccttgcaattgttcctttagggagaaacagcggagtattactaatttgtattggttttcaatagaaatttaggtaaataattatttggggtttcaggcttcctttctctaaaaataattctttttagaccaatgtggggccaatcagtacctggagcaacaatattaaagtacctccttacagtgaggtttatatggagtcctctaaaaaatgaaatgtttcaactctggttggaatacacagagcagctgaaatattttgaaatgacacacacataaaatacataatttatttaaggtaatttattgttacattttaaaaatacatctttttaataaaataaagataaaattaagaggattatattcctcctttttctttgttgatcagttactagactcccttactcctccaaaaaaaaaaaaaaatatatatatatatacaatgcccagaaagtatccacaaatccctgttaaattaatgcagtattgttgaaaaacaaagatggccagagaaactgaatgagaatggaatcctgaggagaaaacaccaatatttaagagacctggttctctcagtgttgtggaacaggatccactgatatggaacagaagggtaagcttctgttaagctaggtaaggaagcttagggttgtgaaagaaggtacaaagacactgcacactgacttttggggaattacctggatttggctttcaggtagctctgccaaggattaacaatagggttcagaaagaagagtaaaccatctaatatgtgccccagccagtttacgtggttataataacgatcaaattagatttttatggcaaaactctctttaacctctacgatatgatagtatttccagcctttttattctcaaggttcagtagctaacattggcttaagcccactcctaactatgaaatgactgagctggctcagcctggaatgagagtggggagcatgagagggacacagccataccacatgaggccatggctagggaaggcagaggctactgaacaagactgaaggaataagcaaagcaaaaaaccacaagcttgctgaagttggaggaccagaaggaataggtgagggtctcagtgctaatgtagggttaatccagggccaagtagacaaaaataataataaaaccacaacaataataataataataaatgatggctagcatttgttgcacatttattttatggagggtgttaatctaagaaatttcccatgtataaattcatatatactaatacttgtcgcattttacagttgagaaacaggtattacagagaggtcaaataactttcccagggttccacagctagtaatttttggagctgtgatttgaattcagtgtattctcagagcaccagaaaggtacaaagctaaaagtttccttctgtgtctggggtttcctggaaaatctgctctgccctataagctcaggagtcccccctcctagcagttcctgctgaagctctatgtgagattgcacagacctgagtttgagctgctgcttattttttattttggggttttagtattttcatgttttaggttaaaaaaattctttaccttttagctttgatgaattacttcatttttatatctaataggtttttttaaccttcactttaattgatttcttaacctctttatcttgctcattttttaatctttttaatgattttaaaatgctgattttaataattttatcttggcatatttatatttatcagtttttctgcttcaagctttattctggcaaatgatgtatatttatatttcttttgtgttgttttttaaatattttttatttttgtttctggaatttaatgtatgtcagttgtgcaatagacttgttagaattttgtttgctttaataatttttaaagtgactttttgcattacttttgatcattttactcttagcttattttgagcttttgatgtctaaatataactttgtttgtctagtgttttagtgtctttagtcattgcttctacatggcaataggaaatatgaccataaaaacctcagtgaaagtaacccacatttagagaaggcttgtattccttaatcccgcccctctacacaccccacccattcaacccatctgtagcctccctttcagctgttcttaaaagaccttcccttttaagggaacttacattttcccttcaatactaaatcccaaaagctaatagcaatacagaagatccactgaccaacatttcttcccaagacaataatagtaacttatatgcataattgttaaagcaattttaagattttgttttgttttttgctatccaagttcctaagacatgttattcctctaaaagtttactatatgaaatgattgactaatggttgaacaaatactataaacacataaggaaggtgatatgggttttactcacagaagattcctcaaaacgcatacctgatttggttttaataaggatcacattacaggagatccaatagaagctacttaaaaagtgttttagaaaatgtttttaaatattaatttgcatccattataacattactatttgaatttaacttccttccaatatacctgtagaatgagctattgagtttaacttctttccaggcatggttatggagcctgctagtgtgtgggtgtcccggggccacaccgtattaaataggctagtgataaaatggataggacaagatttctcatcaggaacatttttaaacacagaatctgttgattctgtgttgggggcagaggctgggagaaatagggagatattagtcaatgcattacttttataagtgggcaacagaacccatgttgtgtggtcaaagtactgcagaacttctcaagcattgtacacgtttcagtttttgactacgactttaatggtccacaagaaaggcctctaagaatctttttcgtgtccatttctataagagagaacataatgctgtgttagacatagttgagatccattataataatgtcactacattttgaaataaaattctgaaatgccttaatacataaatccttttatgaagtctttaaaattggctgctaaaaccaataaaattatatttttggaacatagttaaccactttgtgcacataagtgaggctgtagaaactagggtttttaaatgacttaaaagatatatatttctccaaactataggtaattatatcaatattactttgacagagatatagtaattctccatcttatagtaaaatttatgaaaacattaagtaaaccaacaggtaaatacatttttggtcaaacaaaactttaaaaattatgtttttcttttatttggctcaagctaattctttctgttatttttattattaattgactactcaggtaaaattctatctgaattgaattgacatcattgatcccattgtcagaaaagacagccctctatcccattcaatttattaaactgctaatcttctggacttttcttcaaagcttgtcagttttgatccaaaaaaacttcagatttcattgtgtggacctgttacttcttgtgtgaaaaacagtatggtttcatggaatccactcttggccattgttaatattgtacagataggcacacaagcatttaaatatgctagcaccttattgcaaaaaaaaaaaagttctacttatattcattgcaatttattatagaaaatgttttctgaactgaaaattataaactgttgtcaataattcaggtcccaattctgaagtgtattgagattaccaaactgtgaagcaggaacaatatttattctctacataaagaaagaaaagaactattaaatgaacttgatattataagaagcacttcaggttgtcaaaactcatattatgacatctataatctggcctaaaatcacaagcaaacattccatgatggaatggcagatcatgctagatttgctggttattatcagttttattttacgttacctaagtagaatttaagcctttcagttaaaatatgactcccaagcaaaaggaagaggattaatggattaactattgtttgtgttatcaataatattggcaataactatttgtctatggtgctgtgtcagttacaaggcactctgccatgcattcttccatctgatcctcaccaaagccttggagatgcttcaagccaaaattgttattattctcattttacagatggaggtgaaggaactgatttgaggtcacactgtggtaaatgttcaacactaatctctggtccaggtccagtccagatcttctgatggcaaaccttataatcattccacttcataaatggaacacttaggtccaatcagtcattttctaaatgtgtatttactgttggtcacaagagtttgtgtgacactgtgtggataattaaatgccatccaccatctctactcggaaaaacccaagggtgtgtcagttaatcagtcttaacaggaaagataatgtactattatcattatggcaaaagtacacttgaaaatacaacaaaggatattgaagctattaaaataagcttcttatccttagggaaactatttcaacactagagctatcatcaaaagtccttgagacaagtaacccaggagtggaatggttatgattacactttataagcaaacttaaaaagatatcaggagctgctttactaggcccctgctatgaagtgaaaactggagaaaaatctacagcaaagcattctagcctgaggatgtgtactattttgcaacacagcagactgactacagccaaatattttcattggaaaaatgtaaatgaaaaatgttgctcaattctgctacctgggtagtacataagacatgtaatttaaattctaatcagggataacaaaaatcctatgatacttattttgcaaaggaaaatggcagtcctggcaaggttataagttagaaaattatattttctttgtgtaaatttgttctttagcttcattcagtaatcagaattatttatttccttattcaaattgtaagtgccttctaaacccgagcctactactattatgttgagccatgggaaattgccaatatttgactattttagtccattaaaatgcagtttcatatggtttaaactaatatgtgccaaagcatgaatagaaatacttgcaggaatactgtcctaagtataacctcagatgcacacagtattttagcaaaagtatcaatgggaaatcaggcaagtcctttcactgaaacaatttataagtataataatttattttgtgaaggccttttctttaccaaattagtaatatggtgaatattaaactaaacctgagtcatactacatttgtttttaaattttgtagggaaggggggaatagcaaataatattttatgctagtaatcaggcattatatcagttgttgtaaggaactacatgaaagttggtggtatacaggttaccagtagtaagtttgggaactgtgttgttttggctcacagaatataaagcgtgtatgtatatacctgtgtttccacatagacacactctgttacccttatatgtattgtataatcacatgtgtagatgttcattgtatctggagtgacagttgacaccttttaggggcattttacatgttttaaaacctgacatccacttacagcacttatctactactctcttcaggataaactacctttattgcaagacttttgctaaaaattcttagattatgtcaagggaaaaaaatcctctattgctttttaaagaaaaaattatcagaatgatttaattttgtgttattttttatctccacattagtttgttatttcagtggttatttcagttaaagacatttttctcttccattatttcaatttgttacattgtatccatttatctcatagaaagataaacttttgtgttgaattagctgtggaagaccagctcacacattaatcactactaagcaaatgcgttacaaaaaagagaggacaacaaaaatgagctggaatacagtttcagttcaaccaccaaacgatttgatatcatgaataaatttcttgggtatatgtagccagtaagtagacctcaacatttagctatttttttcaataaataaatattgagcactgtctttatggcaaacactgtcttaggtgcaggggataatggacattatgcttttgggggattagataagagaggaaataagtcagagaaaagatctctagcacagaaaagtctggttacaagattacagagagagagagaaaaaaaaaactgtagtgacttgtctagggaactgtgtggttgccacatagaaaatgtggaagggagtgatgggagacaggctatgttcctagcaattgccttgactcaccataattatttcacctactgaataactgaataaattgagtagagaggctgcttgtaccaaactgtaaaacagtttcaggatgagaaaattacattttaaacatacacttagggaaaacaaaaacaaaaacaaaacacctgccttgcagaaacatgtcatagaaacagattttaggcagaattatttccctgtacaacaattgtgattaagtaaatgttaaaataaaaagaaggatgtttagcagcataaggaatagaaacatttggagttttagctttagcttatacaatgcatcctgttttataattgttttccaacaatgtttacataatgggagggtcactctttaacatgaggggctctgtcactagaattgcagtgtgttagcccctcattttctccagtgtttttgtaaatctttccattgacaatcttttaataatttccaaaacaatcgggggtaatgttcgaattctaagttcttgtcataaatgaatcaatccagttggcaggagatggatgtagtctttttgctggtgttccgtgctaagaaaagcacacacatttttcttgagagtatggctagccgaaaagcatctgagaattgatggaatcctaaggcagacagaaacgccaaaagtcaagtaactggttttgtctccagcacttacagtttgttgtctgggtgccatgacataccctctactagttaattccattaagcaacatgggccatttaaatataggcaaaacaacaacaaaacaaagcaaacaagtaaaaactctgtgaccacagaaagagcctgtaacatagacagaagactacaaatagtgttcttagaagataaatcattaagacagtagcaaaatgagaaggaatagtgtcctgggcaacataaagtgtgtgtacccttctacctgcacaaacactcaactgaaatttgccaaggctcactagtgtctttgaggcaccctagagaggggaggctagaaataaccatcatcctcagctgttccatggtaaggccctacactaggactcagaggagagatagtttggaacattttatccctatcagtggaaaatagcacagttggtgcctaacttcctttcgttgaaaataacacaggtaattttttagccaaatgagatttttatcaaaaaagcaagcaaaggcagaatgtgaaaaggagctgatatcagtaattccaaggatactaaaatttgttttaaataataaagaaatagcatcttcaggccctttagactttggactccaaaattggatgcagatcaaataggatatttatatattaaaaaatcccaagagaacttgtacagcataaggtaaatacaaatcaaggttgaacaggtataaaataattaggtcaagagcaatcagcaaaatatatgcagaaccaaacaatactttgatattctggtctggaaagagaatttggggttattctgaaaaatactgtcactacaactctgtccagaacccacagctgcagaaatgagtaaacaagtcatcttattagaagactgcaaggttaaagaacagctaaagattcaaaactaaatgacattcttgttagttcccattgatacgattataactcacacaattccctaaaggaaaactacaaaaaggatgtttcttgagataggaatacaaataaacttttgcttgtttgtttgttttgttttaaatccagtgataagaatgaatgttttctgtatttgctttttttaaaaaaactctatattttatgtgcagacatttaacataaaatcttttcccaatgtctttcttagatgattaggtagttgaaagacgctactgtttacgaggcattgctaaaagcttttgggttccatgagggagagggccatgacctactcctttgtacatttccccactcctccgtttacatcacataaacatatatgtatggtcttccatgcagtcagccaaatcagacaaatcatgcctaggagttgaaagtgggaactgatttgtctagtttgaatattctgattagtgaactagctagcttagaattttgtggtatttgcatatgtcattcatttatgtactacagctacacctaaatcccagaaaaatcggtaacaaaataacctattattctagatttaaattttaaaatccacataagaatattaataacacaaattatttgtatgacaatgacttctatttttttcatttcaccctcagagatctatatacttcctctatccaaaaacaacacagaagcaaaatgttacagagacaccagaatgttgcccagaaaaccatgcattaattactcaagccaggaaattcccaattttgcaactctattttatcatttaagagagatctttccacatgtgtgttctaaaaaagaacagagaaataaccagtcctctgtaacttagcaaaaatacaaattggtgtttccactttgatttctctttttgaaataaattttcagcttgactttcttttgcctcgggtattctggattatcattttgtagcatctggataattttacattaacatctggagttgagggtctttttatttgtcggatgcatatagaatacttctgtaagaaatgtattttcccagctgctgtttattcattttaaagagacatggttaagtaagtctaacagcctccttaggaaattcaattcctaaattccttaggaaacacaaaccatgtttaatctgaagtcctgccagtctgttttctctcctaccagcttttcccatggcagaaatggttgagatctgtacagaaggaggactttagtctggtaacaggtggtgttgctgagtgcaagggcctttgaaatcaggcctggtttggaatcttggtccagcaatcaatagctgtgtaatcttaggtaactctttgaagtttagtttccgcatctaagaatgaggaagtataaatacatatctgcccacgttggttgtattaaatgagataatttacataacacatccgactaaggtgcagatgtaataaatgacagctgttattatcatttatttcagcacgttgcagaaagcaacttacaatttcttcttttcctgacctcctagggcttttatgcatgcaattagcaatttgggatttgcacaaggtttttccagagtacaagatttttgagagctgtgactgaatcttattctttagaaacttgctctttgagtggaggaaaaggaagaaactaagttgactaatgacattataaaagcaggtagagaatcatttctttctgagcttctgtagcacaggctatgaagtgtgctagtaaagtaaatacaattttaagcaaagtttcagaaatcaccataataaaataaagtctgtaagtcccagctattaaactggcagggacctacattcattaaattaaatgcaatgtgcaatgttgttcgaaagttgttcaaaatgtttttagaatttttcttggagttgattgcttttataatgatgacttcacgtcttgactctcagtgattttgtttgtctccttagccccaaaattattcaccttaaaagatgaaatttggtaatattaagacagtcaaaggaatgtcctgaagttctgatcacagctatgaatagttctaaaatcttctaaatatttttgggatatgtatagaaccaagatgatttgtgtgaagggtttttccattcacttagttgtattatattttaatataattgtttaaaaaagattcatgttatagtcacagattaaaaggcagtttttaaaggagatgaattaacagtttcagagaaacaattttaataacatgcattttatacatttatttattctgaaaacagtaattttcaatatactattttcttataaccactttaaagaaattaaggacttgcaggttgtctggttttttactatttttcttatccatagcaaggttggtgctcaataatactagatgagcaactgaatgaagagatgacaaaaataaatgaatttattaccactgcatgttaaagaagtgtacttttttatgcttgtctttgagaaaagtgtcaaggtggcatacatgacaaaacacaactttaaaatgacaacaaaaaattaaaatttcactgaacaaaataaaataaaagaaaaatgcatactagctgctcatctgggatgagttagttattgcaattcaacttgtaatttaatgcagaattttcagacaattagggccaaaaaagaaaatgttaaattagctagtgtctgacaaagaagaaagctttcaaactttcaagacgaacattttattagcaatgaattctcagagcaaatttaatgcagtccttatgtaaggatgtcagatagaaaaaagtaaaaggatttcaagcatcactagtgcaaaggacaatattacttgcttatttctgcagtgtaacaaagatgaagatattctcttaaattttttactcaatgatgattcatgtgtctctgagaaactaagataatatgatttaattctgtgcttttgggatagtctaacttaattcatgaaggagtacaggggatgggcgctttgtgtgtccactttgtttgtcactctcaaatgtcagatgtgcaggcaaattctcagagttaaattacttgacaggaacttaagcatccgtatttgttgccaggtagtcttctgtgtggttaaagtacagaatgtactcctacaaaagcagagaggcggcccgttgccacacaaaagtgttttttcagatggcttatggttagaaccaatatatttttctagcatacagtttgagtgataatagctcacattccccgatcacatgccttgtgccaagtaccattctaaatgccttgcatcttgtaactcattaaacctttacagtaacctcatgcaatgtacactcttgttgttcccattttgcaaataagaaaactgatgggcaatattaccttgcccaagtttatacagctggtaagtggcagagtcaggatttgaacccaggctgatggtatagtctgcgtgctcagccacaatcatgaacttaccctcaaactgcctgtgtttgcataatcatgtggatactacaggatagattctttagactcatcttatgtaggaggaatagtgacatgaaccatcataagaggagcattaactaaactttgcttgtcttacccatgaaagaacatcagtgtgactccctgccaaatatctgataatgaaaagaaatgcattgtgatcagcaagataaaatgaagaaaataaaaatgtacactgaaatagctgaacgaatgaattaacaacctattttatagcattgtgctggagaagaatgctcatcttacagaggtgattgtgtctaataaaaactgcactggatttgaagtaaaaaataaaaaacaaaaactggatctaatttccaattctatcactcgtagtctctgtaacctcctagtctctttcactgggatcttagatgtgccttcttagaagctaaattttcttatctgtgagttggtttacgattccttcttcctctatccactcactttattgtgatatcaaaataagatagcatatgtgcatatccttggagattttaaagctatctgaaaatgtgccatatttaaacatactgaacatagttaaaagacatgcatctgattaatgtaaaaactataccaatttattgtagtccacttggaaagacaagtagcttacttaaagatctattttgttgcatttaaagttggaaatgaacctgatataaatctcttcccaactactgtgatcctgtctttaatacaactttaatagactggaacatatgccaagagtatacagtcagaatctctctaagaatcaaagactgatgagaaacctctgaaagctgtgaaaagtgtgttattgtttttaattgcttccctaaagaatgagagaaggcaaagctgggaccctagtggtattgatgggctgttgctccttatccatgatgtgtaagagtgaggaactaagtctgaaaactttttaaggggaaaatagcagtatagcatactgaaagttttgttgtaatatttaaaaatgccaattaaaaaatagtgcaaaattgtataacgcaattatatgagaattgttttgggatcagcggtccaaagacaaagaaagtcccctcttctctccatgttcttttcactgctagcagcaattaacatttggcatatatcctcctagatttcattttttatgcataagtgaagacatatcaataaaatgtgttcttgttatattacatagttcttgttttaacacaagtggaattatcctctacatggtgtttatgatttgtttttgcacttatgaggttgtgtttaaaatgttgtacatttttttaattttagcattggtaaatttactttgtttttattttaacatagtattccactgaaatgtaattatactgcaaattatttatcatatctccactgacggtccttcaggttatttctaacttttcttgattataagcaatgttgtaatgactatcttgtacaagtatgtttatactcttccattaatacttatgtaaataaatctgataagggaaattgtaggctaaagcatatattatacattttattttattttttattaattaattaattaattatttatttatttttgagacggagtctcgatctgtcgcccaggctggactgcagtggctcgatcttggctcactgcaagctccgcctcccgggttcacgccattctcctgcctcagcctcctgagtagctggaactacaggcgcccgccaccacgcctggctaatttttttgtatttttagtacagacggggtttcaccgtgttagccaggatggtctcgatcttctgacctcgtgatctgcccacctcggcctcttaaagtgctgagattacaggcgtgagccactgctcccggcccacattttatttttgatatgcactggcacaaaattgtgtgaagaaccaattaataaatatgtctaaggaatatagtttccattgttttaattatcaaaaaattatcacttacatgggctctagttatacccatgatatgaccaatttaagaaacttgaaaatataatttctagcacgtgtatactaatgcgagatagagaagttttatttacaaccagaaattgttgggtccataaaagaaacaaatatgtctagaacattttaaagttgccagagcagatttcaagatattccagcctgagtccctcagatatgtattttggtgattgtaaaaatatcaaaagaaattatttgtgtccgaaagtcacaatatgcgtgagtcatcaacacaataagataaggctaaaattgagtttcagatattttgggatttctgaaaaaaatttataaaaatccataatgtaatcatttgtaaaattttaaagtttatcattacgaaaaggaaagtcaaaatcaaatgaaataaaacaagctttgttccatgggatagtgtcagtcataaagacttactagttaggtgctaattcattttgagcttacagggttttatcaggatcagactaagtaaaaatgtataattattttataaataaaaatgttttggggtttcagatttaaaaatcaagagtaagaagttttacaatatttactaaagattacgattagtataccacaaaacatctgaactttagatattatttatatgaccttaaaagtcagacctttccctgccaatgacttaacttctgtctttagtgctattttgtttgaaggcttatttatctgctatgaagtgatttttctacgactttctacatgtctcttcacattgggttaggaaatcttcaaggaaattaatatcctcgggtatacacaaccttttgctgtggtatttgctctgacatggaacaaaggcaaaagatacgggaaaatgtagaagtgggcattatagaagaatccaaatgtgtctaatgtcttcttcatactaattccttctagcctttatttaaaaaatagcttctgaattgcaaggatatttttaagccacatgaatcagtatgccccttcagctggacttttcaaggagcctgtgaatgctgaaatgattaacattatgtgaagctaaattgcactgaaccgtggaaccatgtggtgtggcaatagtgggtggggagacatattagtctagaggtccctgctgagcaaaagacaaagacctccttctccattgtcccgcactgatggtgggcttgggatgtattttcagaaataattatttgcagggaacttataaaaacaaatgaatcaccctcatcactgtgcttgttccgttttgggatgtttgtctactagactttctaaattgggagatttagaaattcagtaagaaagatatttaaaaaaattttttgaggtcctcagtgtcttctgcaagtacactttcaatttttattacagacagactctcttgatgctgttgtttaccattgcatttttatttaacttgaatattttaatttagcatgagtcattcccatggattagcaactttgtatgctagcatatctagttgtatcttctgtgtgttttcaatggtgtgtctgctactccaaagatcttcctgaattttacatattagaagtggcatagcctcatgacactttatatcaagcaggaagttctggaagatgatgctaacaaatacctcaaatctggaaattgtaggctttagaaaaataaagtcatcttgttagtgaatctctatattagactttctaataccttataaacaggttttcagaaattaattatatttatagcctcgagaaactagggaaaaagctggatctcaaagacattattacaaagcagtagtaaattataaacaatatattttgaattcataattaaaattaacgagtcaattttctgaggcattgacctattaaagatttatgagttacctaaaatcccaaatcttccctgaggtaatagcttcagttgagataaagggaaggtatcttatttgtcgcttcactgcaggaaaaaataaaatttgtgattatgactcattatcatgatgcctattgcaaaattacagctcactcttaaaattatgtgaaaaaagatcattaaatgttttagacatttcttaaaacttataagcaaaactttcaagttttttaaactgatttactggttgtatatgtagctaattgactatgaaaacttgaagcttaactctttgtagaccttccatcataccattgctttataaattattaccagaatattgaaggaaataaacttttttctaaccatatttatgcaatcaatatttattaggtagtttttgagaaaatcttatatgagaacttattccttgtataccaaatgtttcatggaacaccaccagcatagacatttttgtttactctgtgcaactggatttcgttctggggagcttcaatttgtacatgagctcattttcacaaaccatcttaccgatacttagagtccaaagtgaaattcaggaactatggcccagcaagctttcatgtgctattctttgcttcatgactttggaaatctatgggagaccctgtatcactagacagaatactgaaaagcaggattacatatgaagtttaccatctgatttttttcctaagggtttttacatgaacgtttattccttgtctttttgtgtggattcagcaatctccaggtttactgaacaggggttgtgaagggcagttgttcacaactgagctcattcccactgtgttgatatactccggttcccccacatagctccaccccgctaactcccaacctcatgcatagctccaccacactattgggcttgaatctaggctctgccactttctagctggttcctgagcaagttctttaacctctctgagcctgtttcctcatccacaaaaaggatgaagaacaaaaaggacgaggcaataccttcttaacactgataattaaataagataagcttaaattataaaatcagcacagagggaatgtaaattggttcaaccattatggaaggaaaaaagtaggaaggttcctcaaaaaattcaaaatgggactgcgaggccgggtgtggtggctcaagcctgtaatctcagcactttgggaggctgaggcaggcagagcattttgaggtcaggagttcgagagcagcctggccaacatggtgaaaccctgtctctactaaaaaacatccaaaaattagccaggcatagtggtgcacgtctgtaatcccagctacttgggaggctgaggcagaagaattgtgtgaaccgggcaggcagaggttgcagtgaactgagatggtgccactgcacttcagcctgagcgatagagtaagactctgtctcaaaaaaaaaaaaaaaggaactaccatatgatccagccttctcacacatatatatatgtgtgtgagatatatatatatatatattcaaagcaattgaaatcaggatctcaaagagatatctgcatttccgtattcattttagcattattcacaatagtcaagatatggaagcaacctaaatatctgttgacagatgaataaataaggaaaatgtggtatatacatacaataggatattacttagccttagaaaaagaaggaaatcctgccatttcaggcaatgtggacaacatgaaggacattatgttaagtgaagtaagccaggagtggaaggacaaatattacatgatatcatttatataaggaaactaaaatagtcaaaactcagaaacatgagagtagaatggtagttaccagggtctgggttggagggggaaacaggaaagtattagtgaaaggataaaaagttttatttatacaagatgaattaagtcctcgagatctactgtaccgcatagtgcctagacttaacattactgtatcgtatgcttgaaattttcctaacaaagtcaatcttacaaatgttcttatcacaaaataataataataaagagagtgagagaaaacttttggaggttattgatatatatgtggcagagacggtggtgatggtttcgctggtgcatacttatctccaaactcattaggttgtatacatcaaatacgtaaggctttttgtatgtcaatcaacctcaacatgttttttttaaagcagtatagaaatacctattttttaaaattattacaactgaaagccttctaacttgtggtgttttcttgaaataataatcgtatcttggttaatagttgagatctaaaagcttaggcctaaattcagatagaaagcttggcacatctgttgtaagttttgaaaccaggtgcacagaccatctttgttccagacgatcttctcagggatgtttgtaaagtgaacagccttggaaggtagagatgatgtccccctgggaagcaaagggtaggtttactcatagcttgggaagagagagatggtgtctccctccagatgaggggaatatatttaccacccataagaaaagatttgaacccattaagctgagggttcctcttctgtaacaccacccactgtgagtggaggcatcagctggcctgctttctatctctctgcaggaagtagagcccaggcaactggcaccaaatatgccaaagcttatgctgcttcctgggctgtgagtaataaagtcccttttccctcttttagaagtctcatatgttctgtcagcagccaccaagctgtgtcaggctaaattgctgtcttgcaagtagaataaaatcccagaccctttgcaatctttttcataaaaaaaattttaaataccatatatttaccgcatacagttcagaattatttattaatagtatattcacagagttgtgcaaccaccaccacaatccaattttagatcatttcaacaactcaaaaagaaaccttgtacacgttaagtgtcattcctgtacccactccctgaaaatctgcttgctctagctgtgttggattgatgtcagaacacaggagggaagggcaaatgcaagggagcaggtaagaggctttcacagcaactcgggacaaatgatagtggcttggagcagggtagcagcatgaaagtagtgagaagtggcggaatagaagatacattttcaaagtggaaccaatagtatttcctgaccaattggctctgccaagaggatgtgctgatcaattttccgtgaggtgtgagaatgagatggctgagggatgagtccatggttttggcatgagcaaagggaaggattgagttgctttgaaatgagttggggaagactgtgggcatagcaggttttgacagagaagaataggagttcagcattgcatatgttaactgaaaatgtctattagacattttggtgaagctgaatagatagtgtatagtattctggaattcagatgagaaatgctgcttaaagatacgaattagagaatttaaaatcatgagactgcataatatcacccaggaagtacaagaagacctagaaaagtaacagtctgagaactgagctctaaggaacatctacctttagaggtcagagagatgaagtagagcttgtaaaaccaaggagcaagcacacacagttttggacacagagatttcccataagagcattgcaaacgttacatattctctttgttggatgtgaaaataatcttttgggaaatgtgtgcttagaccttgatgtgatgcatagggacaaatttctaattctatttgcttcctaagaaaatgaaatgttactaaataaacagcgtcagggcaaggagtccaggtccataaagaaaaacttgcacagcatggtgaataaaattaataatggtgtattgcagattttaaaattgctaaaagagtaaatttcaaatgctctcatcataaaaaatattagtatttgagggaatgggtatgttactagcttaattgaattattccacattgcattcatatattataacatcactttgtaccccataaatttacataattagaaattgtcaatttacaataaaaaataaaaagccatcaaaaaacgccaggcaaaaatatgtgatatacttatacccatatttaaacctacaccataaattatatttaaatttataattctgcctgctgctgttttcagtaattaatatcattaagaaagcacaggttaaatcaaatttcaacacagtatcatttcagtataaaatctcatattttgaataaaacaaacatatctttacacattattaaatgaactacgctgacaaattttgtttctttttttgagaaccagaaaaacaattatacttagatgggccatctaaaatgtccttccagcttgtggagtaggttgtgtttgtttttcaatgaacatctgtttgacaaattgaaatgctaattatgatttatcatttccatgacatcaaatatccagatagtaataaacgttgatgactaactatatttttcagtttcagccagatgtttggcatcacgtaagataccaccttagttttacataaaaataaaatgtttcttgagtctggcttatcataatggggaggaaactaatatgaatgaagcagaatggttcattttttttctcaatgtgtacaattctactggtaagacttttacaatatcataaataaaattgtactttaaaataagtgtctttcaaacttttacaaatacaaagaaagccagaatcaaaacccaattttgaatatcaagtgttaaatatgaatatcagaaactgaatatatcatcaatacaaattttaaaaaaaataagtttgtaaattcagagtttatccctcagatgttatttcaagcatatatcatagtgacatatccttgaatatatatttaagatccgatagggactgggcacagttgctcacaccagcattttgggaggctgaggcagatggattgcttgagctcaggagtttgagaccagaatgggcaacatggtgaaacgccaccagaaaaaatgcaaaattagcaaagtgcggtggtgtgcacctgtagtcccagcgacttcggaggttgagctgggaggattgcttgagcctggtaggcagaggttgcagtaagctgagactgtgctactgcacttcagcctggatgacacaggcagaccctgtctcaaaagaaaaaaagaaaaatctgatatgataatttagaatatgggtcctcagggccataaaacagcatatgctagtttgttggcttttactcaccatgctgtgcactaaaagtaaaaaaatataaagtaaagcccattcttttaactgagattttgtgccctttgacataatctctccattcccacagccctcagcctctgtaacttctatttcactcactccttctaagaatttgattgttttacatttcacatgcaagggagaacatgtaatctttccaaatgacagaattttcttttttaaagctaaatagtatttcatcgtgtatgtgtacgacgttttctttatccattcatctgttgatggacaggttgatttcaaaatgtggctaatgtgaagtgctgcagtgaacatgggagtgcagatatcttttcggcaaaactgatttcacatcttttgggtaaatacctggaagtgagattgctagatcgcatcgtgattctacttttagttgttttggaaaactccatgtagttttccataatggctgtactaatttacattcccaccaacagtgtacaaggattctgttttttccatattctcgccaacatttgttatcttctttttgatattacctattctgacaggtgtgagatgatatctcattgtaattttaatttgcatttccctaatgattagtgattttttcatttatctcttggccatttgttagtcttcttttgagcaatgtctattcagcttccttgctcatttttaatttttttttcttcctcttaagttgatggaactctttatatatttgtggatattaactttttattgaatatatggcttacaaatattttctccacattcatagtttgtctcttcacattgttgcttcctttgttgtgcagaagctttttagtttgatatgacccaatttgtttgtttttacttttgtggcctatactttgggggtcaaattcaaaacattattacccagatcaatgtcatatactttctcccctgtgttttcttctagcaatttggagttgctggccttatacttaaggctttaattcatttcgaattgagttttgtatatgatgtgaaataaggggccaattttattcttctgcatgtggatacctagtttccccaacaccattcattgaacagactatccttttctcattgtgtattcttagcatctttgtcaaaaataaattggttgtacatgcataagttgatttctgggctattatgctgcattgacctatatttcttttttgccagtaccatgctattttaattaatactacaatagctttgtagtattgtttgaagtcaagtagtgtgatatctttatttttgttttgtttgctcatgatgattttgactgttcttggtttgttgtggttccgtgcgattttaaaattgttttttctatatctgaaaaatgacatcaaaatcttgatagtggttgcactgaaatctgtagattgctttgggtattatgaacattttaacaatattaaattcttccaatccatgaacacaggatatctttccatttattcatgccttcttcaatttctttcatcaacattttacagtttgcagtgtatgcagatcttttcaactccttggttaaatttattcctaagcatttaatcttttttatagctattgtaaatgggattttttaactccaagtatatttcatagatggcattgatacagtaaaatcctttattctgtaaatggcatttatatagtaaaatcttttccatggtgaatgattattagtcttaagtgaaatacaaagatttgattttataagtgaaatatttcttaagtaaactatccttggctgccagtttctttcttaaaagtttaatatttcccagcaacttcctgtggttgactcttaaggatactgaagctgaaaggagcccagcaattctgggtgatggaggaaatacgtggccaggctctgctgtccgtatcttcctcaattttcaacttgaattttatacttctactctgacctttaatttttgtgatctaatttccttttccccaataatatttgtttttgaactagtcttcctcatgccatttaaagaaaaatttcaggaataaggaaaaacacaggagtattaaaatggagaaacatcaatattgttataaacagagcaccccaaaataattattttgaaagagatgcactcatttgaatttataaactctggaatgcttattttaaaattaactaatgtgttaacctacatacaaatttgtatttttacttgaaggaaaagcagcattgctggtagtgcacatgtgcttctgtacatacagattgtacacattgaggatgatgtttatgccataagagaatcatttcctctctttttatcagggccattacatcatttctcaaatagaccactgttaggaagtagggatatataagtataagggaggagactcaagtaaaaccagagtggtgcatatcctacaaattgagaataaggcatattttatcttttaaaataacatattttggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccaggcgtagtggcgggcgcctgtagtcccagctacttgggaggctgaggcaggagaatggcgtgaacccgggaggcggagcttgcagtgagccgagatcccgccactgcactccagcctgggcgacagagcgagattccgtctcaaaaaaaaaaaaaaaaaaaataacatattttagagactcagtaaaataattttaaaggggcagaagtacagatgtagctgttaggaggaagcattatttcagctacagcacattattggaggataggaagagcatatggtattccagtgaaagagcttaattataatagagcagaaaggattagaaacagaaaagaaggtggattatcaggaataaagtcaaagaagggactgaatattgatcagattttcagaaaaacctgcaaacaaaccccaccacatactagcactagtcataggactgagatttgtcaaagctagctctcttctggtgcactctggttcactgtgaatataagtgggccatagagtgtgaccattgtggtctctggccctaggccatggagtgagataattgagacaagagaagtctgtatatcatctctccacataagcaatagagctgattgggctgcctgtaaacaagattttagagactcacttttctttttcttaaaagactgccacacttagccatctgatatggaatggcatctcctcttaatgagcctgtgtctttatttgcaccttatcaaactgggagatactgaagatggcagtgatgctgatagtggtgagacatggaagatgtagaggaaacctacaaagaagcctgagataggagagaaagggtaatttttagaagtagattgggagaactgcattctgggcaataaatattcactggacttacagcgtattcctttttttaaggaaccaagttcacagttgttagaactacaagagcacaacattacataatcatgacatcaaataagcataaaaataatgcttatttttaatttttacaggtgccattttataaactatctctataaagagattaatgttagcttcttgttttggaaataagataatgggagggaaggataaatgaaacagttttgttgccatctctcattgtgagccagtttagaaatgaaaacaaacaaacaaaacaactcttaagcccaacagcaacattcattataattttcctaattacactcccttttctttttgctaagaaagaacggttgtatttttgtccttaatagaaaagggaacagtgcctaaacaacctattataaattcttctgggaaagcatattacaaataattgaaaacaaccctgattctgtgaacttggcagcaaatgtataaaagaaagcaattcagccctggcccctggatgattgattaaatgttttattctttttacctttcattcatgctgtgtttgtcaagaggaaagagaaaaggaatgttgtgaaatgaagtccactttagacaaataacttacaataatgatcagtgacttctcatcagctgtttattcatttttcttgagttgtaatatttcttaatattagctatcctgcatggacccgacagaaaataaggtcctgagttttagcttgtccccaactccctgccagctaaccatcaacacaagctgtatctgagcttctttgagggcatggccctgcagctccctgtggtcagttattagtctgagtccagcaaaggaacaagaacactgtgtgcttgctaaatctacagaaaacttcatcttctggttgtgtgggaggagaggtccctttgtgtactctgtttctttgaaggaactagggatctgttggtgctgtacagatgtcgaggtgcacagagccaacatcctacaaaactagtaaatagatgattaggatccaactctgtacagaataatggtaggaacctaaaccttggggtactgtttacttgtatcaaaattgttgttgtcctataagccatgtaaaattaactacaaatctcctcaatgaaacactttcttagaactttgatatttttaaatgatatctcaccatctgtgtacatcacaatgttgagctacaaatgtggtggctctaacaaaattttaagtatgaagtcagatgtatagaggatcccttctccatcacgttcttctgtttttcatttcccgcttctcacaaactactccccagatgtcaataattctacaatctcctcttcctacaaccttcgtgttggtccttagtcgtctactctgatctcaaccgcaaaagtcaggggatgagactataggccatccccagagcaacagcctcagcacctcagcacagatctggaggggatttgagctagaaagaactctgaccttactcttttttttttttttttgagacagagtctcgctctgtcacccaggctggagtgcagtggcacaatctcggctcactgcaagctccacctcccgggttcatgccattctcccacctcagcctcctgagtagctaggactacaggcgcccgccaccacgcctggctaattttttgtatttttagtagagacggggtttcactgtgttagccaggatggtctcgatctcctgacctcgtgatcggcccgcctcggcctcccaaagtgctgggattacaggcgtgagccaccgcaccagcctctgaccttactcttaattgcttgcatgaaaattggatatggataagaatgcaaacccaagaacatgtcctgctttccttgatgcacattctcctattgatgttcagtgaccttagcatttccagaagcacctctttattgtggatggaaacttacttattcatgttgtctcaggctgtccaggttggtaacaggtaactgctataaagggtggagcacatcctgctaaatggagagatccagtgtcatttacattttttttaactctttcaagggtaatggcaactaacaatagtttctcctgtgtgctagatattgttctaatcattttacataaattatttcttttaatccaccaaacagcactataagatagatattatttttatttacctttgttagagaaaactgaggtatagagagattaagtaaattgtctaaattcacacagatagtaagtggaggagccagaatttgaacacaagcaatttgtctccaacaaatttgatcttaaactatggttaactctctgaacacacacacaaacacacatacgtacatgcaatcacacaaagtatcaggcacatggggatagacaatattagaaaagcatatacatacaaacatccttacagttgtacacatagactcaggtttataaacccactgaagtgaagactcatcatttatgaaaatatacaattttgttctgcaaaataatttaattttttaaaattccttgtgcaatgagaaaagatcagagaggcctacagtttccttttacagagctaggccaggggctgtatttagagtaattgaacacatgattttacttgaatgcggagaaacttgaccaactgtgaatatgcaatttcactctacagatgaaataaaattaaacggggcaaaagtaaagaagaatggagactaggtaaagtgatggaaagagacaccaaaaaattagtcatgtgaaagcaaaactaagaggagagggaaaggtggcaaaagaagggaacattcagagaatgttgatatattgagaggtgagaatagggagttggtaggcaagtgtcagagtgtgggaggatggtgacagtcactaggaactccagtttgcatacacacaatgttaagaacattagaaattagctagccaatggaatgctcagtcttgaagagcttgtgtctctgcttaaactcctgtatgcattagtatgattccataaatttaaagtctctgacatcttgagttttaagctttctgaacattaaatcagtggaggctgctagtagctatcctgaaatgctgcttctatacatatgagtaaaaatccaaattaatgtatttatacagcttttcatttgtgtactcgtaaaatacacacacacacagagacaattcaacacacacacacacacgcgcacacacaattcaacttttctctgaagaacctttgagtcagagaatgagaatgaaggagactgaatttctcttttaagttcctgtctaggttttgttccaatctaatgacacaggatctggcactgtatttagacctcctgctccaagattttatttttattttaaacaagtgttcccacacggggactgaaaacaaaacaggaaaatgttgcttaagttttcctttgagctgctgttatctgactttcaagtgtactgattgttccgtctcaccaatgtaggtcattgtactctcagttactttgttttctatcggaactttctctagcagctctccacattaagggagatcatgttatttcacatatttatttttgttattaacatattttcttcatctccctataatttgaggttttagcactttcttctttgtagaatttaccataaagcatacgtatttttgaaaactagggaatagcttttacttactaaagtacttaagtactaaacctatcataaccaatttcatttattaagatgttagtaagactttaggagttgttggttcttttccggagaataatgctttagcccagcagtccccaacctttttggtaccagggattggttttgtggaagacagtttttccatggaattgacaggggggatggggagtggggatgggtttccagatgaaactgttttacctcatatcatcaagcattagttagagtctcataaggagcctgcaagctaggtccctcacatgcacagtttacaatagggcttgtgctcctttgagaacctaatgccacagctgctgatctgacaggaggtggagctcagacacctccttctgtgcagcctggttcctaacaggccacagatagtactggtccatggcccagcagttggggacccctgctttagccctcaactcttaggcatgtttcagttctgattttggtcagcatagagctttccttctatttaccaggagggtctctactgatatggatcaatggcaggaggtgatattgggtctggaactatcctttggcttagtgacatttgtactctaatctgcctcactcctgccccttctcaggggacctgggcaccgtcggatcccatgacaggtcctacatggtgacctagggcacggtaaaaagtctaccccaggaagcctagaatggatagaatacaaattcatccaacacaaattcatgaagaaaagccaagatctgcagaaaatcaaacagtaaagactattccagaagagcaacaggaggacgataaagaggagatggagttaaaatactgggtctgtcatagacaggattggaatggaatcccaaatcagatgatagaatgaagggaaggtacatggaatagactctcactagtggtgagctttcggtcactacaagtcttcaaaaggggcctagatgaccagttctttttcatccaacaaatgcttattgaacccttcctctgtgggtagtgatgggcacattcagtgaattcagactggaatcgaacacattgtaaccattaaatgagttaatcttatatgagttcatacatacagatcacatgcaagagtgtctcatatccagtaagtttgcaagaataactactattgtttttgtgtacaagatcttgtgtattgtaatttctgaaatagcaatgaggttggaatacatgactaatgattttatcctcttatgatatctctggttggggcacacccaaaacaaaatttggagcaatgcaaatgttcgaggagagtgagagaacttccttctggtgtttttctctaatgacttgctctgaagctactcctcttagattctttcctagctgtgtattcctatatagtcttagcttaacagcacaaagatttaacagtggtgtctgcatttgataaaatgtaaatgagaagctcccaaaagagattgagaagctctattttgacaactcttcttttatctgtgtaattattatatactttaactgaagaaagaaaaacacaaagataaatacaatatttcaacttcgagtactttttaaaaattatttgaaagcatttaaaaatagatgtaaaatgaactcctgtatgtcaaattcctttcagagaaaaaaaaaagtgagagggaagggggaaatttgcatttagtaattttttttgtttttttgaaaatttcaggcacttagtaatcactgttccttttgtacgtcatgcccaatgggaacgataccaggatctttcactcaattctgtggattacaggtcacccacctgggcatgtttcagatgaaactaacctaagctcatcttgagtaaggggcttagaagtaaatgctttgttggttgctttgagttgtacaaagcaggacgaccaccagaggctttctaagaaaaagaatcatagagactttgataaaattggaactcctaaagcagctaaggctttgcttctatttttgatcatttttaaaaagttagttcttctggtgtttggtagttccatagtagttagaaagcactgccacatgaaatctgctattggtagaaaaagaaaatgttacagccaactctgatacaacatgagagagagacagagagagagagagaagggagagaagagacatgttcttctttgaccagcaggaaaaaaaaaaaagctgcacaaaccttttaactagtttcactagcagaaaagaaaaataaaaatataaaatagcaaataatctttaaagaaaactgattttcttattatgctgaaatttattaaagactgttgtgttgactgaagaatatgtttaaatattttgtggaaggcaaagctttcattcaggaatgacaagtgcaaggactgtaattctaaagaaattaaagaaaagaagaatggcaatttaagttcagggacaattggaatcaagcagtaatgatttacagctttttaaaattttcaggcacttagtggtcagtgttccttttatgcgttatgaccagtgggaaggataccaggatcttccattcagttattatgggttacaggtcacccatccgtgacctgtggtcacagtgttaggtatcgaaagcataataccttcttatctaagaaggaaagacctgttaagtctaagcttaggggtagagttgtcaacgatacagtcatatttgttgaacagttcaagttgccatttcttgtattcttggaagaggtaagttaaagaaggttgtgcacagttcttgacattttattattacagcactacctttcaagccactcagtagtcatcggacatgtaagagtggttgttctatttggtcgtgtaaatttctagtgacagtaggaaaaaaaaaaaagacctttattaaagaccttccaaactaattcagtgccctacatgctgcatgaaaatgaggactttccagttctgagtagaaggaatattaaggcacctgaagggacaaatccatttataaaattatttttctttttgtgataaaaatataaatggctctgctagtatactaaaaaatataaatggctctactagtatatttaataatccttcattgatttacctaaacgtatgaagatacccatataatatttttaaaaataagttattgtagctctaaaataatttattagactagaataaataaatttatactagaatttatgatgaacagtcaataaatggaattaaaaatataggtaaaatacagttaaaatatatacaaattttaagtgatacatgcaatgcacaaattgtaaatgtttgattgaggaaagagctaattcattggaagctctagtccagtctatagtatttggggactgctattgatatgttcattcaacaaataattactgataatatagtatgtactgaaatcattatgctaaacactgagggtttacaataaataagaaaatgtataacctcattgaacttaaatctagtagcagacacaagcaagtaaattggcaataaaaatagggggagtcaagggagtttggataaattatagaagaagctcctagacagtccatggaggtatttgtgggaggatggaattggcaacacagctgagattttaaagatatataaagtacatctgtgtaaatggcaagcagtgagaacacagaaaaggtgtttgaggaaagggcctaaagataagatagaccatgacacagaaaggaaagtaaaaatgattcagtgaccatctagtagatatccaatacatatatttgagtgaatgagtgatagactgactatatgaatgggaaatattgaaatataaagaggaaggccagagataaagctctgaaaggtaagcatatattttaagacttcagagtacctaattttctgaatatgcaaatgagcagtattagaattaataaaaataaccctaaaaatgagaactcttggttggagaaaataacaaaatatgaagtaaaggaaaattgacagaatacttcaaaaactgtgcctgatataattggaaataatgcctggaaacagattgagtccataatcctgtatgtgttcattaaggccaggaagattcttggtaaggaaatgtctagtctgaaaggtctaaagattttattaatctgtataataaattatatcttatgaaactcttgtcatttatccagtatatttgaattacccgtgcattactgtttcatatattcatggtactttcatattttataacatttaaaaatatttcaatattccattgatttgaataagattctttaaattacagtgaaagctttctgataaggtatggtaagattatttttcagtaattatgctgatacatataataaagctactgacaattcataaagatgataatacacttagtacaaactgagcttcaatgggattactaaatgagtatgtgaggacagagcagaggaaaaggccaagggttgagcactgtggtgctctattatgagaaagttaggaaggattaaagttggcactgaaggggattgagaaggagtagctgaagcggtagaaggaaaacaagaacagtgtgtcctggaagtcagtggagtaatcacttgtctcaaatgctgctaataggtcaaatatggtgagaactgagaactggacatttcatttagtaatgtgaaggacgttggtgactttcccaagagcagtttcagtggaatggaggaagaccaatggaataataggagcattgtggaggaataaaccaaaatgtacctatttaccatccagagccagactcagagcctttactctgtgctagaaacacaatgaccaattgttgcattgttccctttccttgagctttctacagctcacctcgcttcttcaaacatgtacaatcagacctctgaatctgtggattccacatccatggattcaactgactgcagaagaaaaatgttagaaaaaaatctgcatctgtaccgaacatgtgcagacttttttcttgtcattattccctaaataatatggtataacaactatttacatagcctttacattgtattgggtatttaaagtaatgtagatgtgatttaaataattttgaaatatgtgtataggttatatgcacatactatgccatttcatttcaaggacttgagcatcctcagattttgatatccacaggaggtcctggaaccaatccccacaaatcccctgaaactataactgatgaggggtgatggtacttctttttttacacagtcaaaataaaagagattaggcttgtttttgttatttctccccaaataatgccatattgagcatgactggatttaagaggtccccagatgtctcagccactcatttacataaaaattctttgtccatatctgtacatccttaatctcaagctacacatatggatttactgttctgtctcctggtgtcagcttactttcaatttgttttacctgtttcattggcacacttgtagagattgataatacaaaaatgttttaggagagagcataccacacatcaagttgtcaacttcatccacttctgctacttatttcaaagtttctgatacttattcatgatctttcagtagccttcattctcccatccatccattcactcaagaaacttgtattgttagggaatgtattagaattatagctcttcaagctttccaaaacaaatgtagcaacataaatagacaagcataataatggaaaatcgtctatacgagaaatctaattattttaggcacaaatcattttttaaaatgtattctaaaataaaaatgccattgaggcacagaggtcttactaatctgtaaagcaaacatgatttatatagtatgcttacattagtaaatcaggattatttgggtgaacagagtataatattgatatagttatttggttataaaaagagatgtttctgataaggtttccccccctttatttgccttggaaaacaaatttcaaagaagagtgtcattttaaactctaaaaaaccagttgataaccatagtctgatatttgcagttggaatgaattcctgtgacagcatgaacatacacccaccaacatgtctgtaatagaaaccactttggaagacactagaggctgccacagatttctcaggtcctcacagcaagacagtggtggtcttggggatggatacatttcatcttccttgaagacagataccaccctctggctgtcaccccataggaaatcaggaagtatgctaagctatccagtggacttggaattacactgtgctgtgctagtggaaatatcctatccaacattatgatttattttgaaggagaaaggaaaaaaaaatacacacaaaacggtggaaggaagctgcacacaacatcgccaaacagctggcttgttttatatcccagaaacagcttgggactaactatattcacaagatctcttggcagagtagcttgatgaaaataccaaagctgtgagaagtgttcttttgctgaatccttcatgtagctatcacacggtttattaacctaaatgagaatatgtacaccttttttccaaaaaggtcctttgtatgtttaagtgagaaacttactgattcttcatacggcacaaacatgattcaccacagcattcacaccaaataaactctaataatgttcagaaactataatcctagacatgtagcgatttcctcctttctttcaagtagtatttttggggacagtcaagagagaatttgatagaaatgtaagcctgagttcaatggcactggtgacttttttaggtgccaaggttaatctcagagggaaattagttttaatggcttcatccatatatttatccattcttttaacatttaactctaacctccttaagccaaaaatataactcaattctaaacacatttctggctcacctgctaggtgccagaaatgcggatcttgaggaatatacaagatctgcttcactcttttagaatccctgcattagagaggattcagtattttcagattcatattttagaagacattgcattctattccttactaagcatcccaggtagattcaattaggtggaacatattcatatttttatcatgaggcattttgagtctattctttgtgacaccagaattagtttctcatctcagagtttgctgtatttctctggtgactcaagtagtttattggcagtcagtttgtaaaaggctccctgggattatctaaatgcaggacgttaggaatggaaatatgtatcattgcctctcctgtcaaaaaatgtaattaacacacatgatatatcatcttacaaagtggatgaaaattccagtgggtgaccttgagtcacagctcctcagtgcacacactgtcctgtacccaagcatctcccagatagcacagaactcccacttcctgcatccctgtacctttagcactgtgtgcatgtttgtgtgtgtatgtgtgtgtgagtgtgagtgtgtatgtgtattttcagttcaaaatctaccactcaatttcactttctttaacaattttggtttggttcaatttgttgcataggtaataataatccatttacagaatacaaaaatagtgtaagtatgtgcttcttcctatctgtatgttgagagattcctcattcttttttatggttgcagataattcattatgcagatatacaatttatttaaccagtcccatattgatggatattaggttatttccagtcctttgatgtgaccaaaaaagattataataaaaaatgctgaaagaataatattgtctttgtcagtttgggcggccataagaaagttccatagactaggtgggttgtaaacaagagaaatttatttccccacagtactggaggctgaaaatctgagatcagggtgtccgcatggttatgctttggtgaggactgtttcggggcttgcagactgctgacttcttgtagcctcacatggttgaaagagagctagctagctctctggcctctttttattaggtcactaatctcattcaggagggctccaccctcaggatctaattacctaccaaacgccttgcccccaaatatcatcacatttgggattagggtttcaacatatgaattttagtaggggggaggcaaacattcagtccattagccatattcagttcacctgtaatatagtatctgtattattttatgtctgtagaataattcctagaagtggaattgctagctcagaattactgtgtgtttctaattttgatagttactgctcaattgactttcttgaaatttgtatcattttacagttatacctgtaaatgtaagaggtatgtatctactctcttagtctaaccatcagagagtattaccaatatttgtggggtttgccaacctgaaaaaatgggaagtttatcagtgtgtttttaattaacatttatcctattatgagggaggatcagtatcttataaacttttaacagtcattttaattttcttttctttgaatagggccctcatatatttgtgcattttgttatggtgttggtgcatttctttattgatttacaagagttctttgagtattaggaacatccttcctttatccgtgccaacagtaccttttattttgtcacacagtttattcttcatcagaattctttgctcttgagaagtccctgtgagagcctgccagccttctacacctttggagggcagtttgttggcaatttctcaatttttctttcacatagaaaatgatctgactgaattttatttctcttgatgtcaactgtgctgaattattgtcttaaaaaattcaccattccattcaggtttaacatattttttagagtgtgattttcatagggtatgttacattcttgatgaatttttatcttcttgacctattaattactaaaaaaaaaaatacagataacgacaacctaaaacaacctattgaaatatctcactgtgatgatagatttgtctagttttccttgtaatttttgttctccatattttaaggctatataatgtgatgttttcaagtacagaattattttaagttcctaatgggttccttttttaatctgatattttataactttttccccaagttttctggtttcccaccataccccagattcttaagtaatttagggcacaataattttcagagaaagaatgattaagaatttatggaaatcttaggaaggtcgaattgacgcagtgccttggaagagagaaatataggtagttgaagtataaggagaaatgcctatgatataaacaaacaaattgcatgtacatgtattaagaagactataacatatatcagttacttcactagatgccagtgcataggcatgtacctgaatctgcgtaactaattgggagaatgggaagttaactttatttttccaagaaaaagaaacaaaatcaatatttaaattttggaaaacataattgttaaattatttttcatattgtgtagattcacatctctttaatcaatgggagaccaagtgccgatgatccttctccagaactgctagaatttacctccgctcgctatattcgcctgagatttcagaggatccgcacactgaatgctgacttgatgatgtttgctcacaaagacccaagagaaattgaccccattgtcaccagaagagtaagttatgatgaatcatattagagcctacaaatgatatcccacttatctttttgtctgttaaatactttaaaaatgttttcagtgatttgtaggagtggttattatcaaatttttattttagaattgtagattattattattattattatttgaaatttgacagactttcctttgttcagatccaagctgtgccgcttattacatgtgtaacatttatcaaacattttagccttctcaaactttaatttcttcttttgtaaaatgagaatcacaatgtctacttaataatcttatttttcagaataaaattagcctttgtcaccttaggggatctatactactattataattggctttggcgagttactactggaagtgcaggggctttgaaacatttttttgccaccactgagccagtatacacacatgcacacatacagagagcagtatgtcttaaaccttaatgtgtatgggattagccagtgatcttgtggaaatataggttatgattcagtagggcagagctgagacgctgcacttcaaaaactttccaggtgatgctgatgttgccggtttgtgggccatcaaataatttggttttatgcttgattaatgaatcacaagccatagttttaaaaatgcagtgctataggagaaaactgattctacatactgttttattttcctttacaaataaaatattaggggaaaaagtttaaagcatcttttcaaaagctttttgaacacaagagctaacagaagtgctgtcttccagtgttaaacaggaatttgtgggattacaagatagatgatcaacccagattgctatgagtgataaccgtgcttcctcctgtctaccttctaccatattcactggtttatggcacctcccacatatgctgctacacaaccaaggcattattaccagggaagtcaattcagccataactctataaagtaaactcctgtgaatagagtatctactgtatgactagaggtatagctaagaaaaaagactatagggagaaattaatattgtaggacaaagcatttaattctagaatgatcccactaaggtaagaccaccgtcatcggttgcaaaattgctgaatcactagggttaatagttacagatcctaaatactcctcacatgttttctttcctcgttacttaacttcccacacccaacctctccatcatcacaagataacttttaaggctttagttagtcccatgcaacatatgtcagatgttttagtgccctgtattttccaaacttgaaataatttccccttgtattatacctcaacatattgtaaattgtctcatgcaaaactaatcattattttatagcaatgtttggatttttcacttgtttaagaaaacattttcaattctaattttggcgggacttaaaaatatacaccaaggaagactggtgtgaaattggagtgaaatttaatctttcttgacagtatgtctatcagagaaaaaaaatcaatgaaaataaattagtgttctttctatcatctcttgcaggaggtagagtgggggttggggtacacatctattatttataactttatcgtacatgagtctttaaaataatgcagtataagtcaacatataaatatgttttttgaaagtactcaagttcaataaacactcatttaaatatataaaaataagatagcaaatttcagctcttcttcatgactcaaaagcaaagcattatacatttatatttaaaatagatttcccagttttaaaagcatttacaaatactactgtatcagctttttaagcaaatatctctatttgtgtctatattattaagtgatgaggttaaatggaaaaaatatttttatactatccaaactccctagccagttccattagttcaaggtctaggtatatcaaataagataacataacaaaaatattttcaaagacactatatgtatgtaacaaaaacaaatagaaggaaaaagaaacaaagaagtaaattggaaaaaggggattcttagtcaaggaactcagatatgtgtccacctacatattctagctaaatctgttttttttgtgtgtgtgtataattggaataatagaactatctaacgctaagatgattatttgaatatgataatgtaaagtgctctgacaattataaaatgttatatacacattaattaaaattttaaaaatagtctagcctccataattatccttaaaaaatagctgggtagattaaaataattagtaacatagctctatgttaacttcatatacaaaggtaattgtatggactatattacatagtaatataaaaatgcaaatgttctgcacaataaacttacagttaatgactttttaattttcttcttaatatggttaaggaatatattgttatgagcacaatttctacccagattttgttggttcttttcaaatccatcaagtaaaacagtgtgcgtatgatttgtgaatactgcagttgctataatcacaataaaagagggtttcttgcaagaaactatgtaaaacaacttttatgaagaatagctgtccttagccccagataaaaactactgtcagccacaggtactctagcatggacttggtgctgactgggaaaaagatatttctaaaatgcccaactagcttaaattaaaggccactcttcctttgggctaagatcacagtgctaagagttactttgtcagttttgtgagtcctcacttgtcctcaagaaacacaaatgtccttcaaactaaggataaaagcagaaaataaagtttttactgaatgtccccttttgttactttgaccttgcagtcatcttaacaggatttctctctggattgctttttgcagtattactactcggtcaaggatatttcagttggagggatgtgcatctgctatggtcatgccagggcttgtccacttgatccagcgacaaatgtatgtatatttataggatgcttaggcaaaatgaagccctgagctgtaaaatgtttcatgacagtctttgctgacagagaacgctgtaaatgggagtcaggtccccacttagacagtgtaacagaaatccatgccagggtgaaataagagctggcagttaggatgatagactttgaaatcagccatcacagtataagaaaacagattagtttttcctttttttttttttttttcaaaaaggctccaaactggtctattttgaaatctctctagctatgacagcctgcctcatgatatagctttagagaacgcctgccatcaatcaacctgaccatttcttttaaagtttctaatcaaaaaattaatgcaaatgagtaaaaaaatgtgcagggaagtaaatatataagtgacaatggaacaggaggataaaatagggcaggggcaataagggggtggagggggtggagtgggtgagagagtcaagagagtactgatagtggcaagccggaaaatgccagaatgctttttgatagaattttttcattaatgacaatgaattaagtgaacataacctaaaggagaagatgaatgagcatctatttttcctgtcatagacaaactggtgaaattcaaactcatctcctgtatagtatatggaaaaatacattgaatagtaagatcagtgaatgtaaatcgggccacagattttttttctcaaatattgtaatgcaaatgacattatactcaaagctagttttctgatgattggattataatgttatctcctaggaagattaaagtacactaacatatttttatgggcaaagctgcagtgctgctttctgcctggtatgggtgctttcttcttttttttgttttccattttttaaaattttactttaaatcctggatactcgtgcacaacatgcaggtttgttacataggtaaatgtgtgtcatggtcatttgctgcccctatcaacccatcacctaggcataattttccacaggctttacagagtccctttgtctcactggctttctgcattttaaaaatccctttactgttattttatttggaggaagtgaaaaaatgcatatgccaccatagaatactacgctgccataaaaaggaatgagatcatgtcctttgcagggacatggatgaagctggaaaccatggtcctcaggaaactaacacaggaacagaaaaccaaacactatatgttctcactcataaatgagagctaaacaatgagaacacatggactcaaggaggggaacaacacacaccagggcctatcagatggagggaggcaaagggagggagaacatcaggacagacagctaatgcatgcagggtgctttctatcaggtgtacagatgatcagtgtttcccaggctttaaaagtccacaagacaggcttggaaggccaattccaggtggtaaattgagactgtattcagagcatgcacagacaggagatttagtcctagagacattagatttctggtttacctgcacccctagaggcctaggaatcaactccctccttcttgccatatccaaaaatattaacaacattttgaggggagccttaaaacaagctaatcgacccccaaaaaacacatagatcccaggcatcagagaaggagaattcagtcttcaagaccactcccagctgggccttcctgctttcttctgagcctaaacccagtgattaaagaaccagcctggacttccttaaggtgatgttgatcaaatatacccacttcaagcctggcaccactttcttcccaggctggctagttttacattttagtacacagtccagatgttttctcttttcttcatagtacctttagagagaggcttcctttatggttctaaatgaggctaaaatttgtgcttcctccctctttttgactagaaatctcgctgtgagtgtgagcataacacatgtggcgatagctgtgatcagtgctgtccaggattccatcagaaaccctggagagctggaacttttctaactaaaactgaatgtgaaggtatgttctttagaagccaacaaaatatgtcattcttcctttccaagaaaaaaagccagtaatgaaaaatagtgaaatggctggttatgcaaatgtgtcaacaaatactcatttatattatcacttcgaagacaacccatatgtctagcttttcctaaagggaaatatctaagaaatgtagcagatgactttatagcctaatagtgacaactggtctttttaggtgacaggtatcatggagaaacctgtgtttctggagattttctcaacccaagaaaagacctaaaaatagtcttgggctgaactgcaaacctaaactagtatgaagtccaattcaactgaatgcaaatattaatattacagtaaatcagccctaaccacatttttttcagctcactaagtatatatggccttcaaaaacagcttgatagacattttaaattaataccaacactatatatcctttgaataacaaattaactcaactcacatttatcatgtacaatgtgtcagacatgacaggtctttaaaactattgaatcataacacaccttaatcacaaaatgttccccacctataagatataaagtcggccttccatatccatggtttctccatccatgggtctaaccaactgcagatcaaaaatgtttgaaaaaaagttgcatctgtactgaacttgtaaagacctttttcttattattatttcctaagcaatataacaactatttatatagcatttacattttgttaggtattataagtaatctagagatgatctaaagtgtacaggaggatgtgcataggctgtatgcaagtactatgccactgtataacaggaacttgagtatccttgaatcttggtgtttgagggaggtcctggaaccattcccatggatattgagggatggctgtattttctttttagtttgagattctgcatatatgctattagctctccttattttctgcactcacttcatttgcttttggatttgtgtctgcctgtttataaagatattatggattagaaatctcccattattacaaaagcatatctggaggcatgagccaccattggatcatcactcaccatgcatggtaggggaccattggaagcccagccttttgtttccttcaactacttccagccatgttctggctaatcccttagttctccacagcttctccatagagaacagacatttgttcttaatagtgactttaaatgtaatgccacccagggatgtttgctctcgagctcctttaaattttaattaaatttctcttctgtttgtagaatatcagtaatcataagtgggagcagcacttgaaggtaggggtcttcctgttgccactgacatgccttcacacagtgataattgtgtaatgttaagtggctctgcaaaatcctttaccactctttacttgtgtttctacgtttaaatacaaaacaaaaacaatcgagcaacttgttagcaatagaggtagactaagcaaggcaagacatttcaaactgctactgtacacatttttaaaatagtggaattgtgaaacactttttttctttccctgtagggaagaggggaggtcgtatttccaaactgaaaaacaaacattttaaaaacgcagaaattcaagatggggatcttagccataaagccatacataaaaatcacactttcagcaatgagtacattcctgaaagcttaagtaaaaattttcttttccaagttgaatcatattccaatcaccttaatatttagaaaaatccttccatgacatgacaaatccctccataaaatgaataatcacattctaattcatttgagtttaatttggattttcatcaatctagcttacataaggcaagataatatctctaaaaagcatagaatattcattcagttgctgagcctttactaaacaacagtttcatatgatatatcttggacattctgtgaaatagtaagttgctgatgatagagaaaaaacatggctttgtgatcagttactagccatattcttgaaggttacagacagagcggggtaggctgcagcctacagacagaaagtggggctgtaggtgtagggtcctggctgcacagagtgtgtgatggaccgtttatttggcatcagggttttacatatagtagctcatagttctaaacactcttgacaacacgaattctaaatagtgtgagaataagtctatgttactttatgttttcctctgcttatactggcagcagaagttttgactgttttttgaaatacactattacaacaaagcttttaagaattcatagccaggtccagtggcatgctcctataatcccagctactggaaagaagctatggtgggaggatctcttgagcccaggagtttgaggccagcctgggccacatagtgagaccctgtctgtatcactccgttttcacactgctgtaaagatactacccgagactgggtaatttataaaggaaagaggtttagttgactcacccttctgcatggctaggaggcctcaggaaacttatgatcaaaggggaagagggagcaggcacatcttacatggtacaggagagagaggagaaagtgaatggggaagagccccttataaaaccatcagatcttgtacgaactcactcactatcatgaggacagcatgggggagctgcccccttgatccagtctcctccctccctccatacgtggagattacaatttcaaatgagatttgggtggggacacagagccaaaccatatcactgtctttctgaagaaaaaaaaggaattcttgtatgttgccctaaagatataaaactgcttacaatgcctagtgatttgtattgattactatgtgttccctaaagtttgaaactctccattaacatagcaaaactactatattctaaatcaaatgtcagcaggttgggaaaggtatttacaacaaacatgacaaggggataataacctttctatattaagagatcttacatatcaataagaaaaaagttaacctgttagaaagatcaaaacaggtattcctcagaaatgacatataactttgtaaaaagataatgacactcataatgaaggaagtatcaattaaaacaatgacatattatttttcacctatcaaagtgtttattcttctactcaacaaatatttgaatgcttattatgtccaggaattgtattcaagggttgataacacacaaggttggtggctatggagaaagtgttttatcatatctactagaggaaaagtcatttgtcatagcgttcctggaggggaattttttaagcgattaaaatttaaattttacatatcctttgactagaaattatgcttccaggaatttaccctatagatatattcatatagatgtacaggcatattatcatgatcctcgtcattattatacaagtgctaccactactgctactaacatttattgagctcagtatttagtatgtttcaggcattctgctaagcattctcaaaacatgtatgagacaagtactaaagtgatgctaggactcgagtttttgcctcaaagtcactcaactggcaaataggaaacttttctaacattagagcgcctccctccacccggcatccttgtcctcccagtatgtgtgtggtgttatttgtaaagggagaaacatggaaactgtgtaactgttcattaatagggacctgataaataccttcattcaagtagtaccctgtgtacccttaggggatacacatgctaatatggaaagggctccatgatttactgttagtaaaaagaaccggttctaaacagtatacaaatgccccttcccttttgtagaataaataaaaagattgagctgtatgcatacaagcacacctacacacacacacacacacgtggaaataaatgtaagtactcctaagaaactcaacatgtcaggtaggaaggagactgcatcgatatatttccctggttctatcctaatataaattcttcatatttagaagagtcttacccaatcctttctggagaaagtgatttttcacttcttggaattcttctaatgtaacatgaaaaagacaaggaggaagaaaagaagaaaaatcaattgctaacttctttataagacattacgctaatgatttcacatgcattatctcacttgtgcttttaaatatcccaatctagtaattactattgaccactccatgtattatatggaaactgagccttcgtgaaattaagaagtttccaatgtcatatgactgctaagtagaggagagcacacccacatccaagacagttggttgcaaaatagcatgatcttagccaccagtaaactagctctcggtttgtcttaattccttggcacctgccatgtatcttatttcattcaccgggtaggatgtgaagagattctggcagtctttagcagtgcagactctggagtctggcttcagaggttggtttccaatactgattagaatatcttttacacgttatttcacttctctggactcaggtttctagtatacaaaaataggttaataataataatacctaattcctaaaagcatttttgaggattaaaatcagtagcaacaaatatggagcatttagaacagtgtctggcattgagaaaacctatgttttagttgttattagtattaaaagaaaggaattatattatacatacttttctttacccacaggctctaatacagaaatttccatatggtagtaattcattacagattacctagctgttaatcattcagtgccatcattgaataatttattatttgttataataggaaattgtaagttgaaccatataaaattgcacgttagtcaaaaccaaatattggcaattgcatatgattgagcttaatttatatgttttaatcatttcaaattctattaaaatgtgtgaatttattaatacctccaatacatccagatactttctggatatgtttgtgtgtgtgtacgctaaatgtaatttcccgtatggtataaaagtctaggccgggggcagtggctcacgcctgtaattccagcactttgagaggctgaggcgggtggatcatgggtcaagagttcaagaccagcctggccaacatggtgaagccccatctctactaaaaatacagaaattagctgggtgtggtggtgcatgcctgttgtccccagctactcgggaggctgagacaggaggattgcttgaacctggaaggcagaggttgcagtgagccgagatcgtgccactctgcactccagcctgggcgacagagtgagactctgtctcaaaaaaaaaatctattatgtataacagaaatgatttttaaatgtatctgaaatcaaattgatgtttattaatttatttttccttaatgcagcatgcaattgtcatggaaaagctgaagaatgctattatgatgaaaatgttgccagaagaaatctgagtttgaatatacgtggaaagtacattggagggggtgtctgcattaattgtacccaaaacactgctggtataaactgcgagacatgtactgatggcttcttcagacccaaaggggtaaagtatgctttttctttcataaagagttatttttttgctttttcatacaaaaatgttttatacaaaaaaataataattttgaaagcttctgtaaacagttgaacttcaaattaaaaggtaagtaggaacatttcgtagttgaaactgacctaaatctttgaggatgtaagataaaacttttccatcactccagaaagttttatcatggctccttccagtcaaggagtggacccctaggcaaactctgttctgatttttagaacgtaaattagttgtgcctcttagagaatttcataaaaatgaaatcatacagtacatactagtgagtcttttttcactcgacataatatgttaagatttatccatgttgtttgtgcatcagtagttctttttcttttgaaagaaattgctgagtagtatttctctgcacgaacatatcaaaattttaaatccattctcctgttgatagaaattaggatcatttccagttttagcttagctcctacaaataattttatactagttattttatagtcatatttttatttaccttgtgtaaatacttaggaatagaaagcttttttcataggataggtagatgcttaactttataagaaaccgtcaacattttgccaaattagtaataatgtataaaatgttcaccaaaaagttatatgagtttcagtcattctatatcatctctaatatttgatgttgactatctttttggattttagtcatctagtgggtgtgaaatggcatctgattatggatttaattttaatcgtaagggcttattgaccattcctgtatcttctcttatgaagtagatgttcaaagtctaaatatttttttatcctaaaaaccaaaattttaacttatagagctattacccatatcaagtaaatgtttgtgtgtggtgtgaataagtaaccagatttatatggttaacctgaagttctagcaccatttgttgaaaaatcaattgatcatattacatggatcaatttctagaacctcagttatctatttttcctagcatctatttttccctctgcgtgctaataccatactatcttcattgctttagtaagtctagaatttaggtaatataatgtaccaactttattttttattttcaagattgtctatagtaggggcttttttgtgtgtgtttctatacaattttagaatcaacttgtcaattacagaaaatattaggattattgcttagactctatatacaaatatggaaaatggagcttgaggagatgttggtcaaagaatataaaatttcagttagatagtaggaatacattgaagatatttattgtacagcatggtgactgtagttaataacaatgtatttactcttaaaaaatgctgagagtagattttaagtgttctcaccaaaaaaattgataattatgttaggtaatatgttaattagcttgatataaccatttcacaatttgtatatatataatatatatatacaatgatattcaaaatatcatgtcacacatgataaatatatacaattttgtcaaaaaggaaattaaactttaaaagcaaacaagtattgaggaaaataacatcataataatattgaatcatttaaccaatgaacatagcatatctctccatttatttctatcttctttattcatgtcagtgttccagtacagagatcttgcatgtcttttgttaaattaatctttagaattttgctttgcatgactgtaaaaaaaatttttaaataattttccaattatttaatgtaattgttaaagaattttgaatattgactttatgccctatagccatccttaatttctttttttttttttaaataacttcccttttaaaagttactgagaataaagaatacagaacatggttataggcacttacattgctatcaaatgcaggaattcacttcaataagaagtgctttctctgtaagcatggttcatggcaatagaagctccaacttaggagaggatgttttccgtgacaaaaataataacaacaaaaaaaatggtggttgaaggaaaacagtccaaatttacagatgctttaaacttcttttggccttggcatcagctttcatgttaaaaaataaagctggtggggaagctatctcacttgcaaagtaaatggcttgtatgagattggcgaatcttggtcagatattgcatttttaaagcacaaaaccaccggccaccaatatcttcctgtgcatgcatataaattattttcttctaattcaaatggcaacagaggaatcctggcgtgcatgtgcatggagacacacacacatcactaaggagacaggacaaactatcataaactaagcagtatcccaaacacatcatcatctataggctgttttacaaaggtggaatacaaacgaactgaatgtctcaggtaaaaggcaaagtctatttctccaactctgctgcactcatttatcttcttaaggctttcacagaaagcaccgttttatgaacaggcaattcagtacccagagcttgactggagacactaatcaggattgaagtcttgatgcagttcataaaaacccatttaaaaaaaggcatcaaaaaccacatttaaaataaagttgtccatatataaagaatgaagtgtttagaagttcccagcttgtatcctaataagagtactgaaaggtttaatattagcagcctgtgaacacgtagtgaagaaagagtctgagaaccaagttaacatccttattccactctaattccacccatgccatgggtaaaaacagttcttgcagtctagagtttctcctccgatggtttaaccgtcagatttttacatcttgggattcaaccatcttggcaagcgtcttcttaattctcaacgctgtgagtctgggggctggattgtgggcccagcattctgacattagcttcaaaactgctcgtagacattcatcactgttccaccgattagacacaattggccgcaaacgtttgacacacacaacctcacgcatatcttcgtatgacggatcactcggtaccatgttataatatggcaattggtagtcttccacgatccctcctgtgatacaacgacgagccatctcccaaatgattaggccgaagctgtagatatcagccatgatgtagggctggaagtggtttttgttcaggctttcgtccagcacttctggagccaggtagcgtttggtgcccaccctggtattcaagggcacatcaacttcatttgtgtcactgttgaatttaacagcaaggcccaggtcagcaatgcagcaactcccatttttcttgatgaggatgtttttgctctttaggtctcgatgagcaattgcgggctttccttgggtgccatacgtttctgtgtgcaggtggcacagaccacaggcagctgaataagccaatttaagcagggctctggtgtccagcgtagcacatttcaggaagtcatagagagatccattttcatggtaatcagtaatcaaatagagctgagtccaggaacctgtacctttaatatctgccgctatgaaaccaagtatgttttcatggcgcattagcacagtttggtagatttctgtttctcgaaaccagctggcttcttcagtggtaaagaatactttcaccgccactctttcgccatgccatttgcccatccgtacttctccatatcggcctttaccaacttgccggaccatctgaatctgtttggcaatagttcgctgaaccaataaaggtagtccagacccactaccagaactttgtgactggtcaataaggtcttttagtgattttccaactggaataaatgcttcatcctgttccaaatcacgattgtaacgacgtctgcttgagatgctcttgcaataatgtttgtaacaaaagcagctggagaagatgatcatagcaattatgcagacagccatagaaatgagcaaaaccagccatcgaatgctgccatcaaaaaacggacctatgacaacagggggcatgtgggttgcaaatactggttacataaattggtccgacaacattctattgtccggcgtagctgggcttttggagaatctttgcactgaaaatcagatccttcatatttcatacaccctgaagctaatgtggtttctccctggtcatcttcttctatgatggcaaagcaacgtccattagttatgcatgtgttattaatagcatcatctgggcagtgccctcagcaatagcacttgaaaaaaggcaaggtatcctctggtgctaaggttactccattttctgactttttctggtcggagtctgatttcatcccagtgccgtggagcatactatccagattctgtccttgaacacgagaaatgatgaacaaataggctcccaataatctgatgtaaatgtatagctgagtcattgttcaattgtaatgtttcctgtgtactgtcacctttagtaattggtcttgctacttcaccaatttaaatgactgtcattcagtgagattttcttgtaaaagatcgcaagcacttgacaatgacttcaactcccactgctttcttacgactcctccaagatgtggctagataaaactgtacttccgattttctccaaacagctttgacctatgcttccatctcatgaattccaagacagtattaaactgatgcatattttcataagtcgctcccggcgtctcttcccgggctccttgccagcgtgccgaggcgcaggcagggtgatggaggcgccccggccgggaggatctgccggggagagcggctttcctcatcgattcgggagcacccaccatgcttaatttctttattaattctagtagttttaaactacatgctttagaaacgtacacataaacaatcattttacctgcaagtacattcaggcttacttcttcctttgcaatctttatgccaaggttaactaaaaatggcgagagctgacatcttcactttgttctgaattttaaagggaaacctaatatttcactatggagtatgatgtgaactgcatatttttttatggacaccctttatcagattcagtaggtcccctactattcctaagttgcagagagtttttataacaaaatggttttgcattttgtcatatgcttttcgaaacctactgaaatgaacataaggattttctcctttattctgttaacggggacaatttatgcaaattgaattttaaaatatgaaggcagctttgcatttgtgaattaatctccatttggttatgatatattatcatttttatatattggatgattcaattgactaatgtttggttaagaattttgacatcctctcataaaatatattggtctataattttattttcttataatgtttttgtcaggttttttattggggtatactggcatcaacaaatgatcggggaaatgcacttcctcttctgttttctaaagtaacttcagattaaaattaattctctttaaaatgcttgataaaatttcctagtgaaactatctgagtctctagttttcttcgtgcattgtattggctattttttattagacatagggttagataggttttgtattaatatctttagggagggtcaatttttgatatattgtatttttcaagtaatttgttcaattcatctaaattgtcaaatcattggcaattggcagttttaaaaattgccttattatcttcttgaagtctatagcatctatatagatatcccctgtgtaatttttaaaatgattaagttgtgcttttctccttttattgatcacttatgttaggggtttatcaattttcctaatcttttccaaaaaaacttctgcctttttattttttgtgtttttattgattctgttctatttattatattattcatttgacctgttttggttttaaatttcattttctttttctacctatcaatttggaaagttaaattatgattttacacctttcttcttttatcatataaacttttaaatatagatttccttctagcagttctttagctgtttctcatgaattcaggaatgctttatgttcattgtcatttatttaacataacttctaatttctcttgtgatttattttttgttaatttccaaatatttgagctttattaaatattatatttttgatttctacactggatgtttatgatctgagaacatactctctaagatgtcaaactttagaagtttattgaaatttaacttatggctcagtgcatggtctctcttggcaaacaaataaatgtggatttttccaatctgcgattatggattcctacctttctttcatttttttcagtatttcttcctgttctttgaagcactgttatgaggcacatacatatttagaatattttgaatctttagatttttatatcttataaattaatattttgataactgtgaagatctccacttaatctcagatatcactttttgtcctaaagtctactttattttttattaacattgccacagcagttttcatatgcttactctgtatggtatgttttttctgattttgtttaactttcaacctatctttattttcatttaaaagatttcttataaagagtaaaatagatggattttttatcctgacaattactgtgtgtttagtccctaaatttaatatagttaataatatgattgggttttgctatttgtttcccatttgtgtcacaaaatttttgttcccattcttccttttctgtctacttttatgttaaacaaatatttttcagtattccattttatttcctttattatctttttagcagtacctctttgtataattttccattccaacttttattttaggttcaggtagtacatgggtaaattatgtgtcatgggatttggtgtacagattattttgtcacccagataataagcataataaaattttcaatcttcacccccctcccacccttttcaagcaggccctggtgtctattgttgccttctttgtgtccatgtgtactcaatgtttagctccactcataagagagaacatgcagtatctggttttctattcttgcattaattcacttaggataatggccttctgctccatccatgttgcttcaaaggacatgattttattcttttttatggctgtgtagtattccatggtgtatatgtactacattttctttattcagtccaccaatgatggtacctaggttgattccatgtctttgttattgtgaatagggctgcaatgaacataggcatgcatgtggctttatgatagaatgatatatattcctttgggcatatacgcagtaatgggattgctgagttgagtgctagttctgttttaagttttttgagaaatctcccaacggcttcccacagtgtctgaactaatttactttcccaccagcagtgtataagtgttccctttctctgcaacctcaccagtatctgttatttttgactttcagtaatagccgttctgaccagtgtgagatggtagtattttaagctcatgatatagtgatatagtcctatcttttggactattgttttcatatattgcacataatttgtaagccagcaatacaatgttgtcatttttgtttgaagtcacaaaactatgaaaacaatcttaaagaaatgaaaagaaggaaaaaaatttacattaaccatacctttcccattttccatactctgtggttctagcttatatatattgccctcctgcttgaaaaatttcctttaacattttttttttggtagtgcagagctgctggtgacaaattttctcaacttccctttatctgaaaatgtctttaatctactttcattattgaaggatattttccacatagttacagaggtgtgtgttttcttctttgtttagcactttaaagatgtggcaccattattttctggatttcattcatccttatgacaacatagccattatttgtttctttgttctatatatatatatctttaattcactagatgatttcaaaaatttttttatatctgccttttgacacttataccatgtatgataaaactttggcccgtagaccaaatctgactcatggcctatatttgtatgatctgtaagcaaaggatgtttttacatttgtaaaggtttgttaaaaggagaagtagaagaaggggagaatgaagagaactaggaggggggggaagaagaggaggaagaatgaagagagtctttatatggcttattttactatctggccctttacagaaaagttttccaacctcagagttaaataaactatgatgtgtctatgtttggctttcaagcttaccttgcttgattcacaaagcttctaggaactataaattgagattttattccacatttaggaaattttaggctattttttttatttttacttattttttttaggcttttgtttaaaacctgttttttgaccagtgtttttccttctctttctaggactccagctgcatgtgtgctagggcgttcattgtatctgaggcagtgctaagtaattttttttctttctccgttctttagattggatcatttccattcatctgtcattatactttggtctacatataatgtatctttaatttactagctgattttaaaatattctcattaggccgggcacagtggttcaccccaggaatcccagtactttggaaggccgaagcaggcaagtcgcttgcggtcaggagtttaagaccaacctggccaacatggtgaaaccctgtctctattaaaaatacaaaatttagccaggcatggtggcaggcacctgtaatatcacctactcaggagactgaggcaggagaatagcttgaacccaggaagtgaggttgcagtgggtcaagcttgcaccagtgcacttcagcctgggcaagagagcgagaccctatctcaaaaataaatacaaataaataaataaataaattctcattatatttacttttaacaatagtatcatgtttgagaaaactttggcctgtagaccaaatcctggcctatggccagatgactacaaaagtagtcattaggttgactactcttcctcctatcatctctacctgatgttaagcatatccagtgaattattaaattgaggtattttacttttcagctttctggagttcttatgttccttacagcttccatttctctgaaatactccataccttcactcattataaacattgtttcctttatattctcggacatatttacagaacttacgttgacttccttgtatgctaatttcaatatctgggtcacctcaggatctgcttttatcaacttctttttttaataaggtcaacattttcctgtttctttcctgtatatctaatacagtagtcctcctttattcacagaggatatgttccaggaaccccagttgatacctgaaatcacagatagtaccaaacctatatatactatgttttttctatctgatacctgtgatgggactaagtgactaacaggagggtagtgtctatacagcatagatatgctggacaaggggatgattcatatccctggtgcgacagagcaagatggcccgagatttcaccacactattcaaaatgacatgcaaattaaaacttttcaattatttatttctggagttttccatttaatattttcgaactgtggttaaccatgataactgaaacctcagacagcaaaactacagatgaggtgaggactactgtaatttatcatctctacaggacatttcggagaatacaatgcagacactggtttctgttatgttcctctgaagagtttgaattggttctaattagtaataaacttgctgagtgatcaccatgaagtcatgaaagtttactttcatactttgttaggacagattagtggaaaactccaggtattcatcaaacatttctaatgtagttaacttaaagtctgaattctctttactttatggttggtagcacctgaaaactcttctcaccttgttcagtttccagcggttgctttccactgaatttcctagaatctcctgagtgaatatacaataaagggatcagttaaggctgggaagggtattgttatgcaaattttgtgaattgcagtttaacagctaaagaatttatctctatgatgttcataaaattattgtcttaaaatttgattttagatttttccacttaatgacatttaatttatatgtgtatataaaatatgccttacctattctgtgcacagtcccaacttcataatgggggaatgaatgaatgtatcttaaacaaatgatgattttgaaactgacctgtgaacttagttaattgagattcagtgaggtatataaataagtctaattttaacactctgatttatagtagcaaacaagttttcatttgtaaattaagcctagatatatatacatatgaactatattgaataggtgggcatttcttgggcaaataatttagttttttttttttttcctattacatctggaaaataaatcttgtatatacagtatatgaacacagtgtagttttgtttaagtaaactagctttgttgatatactatgtatacaagataaaaaggaataaaacatgaaaatatcaataagtattgaatctaagtaacaaatatataggaatttattattctattatctttacttttgtgtaagcatgtaaaagaactggattttagaaattataaacatgtattaaaggtaattcttatagttttctcaataatttgctgctctgtattattaaaactactttgtctataaaagtttgctgaagtgaaaaatattgctgtttctattacacttcgttaaattcattttaatatttttgttaggtatctccaaattatccaaggccatgccagccatgtcattgcgatccaattggttccttaaatgaagtctgtgtcaaggatgagaaacatgctcgacgaggtgagagctgcagcagaatgtcactgctctgataaaaggacaactaaaagccaaatatgattattttcagaagaatattttgcagtaaatgttattcatgtaataaatttattctttaatctatcagtgtattagcgttccctccaggaagtagtttttaaactcatctcaataattactttcatgtttaattataatgttttcatagcaagaagagttgaattatgtattttgagatacacacacacacatacacagagataaagaaagagagagagtcaatcacaaatctgtggtatatgtaattttttcatatcgtgttatttattagattgtttgtagcttctatgagttctagcatgaaatgccagcgttcactgaggaatgtgtgtgctgtagtgggaaaagcaaatagaagaactcacacactgagatgtaggcaataatatagaaagcaagaagtgttcataaaggactaagaaggtagtagtcatgaattaatgaacagaaagaggctgacactaatttaagctaaagccttcctttgaggaatgaaattcatgaactccaaacattaagaaatcaaatgccaacataactccttgatataaaagcgtttgggagctacttccagggcagttgctcgccaagtttaagtaggaaattcatagaatgcactgggacgcttcttctctagaaagactaaaattaatcaaggctacaatgtagtgtttttttccctaatgactttagcgttaaaagaccagcaatgtttcttaggtacaattcttgttacctgctttctttataaaactgtaggattatcaatctgagcattacatgtagactaaattttgaaatattaaaaaacggatacgttttgatagtcgaatgatgaattactgagctcacttttcgttttaagccttttctctttgtgtttacaagtaaatcacaatgttgttttcattaatatcatttaactcttccctacccctttttgagtaatgagtatatgatcacagaataaaaatggaaaagtagaaaaataaatatacaattcagtggtaattcaggagagataccactattaacattttcatatatttctgtcataatgcatacaaaaatttctgatattgctcctcttaactttatgtgatgagtttccccaaaaatctatgaaaactttctctgaagtctggcttcagcacctaaataacacattattatatggtcgtgccataattatttaccctctcaactttatatggacattaagattgtttcaaatttttgtttattttaaccaatcctttaataatacttattccatataattacttttcaattattgtaaaaacaatacatagtaaaataaattcttaatagtaaagaaataaaataataagtgtcctcttcaacctatttatcccagtcttacttccaaatttaaaaatattgagccttttttccgattcagtttttattttttttaattatactttaagttttagggtacatgtgcacaatgtgcaggttagttacatatgtatacatgtgccatgctggtgcactgcacccactaactcgtcatctagcattaggtatatctcccaatgctatccctcccccctccccccaccccacaacagtccccagagtgtgatattccccttcctgtgtccatgtgatagcattgttcaattcccacctatgagtgagaatatgtggtgtttggttttttgttcttgcaatcgtttactgagaatgatgttttccaatttcatccatgtccctacaaaggacatgaactcatcattttttatggctgcatagtattccatggtgtataagtgccacattttcttaatccagtctatcattgttggacatttgggttggttccaagtctttgctattgtggataatgccgcaataaacatacgtgtgcatgtgtcttcatagcagcatgatttacagtcctttgggtatatacccagtaatgggatggctgggtcaaagggtatttccagttctagatccctgaggaatggccacactgacttccacaatggttgaactagtttacagtcccaccaacagtgtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccacttgttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtactgcctaggttttcttctagggtttttatggttttaggtctaacgtttaagtctttaatccatcttgaattgatttttgtataaggtgtaaggaagggatccagtttcagctttctacatatggctagccagttctcccagcaccatttattaaacagggaatcctttccccattgcttgtttttctcaggtttgtcaaagatcaggtagttgtacatatgcggcgttatttctgagggctctgttctgttccattgatctatatctctgttttggtaccagtaccatgctgttttggttactgtagacttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgttgttgttgtataagaatgcttgtgacttttgtacattgattttgtatcctgagactttgctgaagttgcttatcagcttaaggagattttggactgagacaatggggttttctagatatacaatcatgtcgtctgcaaacggggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattctgtatgatactggctgtgggtttgtcatagatagctcttaatattttgaattacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcctacttgatcatggtggataagctttttgatgtgctgctggattcgttttgccagtattttactgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgtcgaggaatttatccatttcttctagattttctagtttatttgcatagaggtgtttgtagtattctctgattttagtttgtatttctgtgggatccgtggtgatatcccctttatcattttttattgcatctattagattcttctctctttttttctttattagtcttgctagcggtctatcaattttgttgaccctttcaaaaaaccagctcctggattcattaattttttgaagggttttttgtgtctctatttccttcagttctgctctgattttagttatttcttgccttctgctagcttttgaatgtgtttgctcctgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcatgggtttcaaagaacatctttatttctgccttcatttcgttatgtacccagtagtcattcaggagcaggttgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtttattaggtccgcttggtgcagagctgtgttcaattcctgggtatccttgttgacttcttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatgtttgttggtttaaagtctgttttatcagagactaggattgcaacccctgcctttttttgttttccatttgcttggtagatcttcctccatccttttattttgagcctatgtgtgtctctgcacatgagatgggtttcctgaatacggaacactgatgggtcttgactctttatccaatttgccagtctgtgtcttttaattggagcatttagtccatttacatttaaagttaatattgttatgtgtgaatttgatcctgtcatgatgatgttagctggttattttgctcgttagttgatgcagtttcttcctagcatcgatggtctttacaatttggcatgcttttgcagtggctggtactggttgttcctttccatgtttagtgcttccttcaggagctcttttagggcaggactggtggtgacaaaatctctcagcatttgcttgtctgtaaagtattttatttctccttcgcttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctacatttttttcaaagttttcaacttctttgcctttggtttgaatgtcctcccgtagctcagagtaatttgatcgtctgaagccttcttctctcagctcgtcaaagtcgttctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggtttttcgtgtggatgtcctttctgtttgttagttttccttctaacagacaggaacctcagctgcaggtctgttgcaataccctgccgtgtgaggtgtcagtgtgcccctgctggggggtgcctcccagttacgctgctcaggggtcaggggtcagggacccacttgaggaggcagtctgcccgttcttagatctccagctgcgtgctgggagaaccactgctctcttcaaagctgtcagagggacatttaagtctgcagaggttactgctgtctttttgtttgtctgtgccctgcccccagaggtggagcctacagaggcaggcaggcctccttgagctgtggtgggctccacccagttggagcttcccagctgctttgtttacctaatcaagcctgggcaatggcggcgcccctcccccagcctcgctgctgccttgcagtttgatctcagactgctgtgctagcaatcagcgagactccatgggcgtaggaccctccaagccaggtgcaggatataatctcatggttcaccgttttttaagcccgtcggaaaagcgcagtattccggtgggagtgacccgattttccaggtgccgtccgtcacccctttctgtgactcggaaagggaactccctgaccccttgcgcttcccaagtgaggcaatgcctcgccctgcttcggctcgcgcagggtgcgcgcacccactgacctgcgcccactgtctggcattccctagtgagatgaacccggtacctcagatggaaatgcagaaatcaccgtcttctgcgtcgctcacgctgggagctgtagaccggagctgttcctattgggccatgttggctcctctccccgattcagttttttagtgagttacctttagtatctaaataatattcttatcagtacttttatcaccattacatattgcctattgactctccgtcttgaaaggtgaagaaatgtatcattcacaacacctccctccttcattccaccatccatacatttttattatgtgtttcttctacgatatctttatcatgttcaagagagcttacatgtctatttcatcaatgactacatttagactttctcttgaggtcctactatataagatgtgataaagactatcatccctacattcttcaccacttgtcagtgtctgtcaattacatatctttgaaatcttttcaaagattttcacagttacattcagctctggaccaataattaatgcttataattcaaaaatagaaatataataatcaagattgtaatactgtaattagatacatattatttgatacaggctcgaattgcaaaattggacacatatttgtaggtcatttttatcttcatgcttgctctgataacttatttaggaaagagtgtaagatgtggtctcatggtttgcacttcttcatcagattacataaccagatagtagaaaaggatattttagtgtattactggcattcatttgattacgagggaaatacgatgtatttcttctctgatttttcttttagttttcttcattttcttttagtagaaggaagttttctcccttgtagatttgtaagagcactttaaatattaaaaacagtgatagtatatcattttttaataatcagttttcagatttgctttgtgtctcactactgttgataatttctagtgcacaaacttcaaaaattttatgtaatcagctgtcaaagttcaggtaaaattctttacttataataatgataccaacccatgattattatatattttgatttttttgtgtatttcttacatgctttataatcctagaactctcatctatcccaagattagaaaaatgtatttgttttcttcatttgtatgatttcattttataatacttaattttttattccatctagaatttattttgttatatttcataaggaaattttcaaactacattttgttttccaatactcttttttactcatctacatttaatattactttcagctctttagacatattaaatatatttattttattttcggaatctgttagaagcactctgttattgagtctgagtctgcatttttatttctcttctaactcttattcatatggacttcattttcttatgtttcgtaagtgtgtgtgtgtgtgtgtgtgtatgtgtgtgttttgtggatgtatgcgtgcatatgtatttcttagtttattctttcagaagccttgaatttacatgaagttatgtgataatgacctaccttatataggacctagaattttttgttgttcttctgtaaaaccatgctccctgaactgtagtctagtcatcagaatttgccagtcaactccaggaaagacattgttttaaagaatgacgtaagctttctagaagtcaattttgtagtttctcatctccaaggggtttctttatttcttgccagcgcaacgattctgttatctgccatctgtctttcgatctatctacctacctacctacctacctacctatctatttttctacgtttaattttattctgtatcttcaactgttctgaacaggaggggttttttggacatctagtctacaatacttccagaaataaaagttaagatagacattgtttaatacatgaagtacttctacatttagcctcaatttctggaaattttaacatcagaaataatgttaaactatttaatgcctttgcaaactttattaaaattatcagatttatttcccatttggtctattgggtaatctattagaaacgaacttactaatatcaaacaatatttattttaccagagtatgttctacttggacatcatagaggatccttttaatgtactttaggattcagtttggtgttttgctcatctggattcataagttaattgcctgtgactcagacacccaccagttgtgctcctttggcaaatcacttaatttctccatgccttagttacctcatctgtgaaacaggaaaaataatagtgtctatctcatatagatgttttgagtactaactgaattaacccctgtgttttgtgtaatgctaagtataatgactaccataagataagtgctatttgagtcttagaagttttgtttatttggggttatcatttgcatttgggtatcaagttagaatttgcttcataaattgaattacatagctctccatttttatatgaccataagagtttcaagttttgaaaacagtctgtaaaaattaactagcattacagaaaaccaaacaccgcatgttcttactcgtaagtgggagttgaacaatgagaacacatgaacacagacaggggaacatcacatgccagggcctgtcagtgggtgggggtctaggggaggaacagcattaggagaaatacctaatgtagatgacaggtcgatggctgcagcaaaccaccatggcacgtgcatacctatgtgacaaacctggatgttctgcacatgtattccagaacttaaagtataataataaaaaaaattaactatcattaaaacatgtttgtggtagttctttgataatttgtcctcttttgatacccttgattagctttgtttaccgtttccttttgcttgcttttctttttttcaaatctctttacttcctgtggtgtttatattttctcttttttatacttaaatgaattaaattttaatttatctatttttaaaataatggactatttaagcctataagtttacttttgggtacagtttttccatactcaacaaaaattaagttccttttttactgctattatattctacctagatagctatttatttttaattgaagtcttgattttctctttaacccaagagttattaaagagaaatatttaggcattaatttttagaacagttgaattttgcataaaattctctcatcatgtttgatattcagaactaatttaatcttaatttttgtggcatttgatacacatctaaaagtagtaatttatgttaagaaaataagccttagataatttctgctttgataattgagtattttttatagtcaatcacaaactatggtaaatatttagttatataccacataatatgtaatttgatattattagattattcaaattttctgttttttcttacttcatctgtaaatacttaagatgagtaagttagcatcattttcagccattgacttttaaagtttttatttccaatatattttgttgtccacatatttttgtactgataattagtgcttatttgaagcataaacataataatttaaatcatgtttttattatatttttatcaatgtaaaatgagagcttgccttactgaacctagtttatttgagttctactttggccctatttaatatttcacaacttttttttcttttccatacgctttcttgacacacattcattttcttttacttgtaatattttatttgcaatattcctgttcattttgtttatctcttgtgcacattacatgtttatgtttttaataagaacagtaagactgcttaactcattagtatgtatttagtatgcatttctgacactaattctgtcattctgctttttgctttctctccctaatgtttccttgcctttttttccctcctcctttcttctttctgatggactatatatattactgatttgcttttatctttctccagattttgaaggtctgttagttgtattcattcatcctgtattatttctattttttaatcaaagacatgaataaacattgtgttttgtatttctgtatgttaaaaaagtaaatttaaacttttcattcccctcatctattgcttcttatccccaaaatatcaattccaatgaacacctttattttctttagtaatactgccagtggcatgttcttagagtatcattgttaaactgttattttaagtaatatgtctttattcccaaggctactttgcacctgtaatagtctggtggagcaggcttgttccgtgagccactagttttgcatttgttactgcttattcttctcaatgtagcatcatcagcattagcgtttgtggaaatttctccttggtcattgttttctatagccatagtttggtagatgctttgagatttcatctttcttgtttacatttttaatatttctattgacacttagaagatgctatgttcacgtaatcatagaaagcttttaattaaaccctctactctttggttttaacttttctttattgatatatataaaaaatctatttttgtgtcaaaatagcattttaaaggttactgtcattaaaactttaacaactaaattatgtacttgttttagaaatgttgatatgtggctcatctttctttaggtttggcacctggatcctgtcattgcaaaactggttttggaggtgtgagctgtgatcggtgtgccaggggctacactggctacccggactgcaaagcctgtaactgcagtgggttagggagcaaaaatgaggatccttgttttggcccctgtatctgcaaggtacattgtttattccagtaatgtcccactgtcaagacagaaggttatttttcttggcttctctgttgatttccttggcattaagcaattttaatgacttctggaagtatccataatctattctacgtgtggtgacccaccaggttcactgtagcaggatgtttataaggcacttatctaaaagcctacaaatgcacggaggataaaccacgtttaaaggcttgttattttataacaaaaacactttcaccccattgcccaactagtgtgttaatttaaaaatatacggcactagaaatagcaaccctttaaaactaaagtgcattcaaatctacctttgcatctaattcagtaatgaattctgtcaagggttttattctgaatttttaaataatcttctaaagtttgaacccagataagccttaaaatactcattatattcaaatttttctgttcaattataaaaaagtacaaagccctaatggaattaattaaaggctcaatattttcttccaagattacttttagaaatgcaactttatttgttgtacatgctcacctaataacaaatcatgttaacaccaagggatgcattacctctgcagcttataaacattatgaagcatacaggcatgcacaagtgaaaaatgaaaagactgatttactttacctatagtaatgagttctataacattctgaccagacggtgtataactacattagctgagagaatgaaccattctttgaaaaagttagcataccatacttatgtaaaaatgaaagttactacttttttctttattttcaattaaagagggacccttattaaaaatatttttattaacctgttagtcttatcttggcagctataaaatattatatagttatatttggtacatgtgagcatatgtgtacatatacaaccattaagccataatataagtagtaaatattagttttaatgaagtgtttatgaattgggacaagaatgtctggaaatatcaagctaaatataataataatagttacataataggtatatgttacatcaggggcaatttaggttcctattttgaactactgaaataataaaactcctgtggacacagtaagcagaaaagtccacaagcccatagtaaaaagttgccatgtcctggaatgtagtaaattttctaatctattacatttcattccaatattatctgaaatgaaaaattgcttgagttgaccaagattgtgtagcagtgtgtgagtgattgcttgcttaaggacacctcccctctccatcttgtatgtctctgtgggcaatcctgcaggctcttagtgcatcttctctagtatttatcaaaacatgtcttgtgtgtgctttattctcttttcaaaactccacagaaatctctaacctttaccacttgctcaaataaaggacagtcaaaactaagcttaaaatggaaaagaaacctcctgagtttctagaatatataaaatcaaacagggaagaaaaacaagtgcttttctacacctaccactcatacagtggtgatgtctggtatttgcaaggaaagggagtaataagcgagttaattttctttggtaaatatagcgagaaaggctggagcaagagagctgtagtgattagcagggctccaagggaaagccccttgagctacttactgcctgctctcagccgaactcaatattgtactgagaattattataatcctaataagaaagatgcctcctgtgtagacacttgaagctctacacagacaattaaaatgcaacaataaacagcaattaagaaatcataaaagagaatgaaaattaagtaaatagcattattaaaataaatgcctttctaccatgtgatatcttaaatagaaaactgtaagttcttataaactaaattgtttcaggattaaaaacttgcagaaagcaagtttcataaaacatctacataattataaaaatcacaaattatatgcatataacatgaattacatcacagaattatatatcacaataatatcacaatatgccacgatgagttatatcaaaatgtgcatgcaatgtactacaattaagtgcctacagtctcttgtttaaaaaataattaataacctagcatttcaacaaaatatgcatacaatttaaatactgaaaagacacttagtgtagtgtatttaaatactgaaaagacacttagtgtagtgtatttaaatactgaaaagacacttaatgtaacagttcatactgtttcacaaaaacatgatttgacatagatatgtcaactgattgtaaaaacagcatggatcaaaatgctgcttaagaagcaaaattttattgaaagactaaaatattggagatataaattcaaattaaatgacaggtttttagcagaaggggaagaatatatacataagtgtccatatatttctatccaagttagtaactttaaataagtatttatctgtaaatagaaataatataaatcacatatgaaataatgtgtatataagtattcatctccaaaatgcttattaaccttaaacatttgtacctttattctcttatactataacatatgagtttttaaatagtttttttttatcagaaagaaatatcttactgaagtgtgaagacatttttaaaaagagcttcattaggaagtcttgggcctaattgttttttgttttataaattttaaatgactgctctgtgatgagcccatttcagttgaggctgtattatttttcctgtgggtaaaatgacatactgagctgatatggacatcacttctcccacttttgctattttaaaaatacagatatgctgcataaacatagcaaatagatttataaacatttagattcaagaaagaaagggaaattcctagatgtcagaccaaagagggaaatctaagttaagcataagcaaaagctcaagctaaactgagcaactggggtcatggggtggagggtgggagacaagtcttagttctaagatcagggctaaagtttggagttttaatgccctcactaggacttgacactaggatttggacccacagacggaaattgcagctgaactccctgaagcagggacactagaaatgctttcagacagtgaaatgggggctagaaaattcttcctgcaagcctacagaggcagctagaaaatttttctcttaggggctctgggtgggtaaaagttactaccttgtgtaggaccgaatccccaaacctgtgtgccacgtgggaatgggatacatttttattctccccttatgtgctggcattcttcaacaagtcaaggaaatgatattcccataggaaaaataatacagcctcaactgaaaatgatctcatcacaaagcaagtaaagtacacaaaaggaaaataactacaaaaggaaaccagtagccacaaaaatgaggatatttgtacacaaagaactagaaagggtagtctgaaataaatttgtattcataaaaatctgtgatcatattcttatcacataaatcataaaaatatgtttaaaatgtacaattataaaagcatgattagaagattgaagaataaacaaagaaggaatagaaaaaagtaatataaaatagacgctatattaaaattcaaaagtaaccaggtttggaaaagaaacatgtataatttacttccagaaatgaaaaaaatatgcagtcattgaaattaaaaattcaatgattgggttaaacaagagatgagaaactgcaggatagaaaatcagaaatataggcctgaaaaaattacctataaattgacatagggaagtaaataaatatgatgctaactgactcacagaattgtaaaattgaacagaagtttagcagaagttgccaaagaagagattagaagaagttgagggaaacaatattcaaaaaaataatgaaggagagaagaatgatcatgagttaaaaactattataaatcctcagtttgaggatgataaaaaataagtctacccctagtagaaaacctgtcaaccagcaagacaaagagaaaaatattaaaactgggggcaaatatctttattgtgagtgtttaccactcacagtccaacttcatggaaagaatattaaataatatatgtcctttagtaagaatattgaacccataagacagtttcactagattatagtccagaagaatcaatctataaaaagcagtagtatttctatatgtcagtgacaagcaaataaaaaatgtaataaaaatacttagaatagcaagaaaaacttcatgatacctaaaaataagtgtttgtaaaattgagataatttttaaaggttattgaagaacataaaattctaaatgaggagacagctgaggatcaccaagtaccagtgaaaatctgtgaaatttgaaatgtttaccatttctattaatagagttaattagtaccacaatttaggagggcaatatggtattatctagtatctttgaaggtgataaaaccctgtcaaccagcaattccacatccaaacatttaccccaaaaaactcttacaatgtatagagaaaaaccatctaaaatgtgctcaacgtaaatgtacttactatgatgaaaatgagaaaaataaatagcaaaaataaattgtagtgtttcctttaatctgataaaagaaacagttaaagtggttgaaatagatcttcatgtataaaccatgataaatttcagaaacttcaggtggaaaaaacaatgtcattatggtattatttatatcaagttgtaaaacataaaacaatgctacattgtttgtgaatacatatattataattaaaaaatttaaatacacttgtagggtaagtactaatttcagaatagtagttacctctagagaaacaggaaagggaataaaacagaagtgaaatgagattcatttgtatctaagtatcattgctttaaaaatatatctgaggcaaatataaaatataaatattttgttacctctaggttgcatgggtaatgcatgttatatgtgctttttgaatgtcttaatataatttctaatttaaaatttctttaattgaatgtaaaaaagaattccagatttaaaaagaggagaatgaaatttttaatacaatgtcaactacattattacattttacacataagattttctcttcaacaatgatgttaatgaatattatcatcattatatttcaaaatgtgaaagcagtgctagctcaagacactcaaatgtttataatatttttgcattgttaaaaatgttgaaatttctctcacgaattacaagaggcaagtcaatctcagatatatgacaagtcattgactataagtgctgtctgactctcagtatttgtttatttcaagtaccatatgctagaaattggctcttttgcagtttggtgtcatattatttatgcaaaatcagttggtatgtagaatctcacacataatataaattgacattgatctagttaggaacatgtgcttttatttttatcaaagtcttataatagaaagataaatagtgaagtagaagactagaaatcaaagtctgtattttcatcttgttttgctttgtttttattgcattttccattaagtccttacaggcccacgagactatgtgatctggccttggcttacctctccagaatgttcttgagtttcagtcactgtttttcagctttgcttaaatttcttgagtctcttagttgtttgtagcatctggaattttataagttctattcagatttcttgggatacctcatttctagccctattcctttgcttagccaggcatttttaatggctcggcttaacttcaactttctcaggaaagctgcccctgcatcctcaagtcatatcattctcatggcataatcacttttcaaacctttttcttttcttttatgatctcataatgagtaattctgttttatgtctatcttacctctggtgatgatatggaccctatatattttctttaccattgcacaataagaagataacacaatgactcatacaaaagaaagaaggaaggaagagaactaaaatctcgtgaagctttgacagtcatttagcctttccgattctgttttataatctatgaaatggtgttattgaatcttttctgcctctcagtaggtataattatcacactgaagccctgtacaagtataaagtataaccataaatacctactggattactttttgttgttgtttatattgcttttcccaagtagagataagtttctgttctttttccctgaaaggatttttatggtgtgttaacatttttattggttttggatttccctcttctttttcatttgtgtacaggaatggtcacttcattaacttgtagacttgattcctgggcatttttacaaatggacttcaatgtgtacatttaatcctgaatctaaattacagatgtagaatttttggcataaaaggttcatgcatgaatgaatttatctcttgcaacccctacagttcaaataatattatgttagtcaattttttacatggacagactctctccttgaccaaattttggaaagtcttctctgagtcctctttttgatgaggcctcatcgttgacccttgtcctcaaacctagcttggttaaagcaagaattctgctaagtcagtgtgttaagaacaccttacccttgatatctgatccctctggcctgtcttcaacaagaatcctgttaatttggtttagcaagaatcccccctacctacccctgatgtctcctcttaatgattgttcgcccctgatccttgctcgtggctataaatctctacccttttccttggcactgaatccctacttgttcatgttgtattgggaatggaggctagttctttactaaggttgctttttctctattgccatagtttctcactgaagcctattttcatcgttttaactactgtccagctctggttctctttcacaatattaaaagctgaacttgtgaaaattgagaactaatgtttatgtatttccttctccctccctaacccatcaactattatctagccttggaaaagtgtgttttaggagtaagtcctcaacaaatactgctaattaactaattatccttcttttgttaacttattttaatactaggatgcattagtctaaaggtcataacagaagaaaacctgtaattaactacaaactaccaaaaaaccaagcatgactgagaaattcctgaagcaattatcacacaaaaaaaataacttaaatgtcactggagctattcctggtaactttgtcagtagtactcccagctgactaacaatcacagttcaatatgtactgctgaagttgtacctagtttataaagcagtagcttctatgagaaagaatacaagaaaactacggtgactatttctccagagaaaaactgtactgaggaaactatagcaaaaagaaaattgatgtcaacacaatagtatctcacttcaagaaatcaaaaacaaaagaacttagtaaaatttttctaattcaactttgtttttaaagggaaaagagaactaaagaaaaaaaagacagccatgattttttgtagcgtaggccacaacattgagctatgttcaaaggaaatagatgtctaaagcacacatttcttcctaaaagaatgaaaattggttctttgggaacaaaaatatcatattgattttatgtaaaggcaaacattcacatggtgcatctgtacataaaatatatctggagtattaaagtttcatggtggggatgattatgaaaaaatgactatataggctccatagggacatgatgataaaaaatagattaagtagattgaaaacactagtctaaagtgaagtgatgtgttttaatatcataatatgtgagaatataaaagtatttacgtatggattatttacaatggaaaaatgactattatagttcatatttcattttattaatgtaattgattagaataatggtatagaaatagcaaaagcagaatatttggttttaagaaaatatggtgatataagggaatgaatattaatttctagagtggaagtctgtagcgttctagaaattaccgtgttttataggctgtagtgtgaaaattatcattaaatacgcaaattgaaaagaatcactaatggactctatacaaataaagtgttaaaatgaatttattggatcaataggagcttcccagtaggaatgctgagaggtttaatagattagactccattttgtttagattaacagttaaaacaactttaaaaatttttattaaattatgtttttgcaaccattgaagtatagataaacaaaaaaagaaaaaaattaattatatgttaataactttttaaaattcatcagtacaaataaattatagaatcataaaggaaaatagaaatctcatgatgattaaaataacattcagtctggaaggtacaaaacttttaccttcatcattcgatatttaggttcaattatattcccatctatgctttagggactgaattggatggtggtaataaggtataatatatggtctgtgccaatcttatggatggcaagaaaagaacaaaattatggttttactgtgtgtatttatttatttatttatttcaataaatgccctttagtagatatttttacatctggagacattctcacatctggaagaggacactgcaacagtagcctattttaatcttgtcatgaaaatcttgggatacatcttttttgctcaactccctggtttttctgtcttatttttttcttcggggcatagtggacactggtgatgaatttggtgtcagatccagaacatgttgtctgtacccctcttacagcagtgattttcttccaccttgtaatataattatctgaagtccgcctcatcagaaagtacatagggaaactatcgtgactctatttctccaagtagaaactgtgctaagggaactaaagcaaaaaagaaaattcctacttcctttgctataatcctcttgagggcatttttatattccctgtgatatctcatatgtcttgtatatagtagttcagctatgagttgatgaacgaataatataaagaataaagcaacgataagaaataatgagcagagcatttattaataatttgatattgataacagaggaagttaaattattcaaagagctcaaccataaagcagatggcttcactttcaagctgggaatcaaaaaactttaagtgctagaatattcatgtcaagaggatcttccaagaataagccaggaatgcaattaggggctgactcatggatgacaatggtcgatgagtcacaaagaaattttgaaaaaacaatgatgtccctggggacacatagaaagaattggaactagactgtcaagatcatatatattaacaagctaatagaaggcgggaaattttggtctctatgaaaatgtgcacaaaagtcccagaacactatacttctgtgtttgaactgtgctactctaaattatataaaatatactctataatgtagtaaagaaagatttctttatgccaatgtctcacattttatagacattttacctgctactgtcaacttaagttactcaagtatagttctgttgatttatctcctaatgaacaaccgctaatgacttaccaattcctaaggaatatctcttaggatggactttctgagggcagggccctggatctcaagtaccaagtgaagttctagcatacaggaagtattaaatacaggctgagtatcccttatccaaaatgcttgagaccagaaatgtttccgatttggtattttttcggattttggaatatttgcagaatacatactggctgatcattcctaatcagaaaatccaaaatctgaaatgctctagtgaacattccatttgagcatcatataggtgcccccaaagtttcaaattttgaaacatttaagattttggattttctgattagggatgctcaacctgcacatttgtcttgaaaaataaataatgaataaacctccaacttttaaaatgaattcttgttcccaatgtctttgctaacatcggtctctcattctatctatgtccacaagttgaatttttaaaccatgcttcaaggatcaggtcaaactccactcctgtcataaagcttccttaagccttatagcaaaaattagtgcttcctctatgttcccgtaattatttatttctcagatgcacttaccatattccaccttgcattatagttgattgtgagtatatctttttacccaactagatattggcctttaaagacagacttatttaaagacagaccttgacttatttatcttcatagtgcctagaattcctaccctaatgtgttgcttcaggttattaaataaaattgaatgtgaaattatttaatcatattttttcaaggtcattttactaggctaaaatggagctaaggaaaatgtagctaatgtctgcaaatttctaattgttgaacttagtctgaatctcagaatagtggcattataagctttcaaattagagtaaatgaaaagtagattagaccaagcgcataagaacacagtatacagaacagctgtactgtgtcctcaacgggataaactaaatcataattacagatatgtttcatctttcttgcctttatactcttttgaagatgctctcaacttcagtgctttggggatttatttgtcactgtaagtctgaaattagtttgattagttttgctgatatctatcatttcaaaatgtctgaaatctgccttaaaaagtaagctggcacaaatcttggggcagtgcttattaaggttcccacatagaagtggctgagtttgtaaatgagtcatagaaattcagtatcaaaaagttaatttaaaacaaattattctcttggatataaggaggactgctttgtttattcttaaatttttctccttacttcttcatgctatttttctcttctcttctgattttccttatatgttctcagattttatcatccctatcttctgctcaatctgggtttgtttaaagtgtttttattcagctcgtactatgcgtatagcactttgctatgcatgaaaaacatgactgccaagagatttatttgaacttaataaattttatgaagctaatgctcagtgctgtaccaggaaccatgttattttctcagactataaagttagtaagacagaatttctacctctgaatagattatggtagatagctagagagaacaatctttgagcaatacttttttgtggttgtgatagggtaatgtatacagggccacgaaaactacatggagagagaagttagttgtccaagggaattttttaaaaagcctcagtattgataataagggaattcaaggaagaggggaaatgtagagaaaatgcgtatgtagggaatattacaaatctgtttcctggaaagcaggatgccttcctttagaattattagttaagattaaccactctttaaattgagagattatatccttccctgtttttcattatatggtcagctttcactggcctgagtccacattttaagctcaactatatacaaataatttttcagtatactgagagtaggattaatgaaaccagtctggagagcagtcacagaatgagaatagatctttcccatagtatcactatgtgactaactgattgtactgatgtgttacagaaaacactgtaaaaagttaaccagaggaaaactttgctttctactttatctgatctttaccccagtttctctacctgtcaaattcctatgcttgcctcaaatgtacatatttttaatctgaaatgtgaaaagtatttataactggtgtaatatcaatgttctattatacatccatgcattaatgtctttaattttaccatgaaattaaatgaagtacctcaataacagaacagtgaactttaaatgaagtagctcaataacagaacagtgaacctaactggccccattttagtcaatctaatgcattcctgcacaggtatttatcatgacatttactctacactcaacctacatgaagatcaacatagtcacttttacgagagtagatttgcatccatccaataatctttctcaccagtgtaattagaaaggatacagcttaacacatagcttttgagcagatttttaaaaatatcattatacgttaaatatagttgagagggtaaaatgaagaatgtacagttaatattttccttatacagacatggacgcagctcataatgttgaaggatacctctgttgctgatacatctctttatttgcaggaaaatgttgaaggaggagactgtagtcgttgcaaatccggcttcttcaatttgcaagaggataattggaaaggctgcgatgagtgtttctgttcaggggtttcaaacagatgtcagagttcctactggacctatggcaaagtaagcaagcaccatttggttctgtttgctgccccagcagccttctttgttgctttcatcgttgttcttttgtatgaacagtttctgatagtgaacttctacataaagttacaggaagaagtaatggaattttcttcaaatgctgttgtgtatttttgctcaaagcctttgaggttgtatttgtaatattgtgtagactggaatttcttagaataggtagacatagtctttttagtgtccatgattactctatgaaacaataatgcaattaaggtttcaactccaagggtgcatgatttaagagagaaaacactacattgtgatatgaattatattttccattactagtatgttcgtatgcaagttgagaaaaactctgtatcatctgtatacataatacatattatccaccaacgctttagttactatttgatgttgcctaggctctttcattattaaaaggggacattaaatataggcaataccttcattctgagttggtttgaaaaattattacttaaactatttaatagcaactgaaattttctttctttaacgtaaatgtgtttacctttctaacttcactgcctacactacccactgccttttcaaatctgtgcaaagagcatgttgtctccctatacagaaaagtgtcagaggaaaatgggaccttctgggaatttcacacagcctgtgtggctggacttaagagtgcagaatggtaggaaatgggctggagagagaaagaagtctagacgggggaatgagaatctagaacttatagggttgaatatactaagaatttgagatattttacttggagtgtcattgaagaaatttaagctaaagactgacattatcagagttgtgttttataaagactactatttagataaactatttcctaaacacttcttcctttcaactttaatcagtgaactaatcctgaacagagctataaaatattttctctgcctgcagtgcttttaagtcaagcctcatattatgaaatattatctatacgttatcaactgtattgctttcagagcagacttcaaagaatcaaccacagatggacatctagtctaacttcctcttttgtttataaagtcccaccccaccctccagactgccccactgatagatcaaagtttcatagccagccaaggggcagagctggtactcaagctttgatcatcagatgctagagacacagaatcccattcaactgtcttacaatgcctcaagggtgacgttagaaagggaagaaatgcaaggaatatattacttgttgtccagaaagtcaacaggttgtacctggtttctatttctcatttaactaagggaattgcagtgattccacagctttgggataagcagagtcaaatagtctatgaagaaattttaaaaaatatttcagccacatagagtcacccttagcattctgcttcccatcacccacaacatgaagcagctcatgcatgtctagtaggttcctggtagctggtaccctaagccctcagtaatcagtgttttgtcctgactaggtaggatgctttaaattagaggtgtagctgtaggcctgaccttggctgaagcataaagatgtaaaaacaaatcattatgcattcccagattcctcctttaaggttccttccatttctgggccagggatctaggctgtaggtccccacagcacttctgaccctatctgaaggaatacatacagtattgccaggtgttgtcatagcaccaaggctggtgggttcaaatatccttaagcctcaaagtagaaattttaaaaagtgggaggggtggaaatactgaatgaaacaccacctttcaggtacttgcatagtttctttctttttccctctgcattacaaatacatacgcaatactttttcaggttgttttttccaaaagcaacaataaactactagtggagtaaaaaatacggaactgaaagtccaactgtttgattaagtgtatgttataaccattgtatgactttgagtgaatttctatttttaagaaagtggtatttggaaccacaattttttaaaaagcataggttcaatgaaaacagattattatagaataccttggaaactcctagaaacatcaaggaaaaaaaataaacaatggaagcctatgtgagtacatataatatgtctaatgatattcataatgctcaggtttttttctaaatgtttgtggtttggttttttttgtttttaatttccaaaagtggacacgaccaggaacatgaaagagaaaagcagctgatagatattttttaaaaattaatgatgactgtgtgttttctctaagatacaagatatgagtggctggtatctgactgaccttcctggccgcattcgagtggctccccagcaggacgacttggactcacctcagcagatcagcatcagtaacgcggaggcccggcaagccctgccgcacagctactactggagcgcgccggctccctatctgggaaacaaagtaagtccacgcttgcttcccgctattctgctttaactgactgatcgtgagaatgggttttagttggtaattcttttaaagaaagacaaaatcaaatacacactgaattggattgccagaaccagctaaatcacattgagttgggcgtttcttccatgttgcacaagaccttaaagagccacggcatccttaatatgcaactttgtatagctgatgttctatgtaaactttttgaatgggcaaataaattaatgaagccgctagtgtattttcgtaaagcaaattataggtattggaagaaactgtgttgtgtttatgtgaaaagagctgttttctggagttgtctgtggtgggatacttactaaagtttttctcatcggtttctatttcatttcaaaactgatactcaggagatttacttttccttctacctgatatgaatgttaattggaaaagaaatgtattacataactaattaaatgcttgccatgaggcttatgtaaacaacatatttgctggagctcaggcagaaactaccctaaaagtgccagattggaagcacgtttgttttaaagcccacacatatgtaaaaacatacacagataaacaaatgtagcagcctcagaaatacaggcttatttttttctgttgtggattacttctatctagatagatatcctggggtttagaattttattttatcttgcctaatactttgttggaaacaaaatttggtgacttatttataaacgtgaatacttgcttgttctgtgaaagttaataccttctcagctgatagttaaaatacctgatcacaccagaaggtgtgatgggaaaatcccttcctaaattaatgttgtttaagcctagtttacacctaacaaaatatagcattatttatgaagaaatcataattgattaagcaaataaaagtatgtttatagtcagtggttttcttgcatgacatgtgagtattgaaatagaaaaacttagtatctcatatgctactcagtgaatgggaactggtggtgttggctggttgaaacacttttaacttatggccagtttcttatatttaacagaactctgaatgctattacaaaaaatgtgtaaatgtctaaaagacattttcaatgaacatgtattttaagagacagagtatgttgcataaaattcaatagctgtaaaataaaaatcgaattaaacttttatttgcaaggccctttacagcaagaagtcattttatcctattctatttaggaaactctggtattcccaaaagaacaaaacagcacataagacttgaatttctactgcttaaaattgccaaaaaaatataaaaatatactgtcaatttaaaaaaaaaacaactgagagctccaagaagagccttaggtcaaaattggatgaatttcagaggccttatttcttatatgatggcaacacttaattaaagtagcttataatagaaatattctttaccagattttccatcctttcttctttggtcatatgcatttttttttctgttggctgacaatcaaactgacagaaggaaagcaagcaaatggaatattcggtagaatcagaacaaagaatttggacatcccattagtagttgttggttcccgaagataacttcccttatcctggctgaaatatttttcttataacccacagtgaagctcttcatattcccctaccgatcattttcacatcaaaacactgttcttgcctgtactgccgtttccattcagtgaacaaaataacattaacagggtgtgcaaattgtttgaatacggaggacatttttaatgtaacgtggaagcccttggtggtttactgtcaggcatctcagtatgaatgaaacaatttgccttaataactgaaccatgtaaatttttgatactacaataatactgcaagctctcagaaattaccacagtacatcttaactgtcatgtcacatcacgtaaattatagtcatgatgacatgcttagcttggttgatttaatatcttgctaaggaagtggaaaattgtagggccttgttggtaaattcaataaagccacttttctaaatagttgaggctaaattctttaccagtaattgctgttcgaatcagaaccattgccagaatctgacagaaatagcgtatcaagatacaagtgcatctgcttaaatattgaattttatttacatccatgaccaggagtctatggtacataatccttcctctgcttttttagtgttatttcctaattggaaaaaattatgagatgctattagcttttcctaaatatttatatacagactttcaaacattttccaagttgcttggttataaggcttcttctaacagaagggcgatatgctgtgcatgttctcttataatggagatgccacatgctgttattctttttttaggagcctaatcccaaataataaaagtggctcacatgggacacatttttgctaacatggatgtctgcctggttgtaataaaactcaagaatactagccaatttagcaaaggagtgctttgtatcctgtgaaacatttttcacatttttactgttttggaataatgaagtataagtaagtgattataagtgtatgtgtggataatggatgaggcctaggaaaacttagcacgtttttatactttctatttttgaaattcccacagtctcagctaggagttgttcctccaattttttcccctatgtaccagtgaatatttggcacaactggcagaatcaagtgttaattttcccgcctcgttcttgatagtcaaagagaattaaatcaggcacccacagggctatcctaggtgcatttcattttcaaaatgcttggcaaatgttaatgcttggttttagggcatttgtttaagcaactaggcagcagtggaaagagctagaggacaaagaatcctgctggtttgctgcaggctacagctattcagaaacagtttgggaatttcagagttgggataatttactgccctagtaaactaagtgctactggaacattgcaacagtcatttgcttaaggttgccctagtggtctgaaatagttgaggcagcttccaaaagcaattctctttgcatctgtaaagttctgggagaagctagcttggcttgtctgctgttcctgcattaccattaaggtttgaaattctctctctgaatattattaaattaatcttatgtgatttgttctttaccaaaacctgcttattttctacagcattatgctatctttctgtttctagcttagagaagcctttaaatttgttcatatagttgccaagaatacctatagtctagtttaagatgcacattaggagagtctgctgacataatagcatctggcttctaaaagtaatctctggtaaactcttttgttttgttgttcttgcttgactttccattctacttcacggatctcaaattaaagctatagatttgaagaaggaaactgatatttgagatttgtaggacagggtagatctcatcatataaaagaagctcaacaaataccttgtaattgatgctacatgcttaacacaaacaaacaaaactctaagaaattgttttttttaggttgctcagaaatgcccattgagttggatttgtgggagttgaaagatgaattctgtcttgctttacaaaataattaaaaactcgctaacaaatatgttccactctcctttgagcagcatattttgtgacttctttgctccatagtcctcaaaattattcagaagtggagttcaaacccctcctcgccatccataacttcctcctatttaaatcttggattaaatgggttagttaagaagatcattatgcaagtgaagaatggtatggctataaaagtaaataggataaatcaactgtggttgattttttattccataaatcagatcccatcaagactaacttggcaatggagtagaaccaggaagaaggtttgctgcctagaataaactgaatgaatttgtaaaccaaaaataaaattctaagacccctgactgaacggacccccttcttggccaagggaatcccaaagaaacctaaagaaacctgaacatcatgggaagggacgattacacattcctcattataccctgctccctttggagtttagacaccacagaccaacagtaacattaaaacagagattttaaaactgactagacagacactttacagcaacaagataccaaattctaacctcactctggtatagcataacataacagatagcaggccctaaaagaaatcaaagtattttataccaaaatatatttatttgacatattctgaaatgaccttgcaaagctgtctcttggggaaatttgcattctatagagaatctccttcccttactaagtcttttctggagagtcagataccttttaaggtctggcaagagacattcaccatcagcctgctactttaccctactaccttgaggcttcatctacatgacaagaaccgtggcttccacaacccactctcttaactcaagctgacttcaactgttcaggcagaattttactctttcgaccaattgccagtcagaaaatctttgaatccatcaatgacttggaagcccccacctcgcttcaagatgtcctacttttctgggccgaaccaatgtgtaacttagtactggtgtatgtctttgcctgcaactttcgtctccctaaaatatataacgccaagctgtaacccagtcatctttggcacatattctcaggacctcctaaggctgtgtcacaggccatggtccttaaccttgccaaataaacctctaaattgattgagacctgtttctgatactttttggtttacaaattgttaaggataaatgagaaaataagtattaaaaaacaaaaaaaatcaaggactcatttatttcccatagctatgatagaatctgctgtgtaaaagtaacacaaatgcaggagctcaaggtcaaacatagaaacctctgtcttacatatccgtcataacattctcttgacgtttttcctaattaaatttataaagcattagttctaatgttaaaaattgttatataaaaagcattttaatattcacatgcatctgtctacagtgttttacattttgtttataattcgtcaactgaatgaatactagataggagaatgttccatttaataaaaactcttgagaaaaataaaatagcttacttaacagtaatttcaatgtgagttggtttgtgatgtggttggcaacaaaacttacgtaatctagggctacattggcaggaatttactggtcaggacaaaggaggtagtgtttatacagattctgcacaaaacgcatgtcacctaatattattattaaatattattaaatattattaatatttagcttacttgtgaatttctctttttatctttgttaatatacatgacccaagtcatcagctaataaaccaagaaatccaaattaggaagaaatagagccaggattacaatccagatgtgtctatagcccattccagttaagcattttttcaatcagttaagtttattagttcttgcaaggcattgatctttggaatagagatgctgaagcagcttattcaaaagaaagggaacgacaaagatatgaatttataaaaatacaaatgaatgagatgaataacaaatgtcaatagaggggacacaaatccaacaagttttttaaatggtttcaaagctctggcaagattaatcaagcaaaacgtgggtaaaacacaaataaacaattttagaaatgtaaaaatgggcataactgcaattacttcaaaaataaacaaataaggaagtatcagaaaataaacaaattaagagtattatgaaaatttacacacaataagaatacaatttagaaaaaggaatatccttctaggaaaatgcaacttaaaaaaactgactcaaagaaaaaaaatctataatgtcagataaacattaaagtaattgaatcagcagtcaaataaaccttccaatgaagttaactccaagcctattgatttgcaagtaatatcaatcaaaattcaaaaatttttaaaaatgcaaaattatacaaactttccagagaatagaacaactgggacgtactcctcacataattttatgtggcttgatataaaatcttgacaagaggactatgaagaagaaaacccctacccaaagtcactcatgaacgtagatgaaaatatcctaaataaaatattaacaacccaaatccatcagtttataaaaatagtcaggctaaattggccaagtggattttatcatccgtgtttgaggttactttaaaattagaaaaccagtttaagtaattgaccatattgactgattaaaagagaaaaaaatcaattatctcaatagacacagaaaaagaaatgggtaaaattaaacattcttcatgtctgaaaaattttgaaaactagaattggaaaagcactttaactgatgaaggctatctacataaaaatcaatagcaaatatcttatttaatataaaatgttcaaagtattgtttaagatcacaaacatgaaacaattctcactataacgactcccacttaacattgtgctagaagatgtggacagtgcagtagataggaaataaaatatatagggatcagaaaggaagaaataaaactcacttatagatgatatacttatctgcttgtaaaatcaagagaatctacagacaaattcttaatcagtgagtcaataaggagactatatgcaaaattaatatacaaaagtcaatcatgtttctttatatcaacaacacttttcaaaaaaaatttttaagaggccatgtataatagcaatacatataaatagtaccaaggattaaatttgtagggaaaagccaatggccaagaataatcaaaagaaattatagatggggtgcgatggctcacatatgtaatcccagcactttgggaggccaaggtaggtggatcacctgaggtcagaagttcgagaccaccctggccaacatggcaaaaccctgtctctactaaaaatacaaaaattagccaggtgtggtgacaaacgcctgcaatcccagctactcgggaggctgatgcaagagaattgcttggacccaggaggcagaggctgcagtgagccaagattgggtcactgcactccagcctggggcatagagcgagaccctctccaaaaatatatatatacacgtgtatatgtgtacacgtatatatatgtgtatatatatacgtgtacacatatacacgtgtatatatatatacgtgtacacatatacatgtgtatatatacatgtacacatatacatgtgtatatatatacgtgtacacatatacatgtgtatatatatacgtgtacacatatacatgtgtatatatatacgtgtacacatatacatgtgtgtatatatatacgtgtacacatatacatatacacgtatatgtgtacacatatacatatacacgtgtatgtgtacacatatacatgtgtatatacatgtacacatatacatatacgtgtatatgtgtacacatatacatatatgtatatatatacatgtacacatatacatgtatatatatgtgtatgtacacatatatatgtgtgtgtatatgcatatatgtatatatgtgagtgtgtgtatatatatatatttagaaattctaaaggaaagaagtggggctttttggaaagggattaggtcatgagggttctaatctccatgaatggaattaatgcccttatgaaaatcttatctgatataaagagttaggacttactttaaaagatataatgactaaggcaaaatgctatcagtgtgaaaataaaccaatagacctgaaaaaatagcccatagatatcacatacatagatgaatacttaacttttattgaaataggcattgcagatcaatgacaatgggatagaccctatacagtaaatggtctggtaccactgattatctagagaaaaaaaataaaatttctgcatccttactccacattatacataaaaataaactccccttgaaacaaatcataaattttcaaaaattatgctaaagacaaacctttataaagacaacacattgagatttctgctcctgaccataattgaataatagtatctagatttccttatctaccttaaacaacaacaaagcctgagggggaaaaaatgtggaacaacagtttttagacactcttccacagatagcataaaactgtgatctctgaaaaagagaaacaaatggggtgaggtttacaattgccccaagattattgcctggggacagtctccagggtgaagtgcattggtatattgagaaaaaagccaaacacagcctggccttgccaaattgaaagacagaggttagggttcatggaggccaaggcagctagcatttgtgaggcagcatacaagggaagaggaacctgacctgcacagagagagagacgaggagagagctgcagctatctgcaaagagaaaccggagtactgagttgcaaatatgtgaaagaaaactacctaaggctaatgaaagaatcactaaaaagtagtaagagaaacaattcctgagctgatacagggctgctaatagtttattttcctaacacccaaagtggaatgtcttcataagagggactaaattagctccaaactacaagctactctaggttcaccccaacaaatcttgaaaacagccttaaaagaagtcaacttattccaaataaattaactgcatgccagaacaaagtccaatactatttaattacaacaaaatccagcactcaacaatgtaaaattcatgatgtttggcatcaaatcaaaaactaccaggtacataaacaagcagagcatataagccactaccaggaggaaaatcaatcaatggaaacagaaccccaaatggcaagaaaatcatgtcaagatatatcagaatcaaattattaaaaagacagataactggaaaattgtaaaagcaatcagaaaaaaactaacatggccaggcgcggtggctcatgcctgtaatcccagcactttgggaggccaaggcaggtggatcacgaggtcaggagttcaagaccagcctggccaatatggtgaaaccccatctctactaaaaatacaaaaattagctgggcatggtggtgcacacctgtagtcccagctgctcaggaggctgaggcaggagaatcacttgaacctgggaggcgatggtttcagtgagccgagatcataccactgcactccagcctaagcaacagagcgagagtctgtctcaaaaaaaaaaaaaaaaaaaaaagaaaagaaaagaaaacacaacaggtgcagaggaacaaagataaggaagaatagtttcttgtcagaccctatatgctatggtccaaatgttggtgtccccctaaaacttatatgctggaacctaatgcctaatgtgatagtatttagaggtggggcttttgggggagtgattaagtcatgagggctctaatctccatgaatgggattaacatccttacaaaagaggttgaggatgctgccttgccctttcctttacgtgaaggggcagcaaggaggtaccaccttggaagcagagagcaagccctcaccacacatcaaatctgctgatgcctggatcttggatttcctagtctccagcactgtgagcagtatatttttaatgcttaaaaactacctagtccctgttattttgttgtagcagcctgaatgcatcagtacactttgcaagccagaatacaatacagagatatgttaaagtattaggaaaaaacaacgcaagcaatcaaatgaacaaaacaaatactatcagtctataattctttaccaggcaaaaatgtcttccaaaactgaagaaaaaacaaagattgtttcagagaaatagaagttgaaagaatgtgtcacagactgatgtacacaagaagaaatgtagaaagttcttcaggcaaaagaaaaatgttaccagatggaaatttactcctacaaatagaaattaagtgtatcaaacaggtgaatagcaatgctttgtcactagtgctagctgtcacaagacctctagccagtcatgttttcagctgtagggcctaacaccatggttaaggaatggttacctaaatacacaaacttaaagtagaacttcaaatacttcctgtataaaattttccctctgaagttttaaaaagaaagactgggttgtaagaagagtataaaaaaggcttgcttctccagctctcatttctcatttcaaacttaaagaaagaaaaccagcaccaatttgaaagtgtttcaataaactctcaatgtaaaacttcacgttgttttctgtagcttttcagtaacttcttacactcatgttctatgtgcggctcagtggggaactatctgtatccagtggattgttggttctgacacactagcctacgtgcatatggggcaacccccaacatgctggcccctgccacttgcaatagatcagacccaccccttgtggttgagtgaggcagtattatgtcaattctaaacctggcattttgtttactgttgttgagtgttgttggtagtgggagaagaaaataggtcacagacagtgtgaagacacaaggagaagacagccatctacaagctaaggagagagggctgcaacagcttaattccttgtagtgttcataaagaaccaatcctgctgacagcttgatctcacatagcaaaataatacatgactttttttcctccttgatttccatgagaattgggtgaaagctattactcatataagcggatgacctgattctctcatttttgtggttacctttgattagtgttttggtctttatgcgtttcacagacctgattcaaatgctggatctctgctttattagctttgtgatcttggacatatcccttaatctagttgagccagattctcattatctgcaaaatgaggcttctagcacccctcagaattgtacaaagctctcgaaaatgtccttagcacacagaagctgtccgataaatgccaattgctttatgaatttctgtagttgtatgctgcagtaatttattttggagatcttccttatatcagtaaaagacgtttgttaaaaaacactttgtcacctgtctgacatagtatctggtggtagtaaggataagacatcattaaaaataaaaattgacaatcagagagagttaattttagcaagtacgtagattatatgcctttaatggcagctttgcagcaaagtgcaaaacataaataaatcagttaaccagatttgtgaaatacccgcagagtgttttagactttattttgaaggtgccaaattagagctaacatgcatcgcttcatgtcttcccaagaaaattacatgacaaatatctatctctgcttcactgacaacctggcagtgaaagggatttgaggtttgtgcccatcagtaactaattagagaagtaaatgttataactagtcagtattctgtggctacaatgtggcaagttaaaataatatccttaaggtgggcgctaacgcaatatgactggtatccttatgaaaaaaaaaaaaaaggacaatttggagataaacacaccgacagggtaaacaccatgtgaacatgatgatggccattcacaagcaaaggagagaggcctggaacagattcctcttagccctcaaagggaactaaccctgccgataccttgatttcagacttgtagcctctagaactgtgaaacaatacatttctgttgtataagccacccagtctatggtattttattatggcagccctagcaaaccaatacaaatcataaaacatcaattatttttaaaatctcataattttcattcttgttatatatatataaaacaaataaaaggtgactctctctaatgtataaagaagttaaagaaattgataacagaaaggccagcagtccaacagaaatgaatgagcagtttatagagaaggaaatttaaatggctcttaaatgtatgaaacggtactcaacccgactcatagtatgctaactacactgagaaatcattgtcttctaacatataggaaagtcaaccaaatgaataacacatgccattcctgtggcttcttcaggaacaaaggtcctcctaaattggtagtgtgaatatacattgatgcaatccaaaaaaaaaatccaaagttatagctgggcagggtggctcatgcctgtaatcccagcactttgggaggctgaggcagatggatcacgacgtcaggagatggagaccatcctggttaacatggtgaaaccccgtctctactaaaaaaaatacaaaaaattagctggacctagtggcacacgcctgtagtcccagctacttgagaggctgaggcaggagaatcgcttgaatccaggaggcagaggttgcagtgagcagagatcatgccactacactccagcctgggtgacagagcaagggattccatctcaaaaaaaaaagaaaaaagaaaaaaaaatccaaagttataaatgcacagtcttacatacttctcttctgggaatttattctgtaagtatatatatatatatacacacacacacacacacacacacacacacacacacacacgtgtgtgaaatgacatatatgcaaagtgattcattccagaaatgtttgtaattgtcaccacaaagctgccaatcactgagagactgattaaatgagttttggtacactcgtgccatcaaacactataaaattattaaaaaaggaaggaagatttttgtataataatatggaatgatccaaggtgtattttaaataaattaaacttaggaggccaggtgcactggctcacgcctgtaatcccaacacttttggtggttgagacaggcagatcactggagaccaggagttcaagaccagcctggccaacatggtgaaaccccactctactaaaaatacaaaaattagcgggtgtggtggtgtgtgcatgtagtccccactaccagggaggctgaggcatgagaatcacctgaactccggaggcggagattgcagtgagctgaaattgtgccactgcactccagcctgggtgacagactgagactccatctcaaaaaaaaaagaaaggaaaagaaaaaaaggaagggaagggaagggaaaggaaaggaaaggaggaaggaagggagggagggagggaggaaggaaggaaggaaggaaggaaggaaggaaggaaggaaggaaggaaggaaggaaggaaattaaacctaggaacaaagtagtttatctatctaatctatatgtatgactactatttgtcttttaaagtggagaaacgaatatgtccttgtaattataaggtgacttagctatttagagtcacatctagcatttgcatcaaggtgagtttgtctcaaaagctctgttctagtgccccactcaagaacagatattgtcaaatttgtaaaagatattttaactggaatagacttgatttttattgctgatttaatctattacaaactattgcttttctattctaagctgttgtaaaaattattgctttaatatgatcacttaataagcattaaatgccccaatcctatctgctaaaaattgtttggcatgtttaattgatcacaaggatttgaatagcactcttatcttttcaagtatcttcaagaaattcttattttcagcagggcatgttgaggaaacataaagcttacattttttattcctgatgtcttctcatcacttccaacagtagccactgagtcaaagcagttgctctctttccttactttttctaaagctctccctctatattagctgtgtctgagattgcaggcagttaaaatccaacatttggcacactgaaaaaggggctatgtgatagggcctccaactgaaatgtgatgaattattaaacaggtagtttgttgggtgattgaaaattacctgtgaaagagtgcttatctccttgaggcacatcgaaagctgacggaattgagccaattagactgactgtctcttcaatgagttgtgacctatcaatggtaatagcttattatgatgataaatgaacccatctctcaaactgaagcctgagtacacacttcagcagttgccttgaatcatgaggccattgcctctcaacttcagatcgacagcagtgacagccacaggagcagagagcatgcatgactagacacagatgattgttttactcagatgaatatatttacagctatttccaaagaaacgggcccttcttttgcattgtgtattcgtatctgaaatagttaccatatgacgtttccttcattaggaagagaacccctccctggctgtagcattctgaaataactggattttgaaggtcttttttttttcttcactttttgtttattgtttacaatgttttaatttctcattcttgtgagtaataactcaactcctggttaagtaaaatttcagaataaaaatattgttttatagtaaagatgcttgtaatatcaaaacaagtatgtttttaaaaaattaatttcatcctattacatttcacattttatatttgatgtgggttggaggagccccttagagattcttttttctttgtagagaagttttgtagagatcaatagtgtaagaatcatacaagtgtaaatagttttgtttccttttaatttttcaaaatatttgaaaattctttaagtagttactgaaatttggtaagttccatgtgctgctatattgatacattttgttttagaagaattaggagcaaaagggttatttttataatgaaatacaatcttccagttcctaataagtattagacacctgttagctgccaacttcccaaaaatacccctgagaaaaaaaaaaacctgttggtcaagaaagttcacgaagttattacagtaaacaagaacatcaccttgatattcttagtaatgtctcagaaggtgagggtcaggggaagatatttacaggctttagggaaaaggctggttgatttcaaggcaaatcttgagtgagagggaactggttgggattctgcagggtttattatataatagttttggatttgtcaccagagtgaacaaacattgaagaacatgttatgagtctataaggaagttagcttagatggatcacagagcagacaaggttttcttggagattgctcacagcattcttaaaatagggggtggacatttttcttactcccagcattatttagcacaggaaaggaaattgtgttagcgttagaagaaattgtgtttgctttagttcttacagacaatatatttacttaatcttctgtgacactgtttcttaatgtataaaatgaaaataatatgaatacctactttatagtgttattttgagggttaaatgagttaacacatatgcagtactcaagatggtgtctgaaaatgataagcatttggtattagctattattattaactccaactgggcttaatttgaggtcaggcattattttgttgaaattttagaaagactcccctcacacataaacagacagaaagagagagaggaagaaagaagaaaagagagagatagagagaggcagaaagagaaaaagaaagaaagagagaaagaaaaggaagagaaagaaagaaagagaaagaaagagaaagaaaggaggaaggaaagaagagagggagaaagaatggaagaaagaaagaaagaagaaagaaagaaggaaggaagagagggagaaagaaagagaaagagaaggaaagaaagaaaaaggaaggaaggaaggaaaagggagggagggagggaaggaaggagggagggaggaaggaaggaagaggaagcagggagggcaaggaaaggaaaacaatggaaagaataaagaaataaatgcagcaggaaaggaaaaagaataggaagaatttgctcatatctgtctaatttttagggtattttgatatacaaagtaactgactgtcaggacctgtcttagagatgatctggtaggacagtaaatggcttttctttccagttttcatctgggactgggtttgaagtgatcatcagcctcagtgttctggaaataagtcatttataatgaaatggaactggaaataacccacagacaaaaagctttgcaagccattgaagttcccctaggccatttactgccttaagctcgtttttactcatactgcaggaaaaaaaagagtgagtagggaggtggtgttcttatatcacataattttaaattaagatgtgatggttttatataaaagcaaaaatgctttattttgctttttttgttcaagacaagtacagggatgaaatgtaaatatgttaatatctaatcttaagtctgctcttgatccgaaactcttttgaaactttacctagaaaatgatagagcaatttaatgtgtctcacaatctagcagagatttggagggtgatggatagaataagggcttaacacaagaaataatttctgttgtacaaagctcatgagcttcatgcatggtgaaagatatttaggctaaagaaaatgttaactatgcagggaatgaaactcgtgacagcttgatcccataaaactcagcaaggatgaggtttgactctgcatccctgatttatatagtacagtatgtttatttaaaggagataagccaggttaaggggttcagcaaaactgttaaattaactcctttaaaaatctagttattgctatgaaagtctctcaagtgcggtgctcaggcttttttgcatcagtcatctggagtctttatttaaaatgtttattattggccgggcgcggtggctcacgcctgtaatcccagcactttgggaggctgaggcgggcggataacgaggtcaggagatcgagaccatcctggctaacacgatgaaatcccatctctactaaatatacataaaaattagccaggcagggtagcgggcacctgtaatcccagctactcgggaggctgaggcaggagaatgacgtgaagccgggaggtggagcttgcagtgagccgtgatcgcgccactgcactccagcccgggcgacagagcgagactccatctcaaaaaaaaaaaaaaaaaaaaaatttttactattgacccttactctggattcacttatccagaagatctggggaaatctacgtttttaatcagctccccaagtgattatttacccataagaatttggggggcactcttttatgactacttttttaaattactgatgattaattatctgcagatagttccctagactttgactttccaaggctttaaaaaaacaaacaaacaaaaaaacctgcagtatgcttttagtctgaattcagggattgactttcttatccaatagtctatcctgtacaagggaaccctaaaataacctcgttagccaccaccaaagactatgtaaatacaaatttatttatcaatctcattagaaaccgaaccacgcatgtgcacgcacacacacacacacacaccacaccaaccacacatttacattggaataaaatgaatcttagaaagcagctatttttaaagaaacaggaagtctaacatgtactgccattaatttggaatgggagagaaaggagacttggcagaaccagaatattgcgtgaggattgaagatagcttcagattctagaagagtttctagctctttctgaatatgtgttaacagtttcgctgtttgagctctgctacccactagccagttataaacacaggtaagacccttaacttcacagggcctgttgggaagaggttataattttttagcaacagaacctgtttttcaaacaaaatcctaattagaacacccaaaaacaaacaaaataaaggattcaaatgggtgacatggccagtcctggttacagtatgagacagatgccggttacggtgggcaacagaacagatgctggctacagtggtcgacagagttcattttagttcaagcagaaggtagggctggtgcttgttacagtggccagtaggcctggtttctggttatagcacatggcagagttaggagctctacctacattatgtccccacggcctcatctgtggtttccccataagaaaactaccttttgggaaaacatgatacaaacagatcaggtgaattagaaggtctcctgcagatttaaaattttatgaatataatgccaaatataatcttacactcagttgactactaataataaataaccctacaaaatatggtaaagtgactccatgacaacaattgaaaagaaaataattgcactcagctgagctattgtccatatctagatgcactgatgatacacaaacccagccacagaaaatgtggcatgtgtcagagcaaagcaactagaatgattcaagacactgaacagccagtgttcaagctacgtaatttcttacctatattacaggaaaaaaccatctaactctttttctacctccaacctccctcctctgaaatgttattcacatacctggtggagaagaatctttataaaactcaaatttgattaccttagtcctctgcttaaaatttcagtgtctttcaatgaaagctcagagaccattctggacttataactcccttgcagctcagaagggacccgtggtccagtaattaaaatgcccgtggtaagtgttcaatgctctctcatgcttttcttctcacaatgtcccttcagtacgggatttctttctaccattttcctgagtaattaccttctagtcatcattcaaaaagcatttaagcattgaattctataggaaatgtttctaatcaccctatcccccagctctggctgagttaggccttctctgcacaattcccatgaaagcacctaccacccagcaggcagaaatatccctctttgactttctcactaaactgcaaattcctggtgagtgacaactggattctattcttcttctaacctctagaacctagcagattgctttggagaccttaggaacttaataattctttgttgagtgaataaagggatgctttttgtggacagcagttatttctgtttacacaaaagataagagaaaatacaggtaaaattatcctaaattttaaaaaatttgaaacttacaaaaagtgttggatttaagttcctttgtctgtctggatttccgaaatatttttaaaagattttttctgggatcatttaaggcctcatctgttcagaaccaaggggaggaccgaaatagtatgccaaattcttttccagccctcaaattttatgagcctgagttgcattgtgtgggtaaaagtcttgtgctctgtggatcaggaggaagttagatgttttggatatttacatagaaacaaagaatttgaagactggaaagaacttgagcaggactctattaaatgtgttttgtgtgagatggttttcaccctgtgttcttgtggttcctccatgctaggggcaggaggtaggatggagcagatagggagtctcttttcctcttaaaccggatgttttttttaaaatcagttttatatgttgagagtccatggaatggaatgtggaaactgagaccctgaaagattaagtcacttgaacaaagatatacagcttctccagagaccaggcagacactaggtttatgatttcctgacttccactgcagatctcttaccatttttctatgagagtcataaaaaaagaatcagctatttactttctagtcaaggtgggttaaaatcaagccacttgttttcaaacatcgatttcgggttcatgccatcaaattaaaaaattcacttaactgagtttaatttgctttcacttaggaagcagctgcctttcaagataataaaataaacagatacaataatatttggtcagctgtggcttttaatttaaatgtttgatttaatgttgtttagtttgctggattccaaaatattctctgcaagagaagcatacacattctaaagcatttcaaatgtttattatgatgtcctagaggtggctgtctttctgttgctgtgcataccctgagcagacttgacattgctttggaagcacatattttctgatagacatattactctcataatctaaaatttttcagaagtgacaaaagtggggttgaccattttcttcttcgctgtctccatgattttgctttttccaagatgtcatgtagttagaatcatacaatgtgttgtcttttcaggttggcttttttcacttagcaatatgcctgtaaggttccgccatgtcttttcttgccttgataattcatttctttttagctctgaatactattttgttgtctggatataaccacagttgaattatccatttacctcctgaaaaacatcctgcttgctaccatgttctggcaatatgaatcaagctgctataaacacttatgtgataagtcttgtgtggatataaatattcaacttatttgggtaaataccaaagagtgcaattactggatcatatggtcagagcatgctagttttgtaataaactgccaaactatcttccaatatggttgtataattttgcattctcaccagcaatgaacaagagttcctgtttctccacattctcaccagcatttcatattgtcaatgttttagacatcagctattctaatagatatgtagtggtatatcgttgttttaatttgaaattctctaatgatgtaagatgatgagcatgttttcatgtgcttattttccatctgtatataagctttgctgaggtatctgtttagattttttccaatttttaaatttattttcttgttgttgagatttaagagttctttgtatgttttggaccatatcaggtatatcttttgcaaatattttcttgcaaatggtagtttctcttattctcttcacagtgtctttcacagagaagatgatttttaattttaataaaatctaaaatgaatttttatttcatggatcttgactttagtgttatatataaagagttactgcaaactcagggttatttagattttcttctatgttatcttccaagagtcatagttttgcattttatatgatccattttgaggtctatgatccattttgtgttaatttttgtgagggtctatatctgcatttatgtattttttcacaagttatctcagtcaattttctgttgctataacagaatacctgagactaggtaatttataaaggagagagttctatttagcttgtgatcctgggagcttgactaggagatccaagttaggacaggtgcatttggtcaagttctggtgagagtcttgtgctgcatcttaacatggtggagaagtggaagaaaaagtgggcatgtgcaaaatgaccaaacacaagagggagccttcctttttaacaacccaccctcgaggtagctaatccagtcctacaagagcaagaactcactctaagaaaggtattaattcctttttaaaaacctaatcacctctccaaggcaccacctctcaacatcaccccattaggaaccaaacctcactatggattttgattgtgacaaaccatattctaaccataacacaaatgatgtccagtttttctagtgccatttgttgaaaacactttcctttcttcattgaattccctttgctcctttgtgaaagatcagatggccatattcatgcgggtgtatttctgggctggctattctgttccattgatctaagtgacttttttctgaccagtactatattgtcttgataactatagttttatactaagtcttgaagttgggtagtgttagctttacaagtttgttcaatattatttaatgatgtgttggctgttcttggtctttcctctccatataaattttagaatcagtgtgttgatatccaaaaaataacttgctgggattttgactgggattaccttgaatctacacaaattgggaagaactgacatcctaccttgagtcttcctatttatggacatggaatacctctccatttatttaatttttctttgatttctttcactggagttttatagttttcctcatatagattttgtacataatttgttagatttatattgaagtgttttgtggagcatgctagtataaatggtcttgtgtttttaacttcacattccaattttctttgctaatatataggaaagcaattgacttttataccacctttttcttcagacagatggaatcaagtgacttagaaattggctttgttgctctgcctgagtatcttgaaaattctcatcttccttctgagaaccataacctacatatctcaaggttatagataaaatgctacctacaaaatccttgtaatgcttacagtctaaaagactaaataaggcctcaagagattattcaaaatcagagttgttgattcccagtagagtcataaagggctatgttatgttagctgcaattctaatcctatatcaaagcttctgacttccactcccccatatctaaggaggtttccctcaacagttgaaaaataactgcagatactgctttgccatcccatgccacaaaaatgcatttctgaaggatgctgcagagagatatatatttcttaagcccagctcatatctatttctcaaggctgtgtgatatcatagaatgaatgatggagtcaaataaataaatatttatttatttatttatcagtcaaataaatctgatttaattttttagaacttaacatttagtagctgtgagatcttacagagatttcttcaccttgtatcctttgtcactttatctataaaatggagagtgtaaatactacttcttagagttatcatgattctttaatctaataactcatgagacactggatatgtaataggaactgaataattcttaacccccttgctttcccttgacatttccagaaaataaaacttgattgagtatctaagattatataacagatcccactagactaagtgaatctgagggaagatgtatttgtcacttttcttctcttctttggtttttaaaaagtatcattagaaatagaatcagtaactataaacaaatttctgtgtactgatccagtattaacagagaaaataatggttgactgtgccttactgtgcaaggcaaaaatgagctcaagatattatcaaagtcatgaatcagaaagagaatttcgttttacaaatgatggatagccacaaaacaactaggacatacaatctctgattacacaactgcagtctatagctacattctgcagattaaacaccacagtagagatggaaactttattgtttatattttatgaaaactgttctcttttgtttttatgtcagtttgagagtagaagaatatccttgagggcaaaacatgcctttcatacattagagctgcctagagcatagtctggcacattatataaatattaaataattcctataattaaactgatgttctttggaatgaggatggagacacatagttatctgaattgccttaagctagttttgcaataagtagatttttactattctagaatatgtaatgaatgaatcatgctatgttacaagtaagtattaattaatggttgaagtacaaaaacatcttccttgaattatatgataatctacatcacagtgaaaggaatttatcatgacaaatgctagtcaatgttgaatcacagagggctatatgagatccattttcattcttaaagaaaattattatatctttttattaatatggtggatatttactcagtaaataataaagaaaactaatatgaagtgcaatttgtaatattctatttatgatgcatgatttttgttgcacaattagaaaatacttaagttcttgagaatagttggaaagggttgtaatgatcagaaacacatattatacctaaacatgtattaagaccttgttttaaaaattagatcttggagcaagaaggtaagctgtatcattacgttcttagaatacagggttgggcgtgggggctcatgcctgtaatcccagcattttgggaggctgaggcgggtggatcacgaggtcaggagatcaagaccatcctggccaacatgacgaaaccctgtctgtactaaaaatacaaaaattacctgggtatggtggcgtgtgcctgtaatcccagctacttgggaggctgaggcaggagaatcgcttgaacccaggaggcggaggttgcagtgagctgagatcgtgcctctgcactccagcctggtgacagagcgagactccatctcaaaaaaaaaataataataataataagggtaaatacaaggagtgtgttttgaatacaaaatatctatttttagaatctcaaacccatgagttactttcttccatatataagtcccaacatgttttctataatcagtctatgtctattagatgtgtaattatattaattatgtaaatgcacatgaataccaaattatttggttaatcttcgaatttcttttagcaattatatactctcctccaggttagattgagctttcccttcaactcagagaaatcagtgtcaacaggctaccttctgtaagactaccagagagctatgcattactctgtacaaaggatatttctcctataaatagtgctttcaatagagaaaatctgttatcatgttgtcagtaaattcaaatattttctcttttggaatactctgttcctattaaaacaagagctgtttccttctttgaaacaagttatttatatttatgtggttaagatatcctatcttaaaccataagacctttttgaatacttcacatacagaaaaatgaaaaaaattaaacaaatatcagagttgctgggaaccccaggatataatctactgtggatagtcattcatagacaaagacacctcctatttataggcttgggacagttcagcttctccaacttgaagagagttttgaagatcaaatacaaatgggtcttgtgaagtttcaaaaaatgtttctcaaagtcctttgagaaaaataaacttgggcctgtagccaatagtttgtattccaggcttttaaaaaaaattcaaatacagaaacatcagattttcattgccataggggtcatgacatcttttaacataagtgcagaaactatctgtaatgaatcaaaacttaaatcagatgacattaagaccagctttgctattaccacagatggcatcacaattaacttttaatatatcaaaaatgtgagtgtactcatatattatcagtcatttgatcatgatattccaacattaacatctcagtgtattgtgaaaatgattcatttgtacaatatttttcttcttctagacttttaatttcttgaaggaaggaacgcattttactcatcttgtagtgaccctccctgtacatgttgcctgagacataataactattcaaaaatgtttacagtattcaatgaaattatataaatcttggtttaaaaagcttgatatacaatgaaacatacttgggcaaattataaagctgttcctgagaatgagctaatacatatttagttgttaaaattctgaggggaaaatgtaaattagatgtgaactacctctacaatataagatagcagtaggctgtaagttaaaataatcatttttctcatttttcagtaacattcattaaatgcctgatacaattctgtactttctgaaaattgactataataaagaaatcctggccattataaaattgtcatccactcataggtagaataaatgagagaattatggtgatctaaatatagaaagcatttaaattagagaacagctgaaattgtgcttctaaaacatttcagtgttgttcattttctatatgttatattgaaaaaagtaatatggaaatgtaatgttttcatttgcagatgcttaaatttagatacatgtttaatactgtaatcattttgatcaaacagcagctattatttattattcaatatttatatgtaaaacctgaaactttcatctaccttaatgatggtattgtgataaaagtacccatgtatcaccaagatttgccaattctttttattccttaaagaatatctgacaatttgctggtttgtataagtttgagttaagacaccgtaataatgtcctgcagtatatatgtcaaaatacatgggtcaaaaagacactctaaaatagcagtctccaagaacccaggaagtatgtgatccataggagtgtacatattttattttctttaaaaaataagacagacacttctcaaaagaagacatttatgcagccaaaaaacacatgaaaaaatgctcaccatcactggccatcagagaaatgcaaatcaaaaccacaatgagataccatctcacaccaattagaatggcagtcattaaaaagtcaggaaacaacagatgctggagaggatgtggagaaataggaacacttttacactgttggtgggactgtaaactagtttaaccattgtggaagtcagtgtggtgattcctcagggatctagaacttgaaataccatttgacccagccatcccattactgggtatgtacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaacaaacaccacatgttctcactcataggtgggaattgaacaatgagaacacatggacacaggaaggggaacatcacactctggggactgttgtggggtgggggggaggggggagagatagcattaggagatgctaaatgacgagttaatgggtgcagcacaccagcatggcacatgtatacatatgtaactaactggcacatggtgcacatgtaccctaaaacttaaagtataataataataaaataaaaataaaataaaataagaccattaaaaaaaagttcatcgtatggattgacactgggctgctccctggtggagtaccagctcaagatgttttgaggaaaaaatttgcatttaccaagtgggaggatttatagtggtgatttcacttgttcattgatttagacatatgaaatattatattttttgcacaactaagttggctttcagattatatgaccatatttttaactaaatgaagctttgctgaataaatacatgacttaatatattccttcaaaaaacatatagtgaaataatattaactacacaaagataagcaatgagcaaaaaaacactagtgcttaccactgctcttggtaagagctttccttcaggcacaaaatgagataaaagtaatgacaaggtaaaactggatgaaaattggtcaacaagtgaggaattaactgccttgcaaaagcagtttttattatacagaaaccattttgaaagcagttattcagaaagtttctatcagtatatgatttgtagctcaaattattgttggtctatcaatcacaaatactattttctgcataatatagctagaaaatataattatctaacttatttttaaagtcttctaaacatgaagtttcagtgagctttgaagctttttgttaaatatgttaaaatgtcatactttccaaatagtttccaattataaccaattagcatcagaaaatttattagccaaatttcaccaagaacctaatttgtgagagaattgaaaaatgagtaccataatttagtatgctcagccactgatgtaatgcttataatgggacctgtgtattttttgtctgtgctgtatctcttttcagctgtgaaaactattattactaagtattaaaacaaactgagggcaaggcacggtggctcatgcccgtattcccagcactgtgggaggccgaggagggtggatcacttcagatcaggagttcaagaccagccttgccaacgcggtgaaaccctgtctctactaaaaatacaaaaattagccgggcatggtggcacatgcctgtaatcccagctactcgtgaggctgaggcaggagaatcgcttgaacctgggagacaagaggttgcagtgagccaagatcacaccactgcactccagcctgggagacagagcaagactccatctcaaaaaaaaaataaaaattaaaaaaaaagcctgaacctagaaacggacctacaaatgtcaatacttagtaatatttttaattattaagccaagatttccaaaaataagaaaagcataattgattatactggtttctttttttttttttttcatttggaacatataattgagaaagctttagtatcaagcatatgtaaagactcataaaataataaggaaaggccaaactgcctgatagaccaaaaaaaaaaaaatcaacaataaacattttacagaggagaaacagagaaacatatacagctaaaaacatatggaaggatcttgagtcttatagcaatattgatgagcaaatcaatatgtagaatagcaaatcagtatcattatcaaagagataatggatatctctttatactcaatttattggcaataattaagaatttaaactacagaaatattgaaaagtatttgaatcaaccagatttcttatatagtgctaatataaattggttaaccacttgacattatcttttaaagtttaatattcacacaccctatgacccaacaattttctagatgtatatactaaaggaaattattacatttgtgcacccagataaacacataaaagtgttcataaaagtactgtttatattaagaagagccgacagcagatgcctatccagaggtaaacaaattgtaatatatctggaataacttgttgcaatgaaaataaatgaactacaggtatacgtgataatatgatgcttagtgataggttctcagatgatcacagcatgatggtctttataagcaataacatttttgagcaaacatatatttgctgaaattatctttttaaaaatgtaagaaaataatataaacacaaaattcagcatgtcagggttatgctgcagggtaacggggtggtgaggattgtatagatagttgcaaacattgctcatgttcaacttcttgggttgggtagttggcttttatcactaacaaagtaataagccagggaatacaatgggtaaatgaaaaaataaaatagagtcacgattagaccaatgatgatagtatatcataaatcaagtcttctcatctttaaaatggaattagtaggagtacttagcttcctagggttgttatgaaggttgaaattcttagaataatgcctggtacatagcatttttttttttaagttaagttctagggtacatgtgcacaatgtgcaggtttgttatgtatgtgtacatgtgccatgttggtgtgctgcatccattaactcgttatttacgttaggtatatctcctaatgctatccctcccccctccccccaccctacgacaggccccggtgtgtgatgttccccttcctgtgtccaagtgttttcattgttcagttcccacctatgagtgagaatatgcgatgtttagtttgttgtccttgtgatagtttgctgagaatgatggtttctagcttcatccatgtccctacaaaggacgtgaactcatccttttttatggctgcatagtattccatggtgtatacatgccacattttcttaatccagtctatcattgatggacatttgggttggttccaagtctttgctattatgaatagtgccgcaataaacatacatgtgcatgtgtctttatagcagcatgatttataatcctttgggtatatacccagtaatgggatgactgggtcaaatggtatttctagttctagatccttgaggaatcgccccactgtcttccacaatggttgaactagtttacaatcccaccaacagtgtaaaagtgttcctatttctccacatcctctccagcacctgttgtttccagactttttaatgatcaccagtctaactggtgtaggatggtatctcattgtggttttgatttgcatttctctgatggccagtgatgatgagcattttttcatgtgtctgctggctgcatcagtgtcttcttttgagaagtgtctgttcatatcctttgcccaattttgatggggttatttgtttttttcttgtaagtttgtttgagttctttgtagattctggatattagccctttgtcagatgagtagattgcaaaaatcttctcccattctgtaggttgcctgttcactctgatggtagtttcttttgctgtgcagaagctctttagtttaattagatcccatttgtcaactttggcttttgttgcccttgcttttcgtgttttagacaaaaagtccttacccatgcctatgtcctcaatggtattgcctaggttttcttctagggtttttatggttttatgtctaacatttaagtctttaatccatcttgaattaatttttgtataaggtgtaaggaagggatccagtttcagctttctacatatggctagccagttttcccagcaccatttattaaatagggaatccattccccattgcttgtttttgtcaggtttgtcaaagatcagatggttgtagatgtgtggtattatttctgagggctctattctgttccattgatctacatctctcttttggtaccagtaccatgctgttttggttactgtagccttgtagtatagtttgaagtcaggtagcatgatgcctccagctttgttcttttggcttaggattgacttgggaatgtgggctcttttttggttccatatgaactttaaagtagttttttttccaattctgtgaagaaagtcactggtagcttgatagggatggcattgaatctatgaattaccttgggcagtatggccattttcacgatattgattcttcctatccataagcatggaatgttcttccatttgtttgtgtcctcttttattttgttgagcagtaatttgcagttctccttgaagaggtccttcacatcccttgtaagttggattcctaggtattttattctctttgaagcaattgtgaataggagttcactcatgatttggctctctgattgtctgttgttagtgtataagaatgcttgtgatttttctacattgattttgtatcctgagactttggtgaagttgcttatcagctttaggagattttgggctgagacaatggggttttctaaatatacaattatgtcatctgcaaacagggacaatttgactacctcttttcctaattaaatacccttcattactttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacatcccatcaatacctaatttattgagagtttttggcatgaagggctgttgaattttgtcaaaggccttttctgcatttattgagataatcatgtggtttttgtttatatgctggattacgtttattgatttgtgtatgttgaaccagccttgcatcccgtggatgaagcccacttgatcgtggtggataagctttttgatgtgctgctgcattcagtttgccattattttattgaggatttttgcattgatgttcatcagggatattagtcaaaaattctcttttttgttgtgtctctgccaggcttttgtatcaggaggatgctggcctcatcaaatgagttagagaggattccctctttttctattgattggaatagtttcagaaggaatggtaccacctcctccttgtacctctggtagaattcggctgtgaatccatctggtcctggactttttttggttggtaggctattaattattgcctcaatttcagagcctgttattggtctattcagagattcaacttcttccttgtttagtattgggagggtgtatgtgtccaggaatctatccatttcttcaagattttctagtttatttgcatagaggtgtttatagtattctctgatggtagtttgtatttctgtgggatcggtggtgatatcccctttatcattttttattgcatctatttgattcttctctcttttcttctttattagtcttgctagcagtctatcaattttgttgatcttttcaaaaaatcatctcctggattcactgatttgttgaagggttttttgtgactctatctccttcagttctgctctgatcttagttatttcttgccttctgctagcttttgagtgtgtttgctcttgcttctctagttcttttaattgtgatgttagggtgtcaattttggatctttcctgctttctcttgtgggcatttagtgctataaatttccctctacacactgctttaaatgtgtcccagagattctggtatgttgtatctttgttctcattagtttcaaagaacatctttattccagccttcatttcgttatatacccagtagtcattcaggaacaggttgttcagtttccatgtagttgagccgttttcagtgagtttcttaatcctgagttctagtttgattgcactgtggtctgagagacagtttgttataatttctgatcttttacatttgctgaggagtgctttacttccaactatgtggtcaattttggaataagtgtgatgtggtgctgagcagaatgtatattctgttgatttggggtggagagttctgcaaatgtctattaggtccacttggtgcagagctgagttcaattcctggatatccttgttacctttctgtctcgttgatctgtctaatgttgacagtggggtgttaaagtctcccattattattgtgtgggagtctaagtctctttgtaggtctctaaggacttgctttatgaatctgagtgctcctgtattgggtgcatatatatttaggatagttagctcttcttgttgaattgatccctttaccattatgtaatggccttctttgtctcttttgatctttgttggtttaatgtctgttttatcagagactaggtttgcaacccctgcctttttttgttttctatttccttggtagatcttcctccatccctttattttgagcctgtgtgtgtctctgcacatgagatgggtctcttgaatacagcacactgatgggtcttgagtctttatccaatttgccagtctgtgtcttttaattagagcatttagcccatttacgtttaaggttaatattatgtgtgaatatgatcctgtcattatgatgttagctggttattttgctcgttagttgtttcagtttcttcctagcatcgatggtctttacaatttggcatgtttttgcagtggctggtactggttgttcctttccatgtttagcacttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttccggcttgtagagtttctgccgagcgatctgctgttagtctgatgggcttccctttgagggtaacccgacctttctctctggctgcccttaacattttttccttcatttcaactttggtgaatctgacaattatgtgtcttgaagttgctcttctcgaggagtatctttgtggcattctctgtgtttcctgaatttgaatgttggcctgccttgctaggttggggaagttctcctggataatatcctgcagaatgttttccaacttggttccattctccccgccactttcatgtacccaatcaggcatagatttggtcttttcacatagtcccatatttcttggaggctttgttcgtttccttttactcttttttctctaaacttctcttctcacttcatttcattcatttgatcttcaatcactgataccctttcttccagttgatcgaatcagctcctgaggcttgtgcatttgtcaggtacttctcgtgccatagttttcagctccatcaggtcatttaaggacttctctacactggttattctaggtagccatttgtcctatcttttttcaaggtttttagcttctttgtgatgggttcgaacttcctcctttagctcagagaagtttgatcgtctgaagccttcttctctcaactcctcaaagtcattctccatccagctttgttccattgctggcaaggagcttcattcctttggaggaggagaggcgctctgatttttagagttttcagcttctctgctctgttttttccccatctttgtggttttatctacctttggtctttgatgatgatgtacggatggggttttggtgtgggtgtcctttctatttgttagttttccttcttacagtcaggaccctcagctgcaggtctgttggagtttgctggaggtccactccagaccctgtttgcctgggtatcagcagcggaggctgcagaacagcagatattgctgaacagcaaatgttgccgcctgatcgttcctctggaagcttcgtctcagaggggtactcggccgtgtgggatgtcagtctgcccctactgggtggtgcctcacagttaggctattcagggctcagggatccacttgaggaggcagtctgttcattctcagatctcaaactccatgctgggagaaccactactctcttcaaagctgtcagacagggacatttaagtctgcagaggtttctgctgtcttttgttcggctatgtcctactcccagaggtggagtctacagaggcaggcaggcatccttgagctgcagtgggcttcacccagttcaagcttcccagccacagtttgtttgcctactcaagcctcggcaatggcgggcgcccctctcccaaccttgctgccaccttgcagttcagtctcagactgctgggctagcaatgaacaaggctccgtaggcatgggaccctccgagccaggtgtgggatataatctcctggtgtgccgtttgctaagaccattggaaaagcgtggtattagggtgggagtgacccgattttccaggtgccgtctgtcacagcttcccttggctaggaaagggaatttcctgaccccttgtgcttcccgggtgaggtgatgcctcgccctgctttggctgacacttgatgggctgcaaccactgtcctgcacccactgtcagacaagccccagtgaggtgaacctggtacctcaattggaaatgtggaagtcacccatattctgtgtcgctcatgctgggagctgtagactggagctgttcctattccaattatactggtttctaaaaaagattgtaatatattgttgagagtgaagggagttttatatcaataattaaattattttaaaatattgtttatttcatttctcatacttcaaattacttatttacattttaataatatattagtatcataacacatgtgtataatacagctagaaagagagagcatatataccctgaaggcatttttaattataatattgtaaaaccaaactctaaagactcctgttctaggtaattgattagtccagtaaatgtaggcataagaaaaatgtatgaaatagatgacgttaatctttcatgcacaataacacctttctccagctgtggctctaactgtcctgatggattctttactgctctcagctaatccattatatggttttagacatccaggatagacactgaaaggaataactattacaaaagtaattttaagaggagcatttgattgactgatgctcctcttatgtattcattgtgtgtatgtattgaatttgtgtattcattgtatgtattcaatattcaatgtatgtattcattgatcctgcatatacttgatgatttgattggtggtttgattccagttatattaacttgccagaaactttctagtttccaaacagtgaatacaacttagacctcatgaagcttacattctagttagaagagagaatattaattagataagcacataaaatatacatgtgttagatagtgataaatgacaagaaaaaaagtagagcatggagggcctaggaaggatgatagtggttgaatagactttaattttatatagaatattaggtcagagatctgaaggtgactaggaaaaagttatgtgggtatctggagcaagagcatcttaggacaaagagaaagtaagtgaaaaggccctaagatatgaatgtggctggcatgttcaaagaccctcaaggatggggtaagagtggggaagagttgaaggatatggggaaggggaaaatatcgtaggtctttggcacactgtagttaatgtcttcacatttttcttgcaatgcaatgagaaacacagacatgtaatgatctgagttatgttttaatagggttagtatgattgttactttgagagttggttgaatgaggacaaacagatagaccagttaagagacttggcattcatccagtcattagctgtgaagtcttggaccacagtgataatggtgaaaatgatcaagtgtggtttgattccagatacattttgaaggtaatgctgaaaagatatgctaatagtttggctgtggaacatgaaagaaagaggagttgaggattatttcccaactatggacctgagcaactaaaagacttgtcattgatttagatggggaagactgtggtaaaaacaaattttttacaggagatcatgaactcagcttagctaattatataaagttagagatgcctattatatatcgaggtgtaaatgttaaagtgatagctagtatacaagtctgaagttcattgggtcaggaacatctgaactgaagatgtaaaatgtttgaatcatcaatccatatgtcatttaaaccagaagactagatgtgataaccaagaaaatgaataacgagacaaaatatgagatctaaggattgggccctatagcaccccaacatttagaggttaggaaactgaggacgaactagaaaggagactaagaatcagtgaccaaaaaagtagaaggaaaaccacagaagtcatgtattgaaagtcatttgaatgaatcaagtgatcaactttgtcagatactgttgatgggccaaataaggtaagaaatgagaattgaccattggatatagcaatgcattcgaccaatgaccttgagaagagtatttcagtggaatgaagggcaacatggaaactagagtggatttaagagagaataagaagaaagaatatggagatagcaagtgtagacttgtctttttctagaaagaaaataagggcatagatacttttatgggatgtggaatggtgctgggacatgtggaagtctcttctattggtctgtatattcttagaaaatagaaaataattgagtatgagaacatgggaggaaaatgctgaagattcaaggagaaaagagaaagtatgaaaaagtatccaggaacatagcaaagaacatggaccagacagcattagggatctatgtgagtttagtaatcatgaatttgaagcaaggtcagtcaacaggtactatgagtttcttcagatgtatccagctcagcagttgcaggtacagagaagatagaggttagatttaactgacgttgtggttaagccaagtgaatacagtaaaactagagattaaaataattgaccatggaatctaagacagtgatgagaaaccctcaagctacagcgatttcccattgtctccctaaatgctattagtactgtagccaagacaagtctttcttttataggactatacaaggccttagaggatatttagtatccttggcctaaaggataaaggtaaagtggtacagtacacatttagtgtgctgtacactaaatatcagtagcactttgccacaaattaaaggaacagtatataatccttgacagtgctttaactccattgcatttccttcttttttagaatggaatttttttctatatgttccccaaagcaaggctagtttatataacattaaattacttatgcaaatgcaaaaattaatctgaacatctatttattatatctagcacaaaacatagaaacaaagaaggcataggttattattttgaaattatgctttactgaacacataggaattgctaccaatcgtttaaatagttgccttatttcttagacaaatagtaactgaaatgtatggagcattcatgcatatatttggaatgtattaagtgttcatgtgtatacctggcgcagagttaattgttttgcctgcattatctgatttgattttcccacagtgccatgaagtatgaattatcattatcactattatatagtaaacagtataaaaatgtgtctatgacttggagaatggaaaaatgttttacaatattacattctggttgttcacttcccttccattcatgttgacattgaattgttctaggctgctaaggcagcactgtcagaagccacgttttttctaggcatacacacactttattcctttgtcctttagttccttaaactacccatgcactttcctcctctttctttttacattgatgattaaaatagtgagcctgaatttttttaaataaaaaccaactaagttttttattatttattatttggaggaacatatgccctccaaaatatcatttagtgcatcttagacataaaacaatttaactgcttgaagaaaatgtccagcttctgaaatggcatgccattagatattagtgacatttgtttataaacaaataaatgtcttcaacctctatgtagttactatcaatatagccatgcaatatatatggagttccaaatacctttcaaaaagtaatgttgatacagtagtgatcacttatgtccttttgattgaaactgcattatacgaagttctttcctttcagcacaataacctgaaaaatatagctgtctatttaaagaagacattttcttgtttggcagaatattatcatcatacagcatatgtacaatatggtcctaatttgtgtcgatatgtgctaggcttagaaaactcactttaagttttactaaatttattttggagtttaactcttacttttgacatgatttatattctaaggagatctcagcttcttcctgcttaaatgacattacatagatagaaaggtatatattcttattatagcagtgtctgccagggctgcagtcctgttgttagaaggctgtcagaattttaaatgtaagccttcctttcccaggtgttataatttaatcttctaactcctattaatttctgaagactgtggggccatcctatatcttagaacaaaatatagatacgtacattcctgatttttttctccatatttaccttcccccaaatgttttaattttattatttcaaaattataataatagcaatggatttcaaattaaaattctggctagtgaatccctcaggtatttctttatattgactgatttgtatgttgtaggctaaataatgccctcctccaagatacccatagctgaatttccagaacctgtaaatatgttccctcttacatggcaaaagggactttgcaaatgtgactaagtttaagaaccttaaggtgggaagatgatcctgcgttatccaggtggaccgaatccagtcacatgagaccttaaaagtagaagagggggtcagagtgatgaaacaatggaagaagaggaaggagaagtttgaagcatgaaaaatatttcattcatcatttctggctttaaagatggagagtcccttgaaccaaggaatgtgaatgacctctagaacctggaaaagagcattggctgacaaacagcaaggaaatgggaacctcagttccacaaccacaagaaatgaattctgccaacaacctgaatgaacaaggagatagattctcctctagagccaccagaaaggaatgtatccatgccgacaccatcattttagtcattttagctaaaggagacccatattggaatattcgcctacagaactgtattccaacaaggatgcatatgttggaatattcacctacagaaccatgagataatatatttgtgttgctttcaattgctaagtttgttacggtagcaataggaaactaatgcaatgtacagttgacccttgcacaatgcagggattagggatgctgacctctacacagttgaaaatttgtttataatttttagctccctaaaaacataactactaagagtctactgttgaacagaagccttactgataacataagcaatttattaacatattttgtatttcatatgtatatatgctgtattcttataataaagtgtgttagagagaaaagaaaatactaagaaaatcataaggaagataaaatatatttgtgttaatcaagtgaaagttgatcatcttaaaggtcttcatctgcatcatcttcatgttgaaaaggctaaggaggaggaagaagaggaggggttggtcttgctgtctcaggggaggcagagacagaagaaaatccgcgtataaatggaccggacttgcacagttcaaacctgtgttgttcaggtgtcaactgtatatgaaggctttcttctttaaacagaaaggaagtattttgtgcccaagatttggagaaagcaatgggataaaaatatcatagagattttatggtatttgtcctttttttccttttccccttcactaagggtcttgaaaaactggtctgaaactccgctccagtagagcaaaaagaagaactgaaagttaagaagatatttttgtgaaaaatgttgtgagacaaattttgacacagggttgaggaactctttttttccgcatctgaccaagggcaggcttgatatcctgaaggttaagagcggctttgcctgaagcaaagttctcactatgggaagttgcagccgagtagtgaagagttatcttgatgggaggccggaacaaatttgctttggagacgtaaagggaactaagaactattcttactggactccaatatgagactttatttctatccattggtttgcaaggcctggagatatatgcattagataaaaagactgtatttgtaattagaaaagcctccagtaattaatgtccaaatatgcaaccaatttaaatgatgtctacataataccacacatagatgaaaatccaaaaagtcaaacattcattataataattcttccaatctagttgttgttatatagaagcccctcagagggcaccccattttgctgaatttcttgagttttttacttatatcacagaatcaggatgttcaaagtataacaaagatgagaagtaagttgaaaaaagaattattagtgatatttcttctaccatatacatgttatcttggaattggaattttttcataataagaaatccattagcataaatacagtttaaattgaataagtaaatttcattaaaaacaaaatatttatttgggggtacattttataaatagctgcaaaatcaaaactgcatttttgaaatgtaagccatattgatgctagtaagtcaatatgctcattatcaattgtgtatgtacttttatgttatttagaaaatttaattacacgtacggtgtttcaagtattcaatagataaaccacctaggaatataacagggggcataaaacatattatcgactctgtgtctttatgaaactagataaagcaaagaaaaatctgtcaattactcagccagtttcatcttagtagcctactgtaaattgaggtctatgtttttgagtgaatgaaatctagtaaattaagttcaccaggtcttattctagtttattttagatggaaatgtatgatttttaaaagtgggagtaaaatcttacacatatttctgaaatgttaagaagataattttataattcaaacctgtacaagaacttagtttgcctatctgagcaaattttacattcactagtgaatgcccatgtgaaagacaagcaggaaacttccaggggccaaggggcttagaaccaactgaactggtacaaaataaacattaggtatttcagtacgtagagtttgtggacaaaaagaataggctcttaccaattactatgctactagaatatccaattttgcttttaccaagccttagtgaaaagtgaatgaattctaacaagaagactcaaagacactggtgctccccctgtgtctcccttcacttattctgcatggtcagcacctcttcaaaagaccaataataatggtcccctacaagaagtatacaattgctcctctgatgtgaaagcatatgaagaaaataagtgtccaaagctgcataaatatttgcacccctttgagagtatgagaaagtgtgtgttttatgttgtgattgataggacaactttcatggcccactttgaactcttagcaggaactttggaatgtcctgagggtctgtctgcctttgtatggcaggaactctgttttcttagaaaatagtaaagaacagtttgtactcctttgttctaaagggtacctatagtttatgggaattggggaacttagtagaaaaatcaccaacgctctcatgtttctcataaaaaatgctcagctttatttggaaactttggccattgttttctttttcttctttcttcttctccttcctcttttgggttaaaaaggccacagtctgacctacttatatgtgtgatgaaatgtgcagactctgccaaggctatttattctaatgatttatctactcaagataaaaagaaataaagtgaagacaaatctgaaatactgtgcaatgtacttacttgaaagcagtaagttctcatgttagaaaatttccctattaagcaagaaatcttgaacacttcattaaagtcatatgatctgatttttattatcatttaagtcagggaattttagaactaaatgtgtcaattataaaactgtacatatgtatagcctccaaaatgtgttaaacattagttcatatgaatctcaaaatactgtaacacagtaaaatgagcaagaaaatttttgaaatttgcacagtagagacgatgctgttaatgttcaccgaggtaaataatttgtccaaagttctatttctgtgagatactcaactgagacataatctcagcttttttcactttcatattctatattttggttttcattttgttcttaagaaacaagtatttttaaaatgaaacatctggtttcggcagtgctggctaatgctcagaactcccttcccttgttttcttcaatgtcacccttctataaaaacctctgaatatctgaatacgttttaagagcaccccttataaaacactttttgctttgttatgtttcattttgcaggtgccaaagtcacaaatatttcacctcattcagatattccaggtagtaaggctgatatttttatgagtcatttcatctgacaaaattaatttaagaataaataacattgaaatagtaagtagcatgtattttggacttaactcttattttccctatttctattcttccatgttttaatagattaatatatactcatgtgtatatatgtacatgcacactcacacacatataagtatatatatatttatttttcctcatcttatacaagtggaaacatactatacacattataagagcacagtataatttttatgtaatataatttgaagttaattccatattggatagtttcttcattatatgtgtaagtatatgtaatatatcatatgtatctatgattgtgtatttcattgaatgaatgcactcaaacgtgttcagcaatcagcacagaggttaaacattgactctagtactagactgtgaaggttcaaatcctgctttcaccacctgccatctttgtaaccttgaacaagttatgtaagtactcaatgcttcaattccctcatctttaaaatcaatgtaacagttataagattcttaccacataaggttgtgtgtggtgttttgagaatgtaatgaatgaacatatccaaagccacattgtagagtgcttagcacttgcaaagcataatgtcagtgtgagttgtcatttccatcatcatttttaacatgtttaattgcaacccctattgatggacgtacggacattttcaatattttttactacaaacgttgttatacattgtttttctgttgttgttgttgttgttgttggagatggagtcttgctctatcacccaggctggagtgcagtggtgtgatctcggctcactgcaacctccacctcccgggttcaagtgattctctgcctcagcctcccgagtagctgggattacaggtgcttgccaccatgcccagctaatttttgtatttttagtagagacagggtttcaccatcttggccaggctggtcttgaactcctgaactcatgagtcacccttctcagcctcccaaagtgctgggattgcaagcgtgtttcagtgaatagccatgtgcccagctgtttctcacatgcacccttataactgtgggataaatctctgaaggtgaaactgctatgtcaaagtatatatgcatttataattttaacagatattgccaaattgaacccatatattttagacatgctaccaccaatgcatgagagtacttgtttccctaaacccctctctaatagagtatattatcaaacttttgggtctttggcaatccaatgggtgaaaaatgacattttgggctgggtgtggtggctcacgcctgtaatctcaccactttgggaggctgaggcaggcgaatccctgaggccatgagttcgagacctgcctggccaacatggtgaaaccctgtgtttactaaaaatacaaaaaaaaaaaaaaagccaggcatggtggtgcacacctataattccagctacttgggaggctgaggcatgagaatcacttaattgcttgaacctgggagacagaggttgcagtgagccaagatagtgccattgcactccagactgggcaacagagcaagactccatctcaaaaaaaaaaaaaggaagagagacaattatatttttttccacacaagcatttaaaatctaattcaaaaatctattctgaacttactgaatcccaagaataattaggagaggaaaagaaataatgtttaaataaattctatctgcctgttactatagaacatgaagaatgggttctgtgttcctcttatgaatttctttttaaaacccttcaaagtaggtattttcatgcccttttagacataacataacgtataattcagagttgaattaattttcccaaaatcacacagcaaatatatagactacaattagaaagtgggtaagtctcattcttaaacatatacttttgcattatagtcacatgaaaccactgagcgtgttcatgtgtgtgtgtgtgtgtgtgtgagagagagagagagagagagagagagaaagcccaagagtgagagtttgtcttgaggagaagtgtttaaaaggaatatataaatcaaggatgcactatagtatcaccaaagtaacagtgtgaacttgaacaatttaacctcttagagccacgattgctccatctatacaatagaataataataataaacctacattatacaatttccggagattaaatgaggataaagagtacttttgaaattctaaagttccatgaaaatgttagctttgattacatatggttcagcaattgggtctccttattttttgagatctaccttttttttttgtattatctgtagcttgctaaaataacataccagatgtttttgttttcaaattttaaaaatccagatcatactgatttgttgccatggtatagtagtcagagaatcttgctctgggcagttacaatattttggagattgttttacataatagcaacaataacaggaacaatgataactgctaacttgtttacatttacaaaatgtcaaatactattctagattattcaattgaatcatcacaacaacgctatgaggtagttactgttatattgttttgatttccctgatggagacttgacacaaagagagactaagtaattcactcctgtcacacacagctaaaaagtggcagagctgagtgttttgccccaggtagtccagttctagaactgtactcttttccactatgctataccatcttcctaatactatctgtacaagaaattttctcctaatgaaatgtattgctgtaccctatataagctttagctctaaaattgcagagcaggaagcaggtggataaagctaattgctattctattaccctacaatagaaatttcagtggactaactctaatatttaaataacccactgttaataaactggcatggtgcaattgcatgtttcccagtgagatcagatctagtccaatgtctcagcagatataggaattccttttctatcaccccagacaggtggatctctactcatgtatcttcagagaaatggataccctacaaagcagcacattccattttcaacagctctagatattattttatttatttattttagatgaagttctgctgtgttgtccaagctggtctcaaacccctgggctcaagcaatcctcctgcctcagcctcccaagtagctggaattatagttgtgtgccactgcatctagctccagattttagaagttaattcttacacagggttttctggagggacagaactaataggattgatgtatatatgaaggggagtttgttaggagaattggctcacatgatcacaaggtgaagtcccacaataggccatctgcaagctgagtagcaagaaagccagttcgattcccagaacctcaaaattagggaagccagcggtgcagccttcagtctgtggccgaaggcccgagagcccgtggcaaattactggtgtaagtgcaagggtccaaaagctgaaaaacttggaatctgatgttcaagggcaggaagcatccggcataggagaaagatgaagactagaagactgcgcaattctagaccttccacgttctcctgcctgctttatcctagccacgctggcagctgattaaatggtgcctacccagaatgagggtggttctgtctttcccagccctctgactcaaatgttaatctcctttggcaacaccctcacagacacactcaggtacaatactttgcatacttcagtcaagtagacagtcaatattaatcaccacattctccaacgctttctcatacaggttctatttctccactatgaacagtgagattttttttctggtatacttgataggccttcaaatgttccaagaaaacaatcatgcttttcctaagtcttctctttttaaatactcccattacctttccaaaccttttgttcagctgttgggaccatcaacatcctggtcacacctctatggatgaagtctaatttgtcaactactctcttaaatggtggtgtcatgaattgatcacagtgctctggatgtgctctgactagctatgactgctcctggatcgccgtttcctttaatctatacactatgtgtcttcctaatacagagagtatgttgtttgcctatatatcataacaaattgaaaatgcatttataacttataaagtatatattactaggtgctagaatttacactattatcctaatatacagaagctgggaaaagtaatgccatagagttgatttatgtgtgtaaatgtctaagtgacttaaatattgatttttctccttcaactgcagatcaaacttcccaaacactaaagcttccttattttaaaacaaatgcatttgtggttcaccagtctgcagtacagtaagctttttataggtaagctcaaatcacagaaaagctcaaatagatacatctcctttagcctatttttaggactgataaagctaagaacagagaaaccaataaagacatattttaatgatggcagggtatctcatggggtagtacaaatttatcccagttttttatgccttctctatgtgtaatacattgaagtgatatatggtgttgaatgtgattaaaattcagcagatacttatgcaagatctactatctataagatgcttatgcaaaattccatagggaaacattaagacgtgaataaaatctgaattgggccatcactatgatctctccccaaaacgtgggattttcaagtgcatttagaattatgaaataaaccactaggtttttagtgtgaaatgtttacagtattttaattttgaaaactatacttattaaaacagtatgacaacatttattgaatacatgttatgtgctaggtaccaagtggggagttttatgtttattttctcatttcatcctaagagcaaacttcggaggtaggtgtgattcgtctcattttagtgaaaattcactgatgctctgaaagcaaaattaactttcccaagggccttgtagtgcttaaaggcagaatcaaaatccacaaccagctctggaaaatctccagaaatgagcttaattttttgtgtgatttatatatgactccaatattaacagacatgtcaaacaactaacacaaccctttacctgtttattttggaagaagacacttaaaatgtattttattaccctgttgattctcctctggagtgtgacttagtatccattgcacctttgggattcttatcttctaaaattcacaaccactttctactgctgtaagaaagaatcacctgcagagttcacgaatgagggaagagtgaaaagggaatagtggcagatcaataccacttggcatcacatcaaaatagtattccaaggttggtgttctggcttctgcttttctgggaaatacgttgtctgctatttcaaaatgccctccatctgaataatgtaacctgaaattcattcaactcatatttagcactttaggccatatccagggttgtggaaggtgtacgtaagcaatgaggattgcctacaaggcaagatgagaactctgttttctatactttctattgttcctccctttgcaacagaagtagaaagggccataccatagccatctactgtccaacatgatgaatatccttaaagacaaaatctttaagcagtaagtgaaaggttaactacaattctcatttaaaaagaaaattgcattgctgatatctctttgttacataaattttccacaaggattatacattttctttttattcatttgttatctatttgacaatagcaagcctgtttctctttagcttaaaggaacttggattaaaattttttctgttattttaatcagcattgatgttgtatattatgagcgtgtggctttttgttttcttggcagagaccttgaaaaaattttgaaccctagtcaataagaaatctctgtattaatataaaactataacttatggtttatttgattagatcaatgtttaattatggataacatgtattttttgcactgaatatttacacacaaattaatctagcccatagtaaaagtgctaatggaatgtttcatccaaacataagttagtaaatggaaaacaaacagctgttgcaaagaccctgtttttgggtctgggcctaacagcacgaagcacttcagagaatttcaccactaccatttactcacatctgttgagattgtactatttcaactcaagatttgatcagtgtatgtcataaagtaacaagtagtacgctaagtcagaaaacttaaaggaaacattaaatactcatttcctatatggaatgttgcctttctaagcacatcatcttcttctatgtgatgttttgcaaatctattcataggagatttatattttcaagtgtgctcaaatggatctgtgttggggaaagatacgtgaaataagaaaataaaagctaatccatttgttttaaaattttgtctgcctaccacattttgttggacttcttgttatatgagaactcctaattgtctggttttcaattgcagccaaaagcattcttacctgatcaaactcttcaaattctatttactttgaattatagctgagtacatggaaagtataattgggccttactttgttacacagcagacaaaacatatgctcaagataggtcagtgctattccagtgaataaacattttaacaaaaatttgtatgagaaattcatgttggcctctcattcctctctatatgcctttcacagttactctttttccccttgccaatcaaaacactataatgaatatctcttggccttaacgataagaaacactgtatataaatattgtctaggctgtattttatgagaatgtggagttatatgaaatgtaggaagaaaaaatatgagtgagtaatcctgtgagcagtggacgggctgagcttctaggacactgataagcaatcagtgttagttacacttgaggcagtatctctggtggtctgttccagaactatgtccttgactctgtcacattcatacttttcatcactactttttatacttctgcaatttaggtcacccaatacaggttatcttatcaggttaaactgattgtagtggtcacattgaaaaagaaaaaaaaaatcccaaattcaggacttttcccaaccagttctaattaatgcacgtgtgaaaggacatagttattgtgaaaagaaatgctatcaaaacagtctaatggctacaagaagaaaaagaaaagaagaagaagaaggaggaggaagaggagaaggagatgaagaagaaagctaaggagaagatgggtaacaggaaaaaaagagggcaggaaaagcagataggaaggaaaaaaaaggtggaagagagaaatgaatgcaggcaggcaggatgttttcctcgaggttttttatttatatcccctggactgcataactcagtttattcccttctaaaccaacttttctagaatgtgttgtctctgttcgacacctacaactctggttcattttctatgcattaaggatgatgtaactttaaaacctctcatgtaaattctgcctgttttctaattctacaatcctcttgtttatgttctattctaataattatcgagcttttaaagaagagaaatctgttcttaactcaaatttatacatacactgaaggaaataacaaaaccttgaagtaaaacactgtttctatgataaaagagagctctacaaatagatgcatgaataaacacttctatgggagggataccttttcagagtttaaggctcgcgggctttgggatctaagaagatgaatcgcttgccctgtttgtgatcctaaatggaaattgacagatatgtttaatttatcctgctcagtattataaagcctttttctcatttgatttttgtgtatccctcctgaaatatttgctctggtaagcaaaagcaaatattaggttttacactccatttagtgaaataacagtgatgataatctgacatcagagaaccaaatgttccaggcttatttcatgaaaaggatttcctctccagaaacattatcctcaataggttatcccatccttcattcctcaattcatatttcttgagattgagagggaaaaaaaaagaggccagaccacaagtagcctactgctaaattcttttatgaagcttagttttatgaattaccttttagccttctccagtcatgtgggaaaactttcctgcctcattaaatctttaatgcaatgtgcaccatgcacactgtattgttatttgtgacattaggttatatattgcatagtaactataatattacttgcaaacaagctggtttttccccctgaaggtagaattaaaacaggtactcatgggaaacagctacttgtgttcttcttttcttaatggggtgaagctgaagaacaggaaagtgaatggcttagcctagaaccatctccaggaatggaggtaaattttttcctgcagtgccttctcaatttgatatctgaatctccctgaagagaatttgccttagtagatatggagaaagagggaaaaggccaagcctttggagacccttatgaaatggaatgaaccgctctcactaaattcactttctctttgtattgaaaagagatataattttcatccctagtaaatatagtcgaatccatccagtaatataagaattgcctcaaagtgaactaaaattgcacttactcctacctgtggaaaaccatatttctctagccaagagaacaatgacagattagttcctaaatagcaggagaaaatgaaatgttctattggctgaacacacagtgctctgtaaaatcagagaaatcaatattgtccccaaaatgaactaatttgaaagtctcaaagatgttcaattttatgaaagactcgtaaaattaataaatgagtctgcaaagtccaaaaatgtggaaaattacagttatttgcagtacgtataacttaccaagaccacttatattttgttagaatttttcaatgaatgttaatggatgaatttttttatatagagttctccctgtttggaatcttttagttcccttatttactgtggttgccactgactctgcatcaggctttggaaatatcactaaaaaactgttttttctttagtcttcttactagtcaaatatcagctaaacaaacaaagaaaataagtgtttgaatggtcagagaactataagaatgagaattctggcaggaaaattcatttttaaaaatccaagtaacagaatggataaatataaaaagaggctagatcagacatacccagacattctcagttcagaatgttcatagcgtattcataattttttcatagtgcctccttgaccaacagaaataagccacagttctatttcttaagtagttagtgccaaacaacttaataaatattcatgttttaacaacctagcaattgtttaaaaagaaaatggacagaaaataataatttttttcataaataaccagaatcacttactgatgggatgtggtacctttggggtagtatataccttctcaaacttgagtatcagattggataatgctatccttatttccttttccacattgacttttgtgcagttcttgcttttaattacagtctcttctgaaaacctttcttaataaagatataaagtggcctaaagtacaagtaagcagaaacatggctcaaaatgttgagaacattcttaagtggaatatagcatgttctaaggtttcaacttgtgaaccaccttgaattagttattgcagtgcccaacagatatttagtattgctgtgtgtccttcaaatgtttacaatattccactgtgcctttgtgagttcactgcagcaccctggggcacctctacacacagtttgtgaacacaggggtagatagatcctagaggcattgaaactacacggaaacttgaatgacgttagggatcccagagccactggggaatcttcattagggaagtgcaacaacatatgaaatagctcattaaactttccctatcaaaaaaactgaagtcagagagatgaattcagatgcttgatgagaacctacttggtaatggatttgaaggagagagtaaacgttaggatactgaagggattctaagagagtgcagaagcgagggcaaggaggcacaaaacgaaggcggcacctggaacatggaggagtggacagatggagaagaggcagagaattctttatctaaagcaagaggaaagggcaacgtatactcagaatattctcaaagctttttccctgaataatagcatccttcagaaaagaagtcttgtaactgactcattgcaaagtctcttacacaatggtatgtactctttggggaagacacaactggaaacaacaccaggaaaagcttgattttacagcttatggaaagattgtggagttgaaggaaaaatagaaggaaagaaattttaaaaagaataagttaatattcctaggggtgcatcctctaaattgcagagtgatatcttaagcaatccttttaagaattacttaagagcctgagcgtggtggctcacacctgtaatcccagcactttgggagacggaggtgagtagattgcttgaggttaggagttcaagaccagcctggccaacatggcgaaatcccatctctacaaaaaatacaaaaaattatgcagtcatgatggcacacacctgtagtcccagatactcgggaggctgaggcacaagaactgcttaagcctgggaggaggaggttgcagtgagctaagatggtgccactccacatcagcctgaatgacagagcaagactctaggtcaaaaaataaagaaagacagaattacttaagtaagtacttgactaactggttatataaatgtgatcataaacgcatacctttagggtaaatgaaaaagacattgattctaatattgtgtaaatgggtaactgtggcttgggaaaaaaacatctagtaacagtatcctgaaaattgtttaaatggtccgtgtttcacacaacttaaatggaagtaaaacagcttcgctcatgacaattttcaggcaattcaaaatacgttgtaataatggcaaacatgagtatcagagatacacaaaagagtttagaaaaaaatcattttatgaaatatgagctaaaacaatgttttactattatcgctattattattagccctcagcagaatagggtaaattatttctattccttagttcatgttttatattatcgctgacctgcatgaggagcccctatttttctgcgtatttatttgttcctcttttcccccttcccacctctaattcctctctcatagtattttagtttatgtcagggatccccaactcccgggctatacaggtctgtggcctgttaagaattgggcggcacaacaggaggtaagcatcaggcaagtgagcatcactgcctgagctctaccgcctgtcagatcagcggtggtattagattctcacaggagcaggaaccttattgtgaactgcgcatgcgagggatctaggctgcacgctccttatgagaatctaatgcccgatgatctgatgtggaacagttttatcccaaaacccctcctctgtgtccatggaaaaattgtcttccacgaaacccatgcctgatgccaaaaaggtggggagtgctgcaagtttccattatatgtgactttattataaataggtatgaaaaacacattagcaaatcaagtatcataggtgatctttttctacttcatctatagtcgtaacagctttgacattcaaattatacacactttgactctttttattgacaaaatggaaaattatccttaattcaaaatgtattttatttgagcatatgtggtgatttcatatattaagttgatatttttctttcctttttagagaagccatattcaagaaaaatagcatgtaattcaaattttaaataatcaaaatagatttgaaagctcaaaattttggaacattataggcctatgtcccaatattcttcccaaacctcctttcaaacgtatttattaatttagaaaattctaaatagttcagtccttgtttgaaatatatacaacataaaacttttttttctcctgcctttctagaatccttttattgagaaaatgtgtagctgatctgaagaagcatgctgtgtgaaattttgaatgtttatcttaatagaacctaaaatcttccacataggttcacccctcattactcacaataatgccaagtgctgtagtccaggcagatatttattattttatatgtgaaaagacattcgaataaggccatttctcagtggattaggggaatcagagttttctgaatttaagttccttatagagccccatgtaatgagctcttagaagacattgcagagctgcaatttaaaatcctgtttaatcagccgtagcgagctatgtgccattctctgtggaacactaagaggaatcagggttcttcctcctccatccagtacattcccaaccaggaattgctgtctggtcagggttggacgtgaaaggccatagagagccaaccctgcgaagccaagtctctgcatgtcagcacagagcaagcagcagaatacagatcatcagctttgttttatgaatatctctatttacagtgctggagtggaattttaaaaaaaggattgcagcatttgcattgaatctgtcactcacagcttcaattttgattcctgtcctataaatgatcttgctttcctatttttttctgaatttctacaaggtgactgtcaatgtcagaaaatgtaaacctcaagtgtacattgcatggggcttggcatgtatattagaaagaaagaagtttgcttaatgaaaagaggataatatttattcaaactaagcctatttaattgcacagaggaaagtataccttctttgcctgttttgtttgaattttaatataaaataaaatttgctgctaaccttttgtttttctttgaccaataacatttctcagcttagtgtatgggctatgtaaagtgcctgtcaaatggagggatgtctttgttgaaagaatccagactcacagaaagtgagtgactttctggtcagatggttagaactctcccaattttgacaaagatcgttctctgtttgggatttgtaaagctcaaactgtagactaagatgatgacaggaggatctgctgtttggcttcatggaacttaacctatttcagcaagcctgcaatactggggaaaataatacatatatttatgtttatgtcaggcttgcagttgatgggtaaggttcataaaaggttactcctaaataaatgcctatcattcccactccgtactccagtgatttctgcgtcttgcaaatactgccctatagaacaataaaattcgtatacaacagtaagtaaaatatgatttaatagcccatctcctatcccgtaatgattatgcatcttctgtcttgtagctcccagcagtaggaggacagttgacatttaccatatcatatgaccttgaagaagaggaagaagatacagaacgtgttctccagcttatgattatcttagaggtagagtactgagagcatgttcacccgtgttacttcctgatgttacttaaggttaccagtactgtattttttacctgcctggtttgacactgacttacaggactactaaaaaaaaatataccttaggagatttttgtgccactcttttgtttcactctgagacatatctagaagattgagtatatttgttgggtttgaatgataaaggagaactttagaccagacttgaaattaaatttcaaacataaggaccatatttccaaaatttaaatattatgaaagtgtttaggtacatgctaatttacatggttgtgtttttcctgttttctcttgcttccagatagattttattgtctactcccttgtttatattagataaaataaaatgaaacaggaaacttgtttatttagctatagttaaatcttgacttcagaatcctgttttaggtaagaaaggtacaggagaaactgctttcaagatttgaagggccataggcaacttcaaaatgctcaaagcctgaagtttccttagaggctctctgccaccctttcttatcatatccattctttccaataatgtatctcctccccttgacactgatacgtattcagaggcacacacatacatgcatgttcattattccaaatgggtagatgttaatttagcaccaggctctgttgtttcctgtcttgaaactttcatgcatgtgaatctatgacaaaatgaaaaattcttttctcaaaatggacattttccagtattggatgaagtggtctgctctctctctttctgtctctctctttctctctctctctgtctctctctttctctctctctctctctctctctctctctctctctctatatatatatatatatatatatatatatggcaactagatgtatactttggaattcctttaaggtgaaaagagttctctaaatgtaaagtgttgagtgaaattatttagcattcatgtgaatgaactaagacaagaaggattacctaagtgtcataggtcattcaatatactccttagatgccattgtcctattttgagaattagactgcagtcttttttgttgtttgttttttcccatgtagtaagttcctttaaaataatagcttaattcagttttaagtttctttccctattgttctacacaacccacatccatctacagtttgaaatatgtaactttcgtgcacttttttcaattcaaggtgtttgtaatcacatatatgtttatgagttgtcaggtagctattattttagttaacagggaactaaggtcatgccaaaccaagaagcatatgcttcataatgcatttggctaaggctaatattgaaattgcattgccttcccttcatgtataccacaaatatattccctgaatgacagggaaagccaacctgaaaataaaagtctactaaggccgggtgtggtggctcatgtctgtaatcctagcactttgggaggctgaggcaggtggatcacctgatgtcaggagtttgagaccagactggccaacatggcaaaacccccgcctcttctacaaatgcaaaaaattagccaggcttggtggcaggcgcctgtaatctcagctattatggaggctgaggcatgagaatcgcttgaacctgggaggcacaggtggcagcgagccgagatcgcgccgttgcactccagcctgggggatagagcgagactctgtctccaaaaaaaaataaataaataaaaaataaacataaatttttaaagttaaaagtctattgagggtggaggatacaaatatagatatgtttgacacttttgtaccctcttttcagttttactcttttttatttcttttttttccccctttagggtaatgacttgagcatcagcacagcccaagatgaggtgtacctgcacccatctgaagaacatactaatgtattgttacttaaagaagaatcatttaccatacatggcacacattttccagtccgtagaaaggaatttatgacagtgcttgcgaatttgaagagagtcctcctacaaatcacatacagctttgggatggatgccatcttcaggtaaaatcaagaactgcagctccaacgttcacacatttactttggggccaaggtgcaggagccgccccaggagtgaattttttaaggcacctaggatttgctgtcttcaaagagcagataagaacggagccctagttttctgaaagatttttctcttaaacctttacagttttaaatatgcagaataaatttgtctcggtttttattattattgatgattctttcacaattgtcagaacatgtgatcaataacgattcctatattgagaaatgttatattggaaaataaagtctcctttatgatggctcatagcgtgggaagctaaaaagatataaattccagggcacccctatttggaaagtggtttttaaaatatttccttccagtagttgttaactagtttctggcttaatagtatatagattgtaataagaaaagtaagtcttttcatttaagtgaccacccatctcactataaaacactttaagactataacagccatatggtataaaggaaagaatatgaactttggagccaaactgaatagaaattcaataagctttattgcttattttatgtgtgacctttggcaagtgattaagccttgaggaacgtttcttttcagtgtaaagtggatatagtaatgcctacttttcagggtctttgttaacatgatatgtgatcattaggaaagtactcatcacctagaacactttcagtttttttcttgttctccccgccccctttttttaaaagagtgaactacctgacttgaaccaaatatgctcgggtctgattaactgctgtaaggcggctttgttttttttatttttaaaacaatgacatttttatctgacagaattttaacttcaactgtgtctgaatgagctctttacgcttctcgttttctactctaataataaataacacaaggtgtcataggaacttccttctaaatcaggttaagttagacattcaaatgtgaccccagcctgacaacccggtatacctttaatgaaagcaatgtctccaatattggagtttttattgctgacaccaccacctctcacctccctgtccctcatcatttccctgtgctgcctagtttgcctttcactggtaatatttcaacttagtctaatcatcattaccatttcccaaaggagagaactgcagaatcataaacagaaccattgccaaacaatgtacctcttttgcataggcaattcttctagaagctgggttaaaatgccatggagatgagaagcagcacttaggaattaattatgtttttcacatttagcaaatagaggttgtcatgatgtttaaacagtacaaagaaatgagtcctccagctttcaaaatgaatgacaaccaaattgacaaaaaaagtgtctggggggcttatatatttttgtcagcattgcttttcaggctagttaatacaaagacatttccccctgatttatgttggacagtttcagtgtctacccgtcttaaaatcactggtttcatttgcagtcttctgaggtttcgccatacaggaggaatgcattcacagcgcggctctgtgaaatgacacaagagctaatccaagtaggtggctactttctgtcacctacattacctaaagcactgtggttcaataagtaaaagccaatgtcaaatttgaaactcctacccactcaggtgagctgaaagtcggcatgaatctggagtcagtcagtaagcttgttatattttatctttgatctactagtagattgagtcatatttgtaaaacatcacttgaattgatttcaacttgtcttgcacagtaggctttcgacttggtatactgtttgtgtacaagcacaagtaaattgaagctcaacaaaaattcatattcagacttatttacagtggatttacttccatggcagttctttcagcaaatgggcttaggttcctccagttagttatatgattagatggaattgtataacagaaggagaactggactgcgggtcaagaattttgacttttgttttcaactcagctatttaatagttgtaaacataagtatggctttgacctctttggacttcaatcacttcatctgtaaaataaggaggaggacaattgctctgccagcttcaaaaagtcaccgcaagaattgaattagagagctgcaaaagcacttggctagtggtaacccagcacacaaatatgaagcatttctatcttatctacttcatcccaaaggatcacattttctccaaataccattaagacttagagacctctaaagaaaggcacatactggcatttccatacatatgacagttcttactatcatttttatccagaatgctgagacccattagataaaattaatttattttcttctcgctgtcttcactaggaagatgaaggcacaagtagaaaactcttcattcttcttttaagaatataagagaaatcaacctaactgaactgtgcatctttcacctttaaattatccaagacttggatttagtaacatccttggtctttaaatcaagaaaggcttttatgaagcacctatattagatatagaactctgcacaaagtgtattttcctctaactttacagtagacattagtagagttcaccaaatttccaatctcatctataggggatattgcatttctctaatcctggagggtagatgtgtcacatgacttggtttagccaatgaaatgtggtagaaatgatgtatttttttttttcctgaggtaaacattgaatttccaatgtgagactctctgcagcttactcagcaatcagaagattaaaaaacagcctggggccgggcacggtggctcatgcctgtaatcccagcaatttgggaggctgaggcaggcagatcacgaggtcagttgttcgagaccagcctgaccaacatggtgaaaccccatctctactaaaaataccaaaattagccagacatggtggcacgtgtcagtaatcccagctactcaggaggctgaggcagtagaatcacttgaacccgggatgtggaggttgcagtgagccgagatcgcgccattgcactccagcctgggtgacagagggagactctgtctcaaaaaaaaaaaaaaaaaaaaaaaaaaaaaagcctggaatactgatttagcacacagaggtcagctgccctaacagtcacccaggcctgtagaggattttacatgagtaagcctttgttttctgttaagccattgagattttggagttgttaccacagcataaccgagtccatcgtgacttcatcacgatataactcatgagtattgcttgaaaataaatacagaatcttttcaaggcaagatatttttacacaacttttagtgtaaattttgcggtttgggatcaaaaaagattatacagaatttatataataaataatctagaaaaattcctttgtaaacaaaggagtctttgataatcatagaaatagtattgataggtacacagtatacctctgccttctgaagttaatgatttgggtaactacattttgaagacattttactgataacactaggacttaaaaagatttttgcagctcacttggcatccggccattggtaagaggtgcagccaacattttaccctacgtttccttcccattatctttgactacctcccaatgctattccataagtgttggattcgttcagtctgcaaatatttactgagcaccttccatgattatctctgtaaatctcagttcctcttgtatacaatggcagaaacaatgtctaaatttcaattggcaattaagtgaaaacataatgtatgttaagcacctgaaatagtatctaacatatgttgggaggcaatgcagggtaacaaggagatctttggttttggagtcatgcttgggtttgaatctatgctgcaccctttgctaatggtattatgttggacaaggctctttactcctctgagcctcagattcttcatttgtaaatgtgaatagacatgggttgttacattgtttattgatacttaaatgaaatgtctttccagcctgtatcatagtacacagaaaatagtagacagtaagtagtaactattaaaaagcagtcattctaggctaggctataaggatacaaaggtggacaaatgatcattcagttcaaagaaggcattgtacagtagagaagacagatatacatatacatactgtacatttatgataatataaatagtgcagaagaagtgtgcacaatgcatataaatagtgcagaagaagtgtgcgcagtgcatactggtagaactaagaaggaagcaatgaattcttgtgttagcatttaatacacttttaataaatagctgcaaaagtatcagtttctgtcagttactgctcttactcgatgtgggattgaaaatgtttaaagaaaatatcttgctatatatatataaaaaacaaattatatagcatatatatatatatatatatatatatatatatatatagtgggtagaaaaaagacaattgtaacatcaagggtatttttgttgttttaaagtgtcatgttttgtgctggttgttttagtgtaatatagcatatcttactctggtgggaaatgtagtaaaacaaaaatattgagaacaatctttaaggcagcaccaagacaacgtttctgaaatagttccaatattattcatagtggcttgtataattatgtcctctctcttcatccatcatcttttctgtattttcaaggcataaaaataagagggaagagtcagctaaagcatttgacttagttgacaattctttgatagctcatgcatctctaaaatttagtactatattattgccaacattatgtatttaaatgaatgcagcttgatatcaagagaatgaccatactgaaggggaaaaaaaaataaactgcagccttcttcatgagtaacacttgaaactgttaaacacattaaaatcccatttaacaaatagcagaacctaatgaacattgggattgctcagtgagtactaatgtggaatattactgggaaagatgtttgagtgttgaagtttctcatagctcagaatggttacacagattaaggagaggaatgtctgttgttcaaaagacaaatgaaatttgtcagttcactgaaaatatttttgtttttgtatcttttttaaaactgtttcttaaagtagtcaactgctcattcttctattttgaaatttccagaactctttgtttaagttttgcatgtcaattttatatgagaaattcttggactgtatctagatacagttaatcaatctgctgtttagtaaattgtggtgatctattgtatgataatcaactagtgtatcaaccatgaaatcatctaattctgaaattaaaaggatcagaattataggtttatcaagtgacagtccattaattccaggcagttagatttcacaatacattcaggcgagttctggtctctggcctcaagttctaatgataacagtttccatttatcttctatgtcaaatcaaacaagtaatttgtcttttacttttctgattttattcatctgaaatgtggctagtagtctttattgtatcctttgccatggagtttgttagtcattgtttgtaatagaactgttttccattcatctattcatttattatttaagtatttagtcagttacttttgtatacatttatctgtctatctacccatccgtccacccatccatccatccatccattcatcaattcacccattcgacaaaagtctactgaacatgaacatgtatggagatgatcatcctgcatatatagatggcaagataggtttctgttctcaaggagtagcccataagctcatgccaacataagtactggctttagtaactcttcaaaaccccgttgtgttaaggagacttatcaggcccagaaattctgtttctagatatatatccaaaagaactgaaaataggtattatgtgttcatgaatatgaatagcaatattatttatgatagctcgaaggtagaaacaatccaaatattcatcaactgatgaatgaataaacaaaatgtggcatgtacatgcagtgaacattagtcattaaaaggaatgaaatactgatacatgctgcaatgaagttatctagaataggtaacttcatagcaacaaaagcagattgttagtttacaggggttagaggaagaggggaaaagagaatgactgcctaatggattctgggttttcttttgggctgataaaatgtcttagaattagatatatgtcgtagttgcacaacattgtaaatgtactaaatcacagaattgtacaatttattttttaaattttaaataggtttgaaaattttcatcctaccccaaatgtcaaagttcctctctatgtacaacttgaaatgcttaattttatatgatgtgaatttcatctaaactaatgacaagaaaagtaaatgcctgtgacactgcatttttcattgacagggttcctcagtgaggggggaaaaaagcatttaatgattttcaaatgacacatgtaacctaaacactataggacagtgatatttgcctaatctagaaccttctaccaggttgtccaagatgtgcccctagagaatatagcactcaattaatagtgttggatgagtttatttacaggtaaagataattgccttgtgtttagagggtgccatctggcactcagcagccaggatgattccatccaactgcctatatctggtgatttcagggttaatttccttttctgcttcctgatcatatatgagctcatacatattcaaaagtactgtcaagtgtctaggattagcaaagtgggggtaaaagcaatgaaaattttagaaatctattgctgaaaagcttacaatttggataaagatcatcacttttgaagatatgtttacaccttgtaatgagccttttagctttgctctctggcttgattcccaaattcccagcattgattcccaaatctaacaagttatttggtaattgtgaatcactgatcaacaaaaatctaccatcactcctgagaaaggaactgaaaaatgcaggccatagcgagaatcagttgcttctttcttatggttacaagatgccatatcatatgctataaaatgtctatcggtaatttttaaaactgtgattattatgagtcaatagtagtcatttaattatgtgctcttagagtttatttaaaatttattttcatgcactaaaatgatttggagatacaaatagtgaaaagtatatttcttgtaatgttttgtagtaatttttatttggtttcaacagtcaatgaaaataggttaataaaatgtctagtatttcataataacctactgtgtgttacatattataccaagaagtttatattcatttccttttaaatcaagctcatggtgtatggactattatattatctccattgtatagaagaaaaaattgaggcctagaaagaataagttattttcttctaggccacaaggctggtaaatatcagagacaggatataaatcttggtctatttgactcacaaaactgtattcttaataattaagcttttaagatgtccttttacacaaaaataggaaaagcaagtaagataccaataacatttatttaaaatgtgaatgcatagtaagaaaagaaatatgtgtgtgacagcatttttttccaattttccatttggccaaaccagcttttctctaaaataatgagttatgccaaatcactctgctaaaatcaccagattgtacaaaagtaccaataaaatgaaggccatagatacagagaacaatggatttaatttaggccaaaaacaaattccagagatcattctaagtcagtcaactgagcactttgagaaagtttagcttataccaactacaaacaagcagatttatctctaagaaaaagaaaacaaaattgtttccatcttttatttcaatttaaaagctaagatggaatattaatattgcctacttctgctttccttgtttaagcactaaaagaaatcaagcagtcattggaatgttttcttttttaaaagaccctttaactatatgattttaaaaatgtctgtctccaaaaaatgaaaatcaaaacacatagccaagagccaagagacgaggaagaacattctcatatcttttcagcatttggaggtggtggtgattgtgagcactttagactgagccaacttgacctaatatgacaaaggaccagagcttttggttatggtattcatcagcttcctttctcagcatgcataattggcttatatttatgtcattgttgctgtacgattcctacagctgtataatacctaagaactttacttattcaccatctcttttttcctctgccataggttgagctctgttaaccttgaatccgctgtctcctatcctactgatggaagcattgcagcagctgtagaagtgtgtcagtgcccaccagggtatactggctcctcttgtgaagtaagcttgcaagaatgtatccttagtgctttcaaagttccctcaacattgctttcaataacctattctaataagagctgttttttttctatcaataattacacaaataatgtgtatcacttaaaaacaaaacttgaatatctaccaaaagctgtggctttcaattagagtattaaccacataatttcattttgtaactctttctctctgagatattttgcctataactgaaaatctgatgtttctgtctttgctacatatttgatctattgtatgctggatggtagcagaatagcacttcaaaatattttctcttcattttcatcataatgttatccaaaatttagcactctattttttttttacttttctctcattttttaattctgtatcacacttttcctctacttcatttctaagaatacaaccaaatcacaatcatctgaagcatataatcttcagaatgtcaagaatataatatatggaaaaaataccttgatatagaaaactgcctacaggtctttgatttgtttagcacctaatgtttgagatatttattgttgtctcaatatcctagatttataataagattaatggttcttacttaataccgcagtgtgtcatcctaaggtaacaatttttatttgcttctgtgtattttcttttacacagaaaactggtgtgaaactggttttacttgaaacctggtcaaaaaatgtgaacactatttccttgacagagcgcatggctagcagataaataggagcttagtttctttaaaatggtgcctttaaggaatcatttgagtgtactgagatgttccacttcagaacactacctcattatgccatttatagaaatactctaggcattgctttgtcagttctctcgtacttttaaaataatgcatacatctagagatacgcattatagtcatattcatgacagctgtgtttcctttaactgagctcagattcacctttctagaaataaaactagatataacttatagaagtacttgcttttccaaaattcatgtagatgagagaaaaataattatggatatcaattagctatgtcaacccaaatttgattttacatataaaatacacaatgtatttgatgaaacaagagccttttgctcttgattccaaactatttgaacttttaagatcctctctcaattggcataataaataacttaattctactcttgttttaaggcttgtttccacatactttgttctcatcctttgcattatcttttatacaaattctaagtgcccactgaatataaaattacttgaatattacaattgcttaattggctatgcttttagtctcttccttctctccttcaaaaatattttcaatacattctagatatgtttgataaattctgtaaatttacctgtataaattattaataagtacatacaacataatccctgtcctatctgtttagggagacaataaatatctatgaaaaatgggatctcagcactgtataattaagggagaggtatgtgctacagaacatacatgcaataatcattcaaagggatgagctactgcagtggagagagatgcaaagtgtcctggagtggagaaatcttaaattggatgctaaataatggtaacagatagatagaagcatttgagtgtgaaaaaaaaaggagagataataaaagcttcctgtatctgtcacacaataattgtttgataaataaaattactttgtaatccataaaagaacttaattgaatcaagagacaatgaattttggaactttggattttctctctgacttcttcatttcttctactctctaaaattcattttttccttatcaaaactttctgtccctaaattcactattattcagtcctatcctttcattatttcatttgcttttcaattaagtgtagtttgtaaggccagtcattctagccttgttatcactaatatcctgggatcccttaaaagctgagtaaacgccaaagaccattaatgtcttaattccagcttgctgagaacctctggccaaaaaaggatcaaatgactccattgtagacattctcttttacttcatttggggccatagtgttgattcaggatcttttttctcatttctacttgacttcttgtgaagtgttctgcagttaaatctttcaaaaattttcttactttcatagtgctgtcatcatagatttcacttgacagatgagacaggggatatactattaaaaagagtgttatgcaatctcagtttcttcttccatgaaatgaaaataatattaaccacctcatagaattgtttgtttgttcgtactttcatttagctgactagtatttgatgagcgtgtattttgagacaaacaagaccctacacagggaaaatagtgccattaacaatacagatattgtccctgtccccaaggacgttgcactgagtggtggcattaacgatatgccagaaagcaaatagaaataaacgtgacaaattctatgaaggaaataaacagggtgaaataaacagggttctatgataaagttactgcaagtggttgtatgaaggttagaaagtctactttgtaaaagtttgtcaggaaaggcttcctgaggtggtgacagctaaatcgagtgttgaagaatgagagggacaacgatgtaaaaccagctgctaaggaagcagcatagatcgtggagtctgtaaggactggaaagaaggagcgtggctggagccttgtaagcaaggggaaaagtgggacaagaagtgattggaaaagcaaggccatgaggagatttgcacatatgataagaaatgagcattttattctcatggcatggaacatcattacaagcctttcagcagagtagtggagtagtgtaatctgatttacatttttgggttttggggtgttttttgttgtttgagacagggtcttgctctgtcacctaggctggagtgcagtgatgctgtcatagcttgctgcagcctcaaactcctgagctcaagtgatcctcctgcctcagcctcctgagtagctgggactacaggtgtataccaccatgcccagctatttttttttgtttgttttaatagagacaagatctcaatatgttgcacaggctgatctcgaactcctgagctcaagcaatcctcccacctcagcctcccaaagttctggggttacaggcatgggccaacgcacccagcctgagttacatttttttgaagaaggcattatggctacagtaggaagaatgtgtcttaggagggcatgaataataggaaggagaagggttaatatgtagttgcagtggaacacagcaatgacagtagttgctgttaggatcatggcagggaatataaaaagagttagcatattctatatatattttgatagtagaacaaataggacttactgattcgagactgtatgtcaggggagagattaaagaaataaagagtttaagaatgagtcatagatgaccagtttgaatgattgatcagttggttgtggtgtcatttactgagctgaggaatagttggtgtgtgtgggggggtgggggcatggaatccatagtccagtttagaaattttcgatttgaaaacgctgtgaagtgtaaatgtcaatgtgtatttataatattcaggtcttaaattcagcatgtctgtctggtctagagatatgtttttggaaggcgtcataaactatggaactgaataaaattacccaggagaaagtgcaattgatttaaaaaagagagaaaaatagcccagcccaagccctgaggagctcctgacgttaagaagcagggtcaaagcagaggagacagcaaagaaatatgctagaaatttgggaagtgtgatgtcatgaagttgagaaaagaaattgtgggaggaaaaggagtcagctaggcccaaggctgatgaaaggttggataaaatgcaattgcagaattgtccatcgaatttggctgcatggaatttggtgacaaggacaagagcagttttaattgagaggtggtgacacaaaacagattagaatggaatgaagtgtgaaaaagaggtgaggaatataatacttgttaagagtagtgttactgaaaagaaaaacatagatgactagaaaagttatatgaggctaagaggacagttttgtcatttgtgttttgtttatttttgatggagacactagatcatatttttttgtgctgatagtaatgacccagtagaagggaaagttattactaatccatcagagagagtgaatattgagaagataacagatgctggaatcagatgacaagtggagtaatatttctttaggaggaaggaccccacattccccacatcacttgtttggaatgggaatatggcaacaaggtttggagatatatgcttagatctctggacttgttagtgcaaaggcagctttaatttttttctgtgagtaataagttaaaatcactggctaaaagagaggtgtaaggagttgggaagtttgaagaaagaagacgtggtatgagtactgcatttgcagagtattaaaacaaaacaaaaaaacttattaaggaaaacttcatgaatatctgtctgaaaacagtagattagttctctcccttttctcaacatccttaatttctacccccttatgaatatgtagcttcaccagcttttaaaaatgtatattacagaaggaaatcacttctataatgaatctagggaggcaaaaaatgtaatggggagaaatgggaagggatttaattgggagaaatggaaacggaacaggatagaaatttgacaattttgggttggttgtgggggttgaaaaatgagaacacatggacacagggaggggaacattatacactggggcctgtcggagggtggggggctaggggaaggatagcattaggagaaatatctaatgtagatgatgggttgatgggttcaggaaaccaccatggcacgtgtatacctatgtaacaaacctgcacgttctgcacatgtatcccagaacttaaagtataataataattttgaaaacaaatttgacactttttttggtactgttcaaattaaggggaaagttcattttattttattttcagatataaagtatcagtacataaatttttttatgtgttcattattgatgttcaaatttgagagtcctcatatcctgaggcagaaggaacatttccacggagcataacacaattctatatcctttattacttcagtggtttctcttctgttttctttttcaactggaaaagaagggcttttcatgatatatgatgttgtactcgaccatccagaaatatagtaaataacccacaagatgcaatttcactggagggtgatcataagctcttagagggcagcagtatttgcctcatgcttattttgcatctcatccattttgtagtaatccccacagatggaaaacttaattaaggatgatggggaacttagagcaggcactgacacagggaatctaagactaaaataccctgttttaatcagaattcagtttttatataataaagtgtttcacattttaaacaaggaatgaaaaatacaagcaaagttacagaagaatgccataaaataagctatcaagaatgtgagaaataaatcataaactttttgtgtaaatttgagaaagcataataggatggaggaaatttagcatgaaatacatgaattatatatgtgtagaaattagctgtgtatgtggtcaaatataagtgtgggtgctgcctttcttccaaatcatgtcaaagattttctggaaatgatgacgttaagggcaattagtatatgggcaagtgaacacattccagagaatcaaaattgcttgggatgacatcgggtactctcttaggctaagactatatgatgagtccttttatatcagctgccttttttacagtactttttcttctactttcctgtctgtgcttttttctttgagactgtcacatttcaattctttatatctctgctttattttaccatttcagaagaaacaccaagctaatgcttcctctaatctcatacctgccaataacactaaggtcagtgcaaagccccagtgtcaggaggaatagctctgttgcaatgtttcaataatggcaatgctttgacaagcacatttgatgagtttcctacctgttattttctgttatcagaaaacaaacacaaacaaacaaaaacacctttttgttttaatctccaagactgactaaagccttatctttctctcagtcttgttggcctaggcacaggcgagttaacggcactatttttggtggcatctgtgagccatgtcagtgctttggtcatgcggagtcctgtgatgacgtcactggagaatgcctggtaagtgctctcttctttggggatgctgattgacaaggctgaaatcacctcgacagatgctacaattcagctactaccctggggaccttaaacacttgagtcaagaagtgctttgacaaagatctttgtattgaactgaattggaactgagaatgctctttcatatgtgatctccctaatgaatatgaggaagtgtttattcatattaaatcaagaattaaattagaatcagatatatttttataaggcataacttctgattggaagtataactaccatgaatatatatggtttcactttcttccataaatctatgaaaagtacagtgtacttttaaaatagaaaataatttatatccccataatatgaaaagtgtaaaatataacctttatagtaaacataattaagttttcttcatgttgaaaatgaaaacatactacatatttttatttaaaatgttcataatttaactaaatgcatagtgtcatttgtagattaaaaataaaaacaatatgtaatacatattcaccagagctgcttctcctttgcaattaagtctaagctttaaccagaaaataggctttacaaagtgcaaagcactttccatcctgctaagaaaccttaggattggagaattacactgaatagaccattctgattaactcaagggcacattagttttatattgtctgacatggcatgaagcttgaaacaacacttctcctttcattagtcttgcagaaacacaatttaaaatggtgccaattaaggaggatattatactctcatttccctgaagaatttaaggcggattctgttacctgtaattcttaatgttctatctttctcttgctcattttcccccatttctcttctacttaaaagcttctgggaaaaatccaaaatgaaaattcagggcttttgtttcagtgtaatttggcatttaggtttgttgatgctctttcccttttctctatataagattttgtttaattgcattgcattatgaagcatgagagccttaatttgtggatcagtggatttttgaaatgacatttttatgaatagaaagactaagtgattttcattttaattatgccataagtcttttaaaatgtactttgggaaaaatattgggttacctttaaacacttcactaacatgcagtaggaaataatactcagcccaaaactgacatggaattgttttacttaccctaagaagacaaaaataagtatgtcataataccaaactcatgatgttccatatagtcatatttcatgaattcattaggataaaatcaaatcaaattttcatgctgaattcattaggatgaaagcaaattagtccatttgttgatgtgatatttctaaaactagaagccttttttaactaataaaacagtgtcattcagcataattttgagagaaggaagggagagaacagaccctactaatgatgcctagtttactgattttgtttcatgaacagggagataggaggtctccttcaaataacagagcgatcttgaggaaacagtggacatcttgatgataaagacagaatctggtgtttcctgaattttccatcatagctagtaaataggtgatcatgtaggatatactgactttcaagtgccctttctccaaaattgtattgataactaagtgctgatattccattttgagtatatgggttctgatacaatacacaaagaggagaatatttgaatgttgctcatcaagggcattcttactgttcagctgaccctgcattttagcttcttgtttatttttcatggttttaacccagcattaagtagcatggtttttagcatgaaaaataaatttataaatttataaagcttaacttgctttaaaatttgattataaattatctgaaaaatatttttggcaccagaacaaaatctaaacttctgcaatagtgtaggtctatatttaaaagacattttaactcaaagtccatttgaagtaagccaggaagtattcaatgtcacatgggaagatttcatgcttgcttcttctcatagttcttgtggtatgtaatgtgagcaaaattttgtaaagcactttcgtaacaggacacctgtaaaaataaccaatccatcagagtgaagcttccatcttttttttttttttatttccattatataggttgtctgatgcagttttctggtttccactacaaaaatacttgagttttaagatgatttttatttgatgaaacgtgacattagaaaatgtaagaactacatgttatttgtcttttaaatcaataattggaaataaaaaaccctctcaattatgcaagattttcagttgaatgttagaaataccattttcaacatgtttaaggcaaaattaatttttgattcaattttttaaaacccttaagtatttgaagacataattttagttgtatcagtgagataacatgcaaataattttacaaaaaaacaagcaattcttcagtaatagcttagtttagctaaacttaaaaattgaaaggaagtaaaacaaaaatcaaatcggggaaaaaatctttcttcaaatggatccatgttttgcacattaaatcccaatatactgcattattaaggcaactattcatagtgaagctgaccttaatgctatcttttaaaaagttttgttaaaaataaatttgagaaagaattttaaataacttagagaaaagcctgttttcaaatatcaccagttactacagaaatacatatccacatttagttgatgaaattggcacgtgatgtttaaaatttttcaattttctccatgtttaattatgagtcaagcaagcttctcacagatgtaatacagtagtgcattgtccaaaccatcagagtccactgaggccaaaattcatgtctgagctaagaggccatagccccggaggatttctatgattagccacagttcccattaaatcagcaatttcaagctgaacaattgatttttacctagaatcagctacaatttccattaaacatatgttattagtgctctatgactacacacacacacacacacacacacacacacacacacacacacacacacacgcaatatcatgtattttcttaaggaaaataaagaaaaaatgaagtaagatttgcataatgaaaaacattaaaatgaatttcaatcatctttttgtaagtatgcatatgctgaaactactgtgttgtttataagctagatattaaattaactttcaatgctatttctctgctgtaaaattgaccatttaacatggaaaaattattcttgctggcagggagcagactaatgacttcgtagacctatttttggcaacatgttgatccctgacaccaaaataataaactctgatgctcatttctttctcagaactgtaaggatcacacaggtggcccatattgtgataaatgtcttcctggtttctatggcgagcctactaaaggaacctctgaagactgtcaaccctgtgcctgtccactcaatatcccatccaataagtaagtaacaaacttaccccatgaataagctcagcatccatttctgcaagtacacttttcatagcaaatatacacttccttttatcccatgtaaataaataataaacacagacatgaattttttcaggaaaattatatgaattttttcaaacctaagatatttaaaactatgaggatttctaagaatttgtaatttttttagctctagttttggtgatttaatttctaagagtagaactcaaatagaatttctacaccaattccaaagaacataaatattttatacaaacacatacatgtgcatgcatgtacacacctacacacagacacatacccatcttcataccttaataaaaggatataaatacagctaatttgggttctacccatacactatttttttgtgaatcttgggcaagtcgtaaacctctcaaaaagtaaaatgaagggactgatttaactgacttttaagtacccattctatcccttctttttagaaaaattcgttgttcacctagaacaaccacctcttagagcagatttaaaaaaacaaacaacaacaagaaagaacacttgacttcctcatttccttaccttttagaggaatgctatatccagctgcttgaattcacattccctcagggcagcctctctcagtaaacagctaagcacaccccaaccaaaaatgttgttttgtttttaaattgggatactttttttttttttttttttttttgagacagagtctcgctctgttgcccaggctagagtgcagtggtgcaatcttggctcactgcaagctctgcctcccgggttcaagccattctcctgcctcagctggactacaggctgtgttgaataaaaatcaacaatttttactcaaaagtgattataaataactatacttttaaataaaaggaaattattttctgaagaactctcttaaaggtgagcttagtgcttaataaggttcatatcgtattgtacactttccagctatctctaggcactgtgacaacactgacagagcaaaaattttcaatgatctttaagggaaatctgtcagctatagtcttttaatgtgtagatgtgatcaagtaggtcatacttcaaactcttacccagaatgcgcctaattaaaatggtcttttgttagattcaatgaatactataagctaaagactttgagataattctaacattaagtttaaatgttctccttgaaactgtgcttcctactgttaatccacatgaaatgcttatcctcccaatgaccttctttactcagaattttttaccttactcattgtttggaaaagaagagaaagcactactatttaataaaagcagactactatattctaggccaaacactgtatttggtattatttcaccttcaactataactcagtaaggtagatattattatcctcattgtatagattaagaaatgaaggccattagtagaaaaatggcattatgatgccaattctggagccagactctttggtttaaatgctgggttccatactttccagctgtgccactttaggcaagtcactgaaactctctgtgcctcaattttgtcatcattagttataataggactctcatagggttgatgtgggaaagacataattaaaatgtgtaaaccacctaaactgtgactggatatgatgaacccaatctaagagctgattgttattaacctgctcagagtcataaagtattaaagtatcagagttggaattttagttttaaaatccatgtgctttccaaatctctacggtctacaatgaagacttctttaaaaaaaaatacacactgcattttaagtgataacactaaaagcagtaattaattcattggataagtcaatttatctagcaaggttttgagaaaataagacattggtttaatgcaggggtcctcaaccatctatagcctgttaggaaccgggctgcctagcaggaagtgagtggttggcattaccacctgagctcagcctcctaacagatcaggcaggcattagattctcatagaagctcaaaccctattgcgaactgcacctgcgagggatctagcttgtatgctccttatgagagtctaactgatgcctgatgatctgacgtggaacagttttatcccaaactcctcccctgcatctgtggaaaaattgtctccaacaaaagaagtacctggtgccaaaaattttggggaccactggttaatgtatgttagtgatcagaacatttccagggcctaaggcatgagcctgaatgggctcaaaactgaagattctttaacaaccaaggatgttagagaagaggaagaaggcaagagagaaacctgttggaaaataattactataggagaacaaatgaaatatattccttcataattaaaggctactcaagcctatgatagtcataacatgacacaaaacctgcactttggtatatatgcgaagggttagatcacccaatggaagacctacttgtttgccatggctgaatggcattctcttaaccatcttcatttacatgaaactcattgttcacgactaacttgcatttgaggaaagcagaagtattgcatctggccactcgtattgcatctccttctcagccaagatgtcatgagcattagcaccactatcaatccagcagagctggctgcccattgcatcatgtgaattccagctgaatacatattagaattatataattgattgagtatgcaaaccctatggatttaccctcaagtctgaccaacattactataaatgcagaggaaacattagggagataattttgcttggataattataggcattcatgacccattgttgtctctttatttgttgtgcatttacttggataatgggttctaattgttgttcctgaaaaagaaagaaagtctgcaagcattaaaacacaatccatcagtgccaaagggattgggtttccagtgtccaataatattatttcctaaaagatgtatattctaatttggtataattacgttgatcctgatttttaaaaatgcatataacacagtgataacaataccagtaacaccaagtatttaatgattctttcattttcaaaatgttttcacttagagtaagcaattaataattattagtaaatattaataattaccaaattatcaaatattaatataaaatattaaaattagcaaattactaaataataattttacttctagcagtagaattgggactagaatagcaatttattttaaattccagctttcaatgtggtattttaacaagtagaaagagagggcagtgataattcacttagtttataaatcctagaagttttgtgagagggttataatgtcttttacatttaaaacaattttacatttaaaacaattttacatttaaaacaactagaaaattatcatggtttagttgcacaactgtgatgagaaaaatccattttcatctaacaacctgaaatgtttaaaaaaaaaatcactaaacaagacacttaatgacctagggaaactatcctttttaaaaatattttataaaaaacattactgttataatgtgagctagaaactctgagatatgaattgaatatttgcatacaatcctgaagacgagattttaatttccacaggttattcagagaaaaaaaaaaagggagctaaaggttgacgcaaccttcatgggaagtctaaagcttagtgatagttttaccttggtgatttatctatttaatccctggtcataaatcttatagatcacaagcattttggctccaaatttcttagataatattgctaaataaatcaaatatgtaagaagatagagatagattggtataattattatgatgtatgaatacagagaagcatataatatttaaattatacatatatatcaacttcatcaactatttatggtgatcactatgcttggccttctcatcttgttgatgtatatattctagctataggttgtaactaggcagtaaaagttatctggagagaagcaaataacaatgtaactatttcgaatgtttatattctttaatttctggcatcacatagcttataggttaaataaaatatgaaagagacatgtgaatctctgcctttgaatacttaggatgtgtttgaatatataatattattgaagttgttatagattttcatcagttatataataaaatatattattggcacaaggctggacagagataggacctcaataagttctatctactaatatcactgtaaatactactggtttgtgtgggtcaggaatgctgaaatttaagtttttgaaagaatgaaactcaaatttgagttgacctttgggctcactcaagagatcatattgaatgcacgttgttaaaattaatatagagaaatgtattccaagacaataggtaaatttaaggaaacaatcaattcagccatattctctagaaaattgagaatgctctagatgttttagtgctctttcctacacattgttttatgtgcacatgggagattatgatgggtcttcctggttccatatgccaaaggaaaaaactaaagttcagagaaattaagtgccttgatagtgattatacagcttgcttgtggcagaaccaatattggaactcatatattttgactcacctctctgtgcttcttccaatggggctacagtaatagaaacaattacagaaacattgaaaagaagcaaaaaaaaatcaatagaatttaatgtcagacaaactgtaaatgttcactgtaaaaatcagtaaatcttcactgtttggcaagagttatgttaattatgctacatagttacagttatattaacagctatgttaatataagggactagagcaggatgagaaaactgcagatttaattctttaactattaactaaatacctttcacgttaaatcaacatatcttattttgtttaaaaatttgtaaaaaaaaaaaaaaaggcaaagttttttaaaaaattaataagtcgtatctataatttattatggcaatatgctttcatactttttcagtataaaagggtttatcaaatcaatcatattattccattttgcagaatgggaaacaggtttagagaaatatatcgttcaaagacatacttagaaaataaatcaagtctaattaagaaatgcaattgtggagattaaatcagatttcatagtacttaaaggtaattaaagaaataagtgtttgcttaatgattctcctgagaataagtaggagagatcattgaactgaagaagaaaatacttagaaacttcagaaatttatgacgctaacaccaaaatcatgaagtaaatgaattttttctttttctcctcttcctctcagtccctgccccttttcagttatgtgtgaatattctcattaccctcatctccagcttctccactgacattgtgtagccactcaaaatggtttctcttatcctacccaactgttcaagataataattagttgaaaggagtcctgatcccctgttgtgtatgcaaatacagaacatgccctgattttctaaccctaatgatggaagttttaattttatacccatgattaaaggagtgcttgttttatatcacatacaatcccaagaagcaattcattatattttatttcaaatgcatgacagttaaagacacacaaaatattctcacacattgacttaatatgtgtttaattttattttagagtattggattaactctctgtgggagcatttaacgttagaactgaatttcaggacccacagaaggacccacagaagaagtttccctaatgtctgataatcaggaattgttgagcttctattgagcaattgttttgcttttggcttctggctgctctgaatcatttacctgttgattgttcccttttgcattagctgtgaaaaacctcaaagccaaatgttgatccacccttatcaaatgaacatatgttataacatgcattttgaattctaaatacacccttaagtttatcttttttttagtatttttttctctttaaccttgctttattcttaatgcacatattttgacagatagaattaaattctttttagaacaaggttaattgtttctctatgtatgcattcacatacataaacatatatagattgttgacatagtcacatgtatacacatgtatgtacacatatatatgcatacatatatacatgcttataagtagattataaaaataaaagtatatattcagccattaagagggattattttcatgtccagctttttattggttatcccaataacagcttcccctcctcccctatttgtggaaaatgcccgctgctcttggctttcttgtgtttcctgtggcgtggtttggataatccgggatgaagaacattttctgctggtgtggagctagccaaatagagttaaatgacataatcttggaatcacttgaggtcaatgatgatctcacaatttcctctttgtgtcacggaacaattagcttcatgtcttggccaaaattagtgctaagtgactgcatttgccaaggcaaattctgtagatgttttttattgtgcatgtttatttctcactctaattttatttttgttgttgaatgccatcttctgccatagctgtaactgcaattacagcaataagagagtgaatcttcagtttatgttgttgaaagaatatcaaagcacaaatacagatatattttatgagaaagttttatttggatgcgttatgtcgagtatctatattactagaaacttaaacttacttaattcttaccagtaggtttcaatgacaattggttataggaagaagagaatatcacattaagaatctaaagtcctagatcccatactaaattctcctggaaattttgtatatgaccttggttaagaaaaactgtgcctgccctaaccagctcataggattttgtgaaaatgtgataaaattgtaaaagtattctgaactgtaaggagctagtcaaatttaacatatttttattgcctaatttttttctcgaaaaagtgttgatttttgtcagtgagcaccttttacttatgttggttttaactgacatgtgagtgtatttaagaatctgaaatctattttatgaatagctttaaagtgtcaaggccaggtgcaatggctcatgcctgtaatcctagcactttgggaggccaaggcaggtggatcacttgaggtcaggagttcaagaccagcccggccaatatggtgagaccccatttctactaaaaatacaaaaatgggccaggcctggtagcacctgcctgcaatcccagctactcaggaggctgagacactagaatcgcttgaacccagtaggcaggggtttcagtgagccaagattgcaccactgcactccagtctgggcaacagagcaagactctgtctcaaataaaataaaataaaatatttttaaaaatgtcagaagccttgtcaaccaccattgacaagagttatgataaactgatttaggattataaaaaacaattggtatggttttctttcaatcagtgtagtcccacagaggtgggaaacccagtgcttctggttggagtcagtttctcagtagatgatgagatagttacagaatgccaattttcaaagaagacatatatatgctacagagatgcagttctcacttttatgtctgaaaacagtaacagcaaatcaccggatgtggatgagaggaaatcctttttttttattttattttaacctgtgcatcttcagtgcaatcacaatcccgtcaagaaaatcacccatagtgaactgtctttgggtcatgcgtagcaaagtacaggatgctttataaaaggagattctttactcgcagtgcacacgctgggtatgtcttgtctgctgttcatcacagctaccagaactccttaatgtggaatctttgatccagataatatttataaattcaaagcatcccagaccagcctttatctccttgacccagcagattcatttagactttccactgagttgaaatgtttaaaatgatagacttacctggtcctaataccttgctagtatcccaaaaataggaagaactattaaatctttacagaactaccctgagttaagccagagaaatactattcagaaatagtgttcatgatctgatctgcaccaaagttaagaaagtatttcaaagtaattcaagtgtcaggagcaggatcaaatcaggacttggaatgtttaatttgttgttatgtctttaattcatttagccatcaagcaagtctctattgaattgccctgtcatatataatagaaaacaaatctacttagggaaaacataataagagaaagattaattgagggcatttccctttaaaacggtagcgcaacagaccttacagaattcaaaatggttgatggcccttcagagagccagtcgagaacgcattaccgtgtgtcaatcttggggtaggggttcatgtatgagaggtgcctctcacaaggcaaagaagcatggctggagtgaaacatgttgctgaaagctaaagctagcacctgagttctctgttggttcttcatctggtgttcagctctattgcttcagacccaaattagaaatatgtgcaaagagagaagtgaattttgaaacatgccagagggtatgagatggcaaggttgcttttgtttggttaggtttatgataagtttaggtagaatatgcacacttgatctcttctgaaagctttcctgaggattccatcagtgtgagggcatacctgcaaggaagcacatgccgcagcctgcacacaggcacgccccactatggcagtagctgaagaaggaagcactgccaccaccactaccacatactgagatttccaaaatcactaacaaatttctccaggctgcttcaaattcagagggatttggctacagaagaaagtatgtgaggctgcatatgtgccaggcctggaggaatttctaaaaagcagctatacatttccacttgttactgatgatcactactcagagcagtcgaaagtcagttaataacatgtcacagggatactgctctccactgggctatattcacgtctgcagaaatagcaatgtcatttcatcctccattggccagaccctaatctctgtctctggggtgagaatgaccagcctgtactcttttgtcagagcagtagtggagagagagaaatgagaaaatgctaatgactttgtgtatgtccttcttccttgtccctgttttccgcaacaacatcaacatagctttagcccaacgtgccatttagaccggagtcttggattgatctgtgatggatgccctgtcgggtacacaggaccacgctgtgagaggtaagagtatactacactgtcttgcaaaatgatttctaccttgggagttataaaaccgcagatacaatcatcctttgcatcatcctttggagaaaaaaggccacactcaatgaggtgaaataaagtttctcaacgcacttgtcaaacaaatgcattatatttttgtaatttatttatttttcagaaattgcttcataaatcttcattcactcagagaatatctgattaatgttttaatcttaaaggttaagtattaacctacaatctttgtagaaagcattgctcaagtggaaagtcatgcactttaagatttatcttactgtctgtgtaggcaccatttatttttcataattagctttttgtccttaaaatgtagcttaaatgcatagttcatagttcagcaagtggttcataatttactttaaatatacttgaaaatagaaacaaaatgtaatttattatcatgatttatatcctcttctaattgctcctaaaccagtattttaattcctgttgattttactgggttgctttgcagcagaaacaagagtattattttatgtaatttgtgtgattatatttccttctgaaatgtttttgaagaaataattcttctatatattcagcctcagcataaaagtgatacaaacttcccccttgacatcattgccaaaaacaaaaacctccctctggtttcagcactggaaatagtccctgctgccacccttcctgggagggaggggtgcaaaggaagtgacctactttcactcatcatcactgaggctaaccctgaagagggctgtttctgcccgtcttttcctgtcatcttggcagctatcacccctgtttcaaccaggatgcataaaattaatgaagcaggagcctatcacccagagagaatttagctagcaactagcagtctgtggacaaagtgccaatgacagttcctagcagcaacaagtactatttgtgagtatggaagcatctgtaaattaggaatgaaagaaaaaaaaatgaaacaagcagcatttatttgcaatcaagaaactagatatctttaattgtgtgtgtgtgtctgtgtgtgtgtttaaagaaaggcatgtgcatattacttactataataggagaacatatcattgccaagacagatttacatcaagtgcctaaaccccccagttcactacaggcaacctttttttagcaactggaaaatgacagctgctctgtcatacaaggctattaaatccacttatctaggtgagcataatctctgatgtacttatattgctttgctttatgtactatactccctatacatgttagacaatagtttctgaaccatctataatttaaaaccctacattttatttaacaaacatctgtttagcaactaccatgtgctgggtacaaggctagacattggatataaatagatgcattttcccatccttgccctcagcacctcacatctttctttaatgcaagtgaggatggttgcttgtattcttgggagaattccatttgaatagtaaaaatcaccaaggagagaaatacctgacagaaagtatgatttcctgtctaaaatctgtattaatctgattcagaagatggcaacatgcatatgcagtgtaatgaatggcatattttatctccagctcaagtttttccacagttgataccatatttttctagccagaatttagattagggttttccaggaatatttaagatttataatttcattgtatttatgtaagccaaaagaacaccttagatagatctaaaatatgagggaaacattttttgtttgagatgtgcctgttgaagtagaagagagggaagataagggtcagggtaaggaggagatactggttgcattaaaaatcttgtaatcaaaaccattctgtaagtgatttgtgtgatcagcttatgcacatcatctaaataagaccagaatttaaaaactaaatcaacatttcccaaattgtagatgttcctggaataaagaattctgtgatcacatgagtttgggaagcatccatttgcatgttaaaagttctggcatgtcctacagtgtgtaattaagaaatctgttcaatttgtttagctcagcatttcctaaacttatgtggccataaaccctctgctttaactatatagcaagaatatatctcagactacagctcaggtgggacaagagttataactttatagtctttatcacaatttaatttctattttgagacccctttctctatatgtgggaactgtgaggtcttagaaacataatctgagcccatttcaagttgttttcttctcctctctcccagctagaatcaaagttctattaagcttacctagtaccaaaggccttatatgcaagggtagaggggagggtataatgtctgtgtgtatatgttgagcaaggggacatgtgatagggccagccagtactgagtatttcacccaagcatgtttctgctgacctatccctttttctccgtcctcctaattacctttcctttcaggtctagaaagtctctcaactactttcattccattcttagaggcacaggaatcattcagcttctttcattccatgctaagacccaccaacatctctaccatcatcatttttccatctgcctttccaaatccatcccattttctatttgaaaaaggatgagctacatttgtggaactggtggctttcagagctcggggtctggcagattcctatgtctctgccttttgccctgtcaaatcccttcattcaaacatgtagcacaagatggccttgcttcttgaatcgagggggtgaagagaaacagtgaacaggggaatggccaaacaagatacaacaaaacatggattggtattctgtcacaagttgaacactagttacagcttggaaaacattcacttagggccaaaacaccactatttttgaggtatcactgctttgctggggaatgatttaaacaaaggaaaaaaaagagtcagagagtgaggggagaaggtattcatgatgatacctttgctaagattctagacttttatcatctggacaagaggagaacaaaaataacaaagagacagaatcttgaagggctaaaagagattaagtaagcaattggaatatcaagagcaattaaaaagactgttgagctaaaagtgagtcaaatgctgaggatacctgcctgatcggacactaagttactttcagaataagtttgtaacctcagcaacatgtcatacattatggagaaggcatttcaaaaaggcaggcaagttcatctggtggattctataggacaacatgaaacttaatgggatacatagacttcttaagccctccccgctccccagctggcaaatttttaacaacttctccttaagtgatgagagaggggtcaaaagccaggactaatctcacaattgccactgaaaatgtggaaggtgtttgaatctaattgcttaatattttgaaaattcatctacagttttatcctcaagattcatactagatatcaaagaaattcctttttgtatcttaaatttcagttccaaaatcccatttagattttgtctgcttcagaatgtctgaattcgaatcaagtctaatcacccctctgcttactatgctcatgggaccttctattcacttgtgagtctccttgtgcctttgggtcctgaatgcagagcatgggctacagaaataacagaggaggggcagttatacctacctgtagtactgttagcaaaattgtgactccagttgaggtgtcaagaggccactcatatgtggttgtgcagtttgtacactgcacaaaggcactcagggaaggggaagattgagggcttgaatccagtttaccctcttcttttccatgaagtccctgggtgtctagtctgtttactttttctgcatatgtctagaaaggacaatttcttccaacttgtaaaaggcaccatgtgagcagggaaacaccctcagtcttttgctgattatgtcaaatgggaggaagtaagaacacagcattacagccacgcctctttatacagcagccaccctcttctgtgcctttgccaatactgttccctctgcctggaagattgcagccctttcactcctccatccgagactaactaatccctgttcagctcccaaaagtcagcactatcatcctgaaaatgtccttgattgggcctaatctgagttggttgcccttttgtgtgctgccataatagcatttgcatatctccagttgttctactgctacgttttaaaatgtgtgttcattctccatggactgtagtgtgaagactgtaccttatttgtattagtaccgtgtaaaagtgctcagctgattttttttaatgggttgggagaaaccagagcttttctaatttgcttggctagattaagccagcattatattgtttcattgttttcagtgtatagataatagaaatgtaggccgtgattttagccaaaagttgctgaaaaaatgatggggcagaatgagacaaaagtctcatcagtgtggttgctttcttctcattgttgcttgtctgcacgtccgctctttttctacctctccctctctctcttcctctctccctccctccctctaacattgttcctaaattatcaatagcagcaagtgtaacaaataactgcatgtgttatctggagtcttatttacatttaaacggccctttttcaaaatattgcaatttgatttgaaaaagttaacagatgtggaaaggaacaatgcctttgttatgtcaagatatccgtttctagcaaggcattcattcgataaactatttttaaaaatgcactcattctgccttgcatatgaaaatgagagggcttgacatttcacattacaattatttttggtggagtgaaaaaccaaaggactgtgatttaaactaattttaattaggtgaatccaacttgatcagactctaacacactatttttattaataaaagttatatgattagcagtattatattctctgaccctcaaattactttttaattcctaacggaacaccttcagaaatctctaatactgttctctgtatagaaacacacacccatacaccagtaatgtgctgaagtgttgcagaaaatagtcccactttcagtaacatggcatatgaattttctatcacgtatattcacaaattttccttacacgtcctgcaagaaaaaataaataaaagacagatgcttctttagttattctatttaattatagttattttcctcctgaaatgagtttttttattatggagaatttcagtcttattaattgctatctaagttaagaaaaattcccagatctcgttatataaagctatctctccaaagggcagtaactcatcttgaggaaagtgagctgaaaataataggttttcgtttgctgtgataatgatcattgtatatccttattccagtggcacaaagtcactctcttagtggtaaacaaaatgagatgtgaatatatgtggatgtgatcataagctctgaatattaaataagacaagaagaatcaggttaaaattcaaaagaatctccttcttatctttatcaaatgcctctcttgaagggattttgggggaattttgtgcactcaaattttattgcatattttataatacagaattaacaaacaattatatctgtggttggcaatattcttctaagcagtatttatacaactcataagtgtataaaatcttttgtgaatataagtaatttcattttaaaaattatgataaaacatcaaatctatgaattatagtacctaagtacctatacattttctagaaaacttagaatcatcaatgtatctgcaccaaattaatggctctgccccagaattgggatttgttaaagtactctcaatataatgtactggatttaaaccatttttatttcaaatggtagagagcctttctctaaataatgactgcatatctgtgagtagatgagcataaaagtggtgtactactgaggaaattatattctcccacattgtttttgatccccttcaattttgacacttgctgcaaaagactttatcttggtaagatggcaaagataacagagctagcctgaccataagattcagatgccctgttctgtttctcctttggcaaatgtggcttagtataaagtgtgagcaaatgtcattgaaagagaagacagagcagaatataaataggcgctgcctataaggacgtttctgcacacctgtagcagtaagttgcattttaaaacataacatttaggtcagagaaaatttgctgctatcgtttttaaaaatcttctttgccatgccctataaacaaacttttgtttttccaataatataatatattatataaatagttttatattatattatatttatataatatatataataatatataatatattatatttatataatatatataataatatataatatattatatttatataatatatataataatatataatatattatatttatataatatatataataatatataatatattatataatatattatataatatataataatatataatatattatataatatataataatatataatatattatataatatataataatatataatatattatataatatataataatatataatatattatataatatataataatatataatatattatataatatataataatatataatatattatataatatataatataaatagtttttggtaagaaagaaagagcaggagacaaagaaagaaagaaacagagaggaaggaaggaaggaagggaggaaagagggaaggagggagagagggagggagggagggaggaaggaaggaagcaaggaaggaaggaagggaggaaagagggagggagggaaggagggaaggagggaggaaggaaggaagagagagagagaaagaaaggaagaaagggagaaagacctggagtttgctaatagagttggcaggcacagttcagtatcaccttatggcatattcctataatatgcaggcatgctttctcagacttccctttagtaaagccttcaatgaaaatttgcctctgaattcatatgcaaatacatacaaatagattattaattcagatatacccacagctcccatccaattaataagaatcttctgagtcacagtttctagttaataaattctgaactcttattactgaatttccttgcgagcctgtttcctcataacaagttctggctgcaacaacaacaaaaaatgtgaaccttacatatttgtagagaaaataaccaattggagtagagacatatgatgtgttgtactacaaaggctttccaacatggacctggattcctccagagtgccagcagcagattcttattatgctttggtctcattttcagtgccagtgacaagattatatatttttttcgggctgaaatctaattactagtgggctggcaggatatcatcttgtatctacactgcagttgtagaaaaacatttttttaatcacgttgcgtttgagaaaaggaacacttaaaaggaaaatccatcatcctgggagaaggggagaatgaaaaatatgtaaacattgccccaactgaggtccccccaaaggctcactgatgaaatttcttgccttaggtgtgcagaaggctattttggacaaccctctgtacctggaggatcatgtcagccatgccaatgcaatgacaaccttgacttctccatccctggcagctgtgacagcttgtctggctcctgtctgatatgtaaaccaggtacaacaggccggtactgtgagctctgtgctgatggatattttggagatgcagttgatgcgaagaactgtcagcgtaagtcctgaactattgatgcccctgacagaattgatgtattgtacctcaaagtagctgatgagttcttgagtgtggattgaagagtaggaaattatgtggaatacatggttgatagatgcatagaatatacagagtctgcatattccagaacatttccttgtactaactaatagagtaaatacctttaaaattgctgtggtattgaagcatcactgttttccaaatgataaacatgtttttatttacatgcggaaggaagatttttttaatgaacttatgtccacagcaggaaagaagaatttgcatattagatagacaccatgtatccatttttttatctcaattctaatcacttgctttaaataattttttctgcccatgatatttcagtagtagccatcagaaggtgttaatcagttatgctttcatatgttaactttacagtgtcgtattttgtaataggtataaaattctgccaatattttcgcacacaggcatttgtcattgttgaatgattaacctcattttagtttcataatagtcatttaaggactatttctagaatgctctttcagtgttttccttccacaaaattagctactctagggcttcatccatattagtataatacatttctcccctctttaccttttttgctgtattaatactacatagaatttccaaatccttaatgtcagtgggattagaatatgaaggcggatcttgttgcagaagatcaaatggaaagtgaatccaatgttagcatttggccatcatcagcttcatttactatcataatgtttaagcagagtaggttatgagaccagcctatccattcatttctgtcaaatttatgtgagagactcttccaattattcaggtgggtcccaggacatgcagaattatagaaaccactgtaaatgtagcctattatcaactctactgtaagcaccaaagacccagtagggtaccctatttcattaagaaatgtgtctctctcatcacaggtttagaagatgagttctagctttttgttatttaataatgataattcattgaatcaaaaccaaatcactttctggaccaactggcagctgttaatataacctgtaaattgatctttttttaaagcaaaatttccaacagctcagtgcctttaaacactggattcctgacaaatgtataaaatcatagaaagcctaagaaattcttcctttcccacagatcatctaggatctacattttctagctgtgtgctcctgagcaagatatttgacctccttgagacacagttttctagtctacaaagagagtcatgaattttctgtggggactaaaggatttggcacatagagggtatccagtgagttcccaagtcctggagatgctcacacatggtagctgtctttggtagcagtgctcatagtagctgtgcatatcagttgttcaccagtgaattctaaggctaagttagtcatttactgacattttatcctgtcttccaataacccccacccccataaagttagggatattattccactaattttattatggtaatttattgtgggattattttattatggtaattaattattattttattatggtaattaattattgtagaaaattattatgggattattttattatggtaatttattatgggatccatggcatgaagtcttaagaacataaaaaagaatgtgagaataaaaacattttgaccattaccagttttcatactacttgccgtgagtatagatgtgattataatttttaatgctctttgccatataatcacaattaaaagtataagaagcacatttattacttatttttataatttttcatggatacaatatcacttctatgcataagtggtaaaacctcaaggaaagaaagttcctggaaatacattattttggttacctatagatttgttcaagaaaagtacaccactacaaagaaatatattttgcattttaaatttgtgtatatcgttggtgtcatatttttccattaaaatgacactttagcaaaactttatactgctttgttgtttttacgataacattaattaattaccatcatatttatggtaaatttaattttgtagtttacactccaagaaaaagtgactcctaaagtctaaataatttgatattttaaaaatgtatgatatgcataagaaactttcataaaataataaaagtatatacaaattcgataaatcagatgaaaatggatatttaaaggaaaaattttcagcctttccttgtatttcagctatagactatccgtaggctctttcagtttctcaatggcccttactctagtatccccttggcagacactgaagacaaactttgctggaagataaattaagcagtttttagaaaagcagttcttttgtttgtttatttgtttgttttttaaaaggagaacctagagccaggagaataaaatattagcataggctgatagagtacctgtttatagcttaattttaggttgtgttcaaatcaaaatattcagaaatttaacaaaatcatctatgagtagcctaaattcccatgtcatctcctccttgtatttttattctgatataaatgcaattatatgtaccattaaaaatatagggtacatagtaaacaattaattactattctatttgtgaaaaggtcacttaagctttagactgatttactctacgttttagaataacctcagacagctttataacaaagcaaaaaagacaaaagattacttaaatgaaatatgttttgtatgtttggagatagcatataaactgtaaaataaaagtgattcttaaatgttataatgctatagtcttaagatacttgaaatgatgtttttgttgtcttttaaacttctgaatcttaaaaaaggcataaatatttcacctcaaaccattttttaaacttaacacaaaaccggcacacagtaaatcattaaatcaaaaaaactaactaaatttttctagattaatagtaacattaaaattttgccaggggtgctattaattttgaaaattcctcaaaattattttagttctaaagtcagtatgcattacttacaatgggataatagtattttaagtgttaccctgatgtatctgtaaagaactaaaacagcgttacaccttgagtcaagaactccaagttcctgtcacgttctggactcacctatatgacacagcaggcatgtggacttgtataagctatggcttctttgaatttcagtgtcttcatgctcaaaattggaatgatgatgatgacattaatattttaatggcatatgatgggccagacatgatgctaaagcctttatgtgaattatccctacagcttgtagagttgttatagggattaaatgatagaatgcctaacagggcacttaacaaatcagaaaacattctgttactgaacttaggcgtccatgttaccatgtggggtatattattatttaacaagcctattaagactattagaaagttttcctgatcacaggtctctcttctctttgcagcctgtcgctgtaatgccggtggctctttctctgaggtttgccacagtcaaactggacagtgtgagtgcagagccaacgttcagggtcagagatgtgacaaatgcaaggtaaggagtagaggctgacccataaattactttctccttacagattttcactggcttttcatgacatgttttgtataccttcgtatattaaaaggaaggtttgggattatctaattctacaattgaaatgactgtgatcagtgaaaagtttttttcaaactagaacaaaattcattgtacattaccatttgaccttaaacatttttttttggcagtgaatgtgtattatattcgctttaattcagacatttctgaaacaaatagcaggcgaatttaatcttaatctgtggagatactctttcctttgcctttacatttttggcagaataaaatgttactcttggggctgggcgcggtggctcatgcctgtaatcccagcactttgggaggccaaggcaggtggatcacgaggtcaggagttcaagaacagcctggccaagatggtgaaacaccatctctgctaaaaactacaaaaatcagccaggcacggtggcaggtgcctgtaatcccagctactcaggaggctgaggcgggagaatcgcttgaacctgggtggcagaggttgcagtgagccgagatagtgccactgcactccagcctgggcgaccgagtgagactccatctcaaaaaacaaaacaaaccaaaatgttactccctttgctttttagcaaacaccttcttctagttccatcatttaaaagctacttcctgtgagcagtctacctaatggaagtttcagtagagaagttaatcaagatatttttaaagatgcattattttgctaaaacaaaatattcaattaaaatacagcatgttgttctcagtccctgaacataccgattgccctgctttcagtatggcaagcaacttcagattcctccatgagggtggacagatttgctctagcgctttcacaaaaatacattgtatttgtgataaagacagctaagcagaagcaagcatttctccgatgtcaaactggccttactgtaggaagtttgaaaatatcatctgcttctgtctcttgaataatatcattgctctgttttgtttttattttattttatggttggtttttaaagcccaatatgtggcgggatccagagaagcgattctgtgtgctatgtgactgcgatcccgttggctctgtgtcaccgcaatgtgatattacaggaagatgtgtctgtaaatcaggcttcgtagggaaacagtgcaacctcggcaggcaggtgcaccaacaggaggagcagccgcggagagcgcaacgggtgctgggttctcctcagaggtgggctatcggcagctccagcgggtgccctcggggagcctatcgggccccagctccggtaatcccagaggcgctgcatggctcatgcctctgcatgttgtgttctgtgtgctgtggctgaagttccctggtggcattttaccaaataacagttgctaagtgtgcaaattgcaaatgcaaagattagacaattcctaattgaacccttgcccttttaaaaataaccatccgtatgctttaaaaagcatattcaagttcatagggtcataaaactttcaattaaccaaactttcaattaaccatgaatatgtggaaatcaaataaaaatctacttgagagaacctataatcttagaaatggaagagacttcaggcaacctttggggaaagctaactttaataaatgaacaaatgaaggaaaatctagcagagaaattgatttgtccaagaaaactcagcccatttatcaggcatttcatcataattaagaattttgttaatttccacatcaattgtgcttatgtgtacaacaaatgcaagaaacacattttcacacactataaatggacaaatacccaaaacggggaaagttgtttctaattacaaaagtgtggttctcatatcacaggacaaaacaaaacaaatgctggggaagaaggaagagagggagggagggaagaagaggtcccaggctgagctgcagaagagtaggagacaagacttaccagtatagagtcaggacctgtagagaattgaggatagggcatagaagaaggagagatggaaataaaaagtaaagaagaagaagtaaaaaacaattcatggttttatttcttggctcattatcacacattttttaaaaaacaaattttgatgtcagactgccttagatcaaatcctggcctcattacttcctagctataaattccttgaatctttctgtaattcagcttcttcatctgtagtaagatccacttcagagggtttatgtctgcttacgtactccaagaagcaaatgccaagaggtttcctgggggaaaggccaacgaagcatgaagtgggagacagcatagccttctgctgcaatggggttctgactcccgggaaaacacagaaagaaagactgggtaggaaaagccttgtttggtgcattttgtcaaatcttaaattcttggccaagccaatgggatatacccaagcaaattttacccactaaaggaatcctgaattggtcagggaggttctagtatcttacagtaatcagcctgagagaaggatactcttgtggaagctcatcttaattcattcagagtgctataagagcataacatagactaagtggcatgtaaacaatggaaattcatttctcacgattctagaggctgggaagtacaagatccaggtgctggcagatttcctatctagtgagggccctctttctctagacagtcatttacccactggaacctcacttgggggaggaaactctctgaggcctcttttataagtgcagtgatcccattcatgagagctccattctcatgacctaatcacctcccaaaggccccacctcctgtctataccaccaccttgagggttaagatttctacatatgaattttgggggacataaacattcagtccattacagagcacctctgatgggtccaaaagacaagaaactggaggctttcagtcagtaaaattccacactgtaggttgtcttgcaggtagatcggatgaggcgcctccaaggctgtctcagggtagcagtgagaacagtgcatcaggcaggagcatagagagtttttagtaaatgttaggcctgattactattattattaccaatgttgttaaatgaagaaatgtttaaaataattttttttcaaaaacaaatgcatacatttacaataaaagaaaaagataataactgattaaaatgtctcctaaatataaatttagcagaaagtcaacgttcattcaagccctacatatcttacagtactattgtatgaagcagggttttgtcccgagactattttttcctctgcagcagtatgtgtgagagctgagagctcagactctggagccaacctagctgatctggaatcttgactccacaattggttagctcatgaccttaggcaacttacttaacctttctgtgcctcagtttcaccactcaataaaaaagtggtgagaatgacaactctctgccagggttgtcctgaggagtaaatgagtacatatttgtaaagagtttagatttgtaaagggtttagaattgtgctttgcaaaaaggaagcacaatatatgaatgctagttcttattaccccgagagagacacatttatgggaacctatacagtttctcactgggtctggatagccactctctcccatatttattttacctcattaatctcaattactgaccatgaatgtctgctccttaagtttgtttactagtggggttttctttagcctttgaaacaaatttttgaacaaatttgtaaacattttattactgaaatttggtagtatttattttgctacaacttagcctttaaagctacattatttaaatatttgaaaagtgaggtagaaccgtttcttcttgtatatttccttacataatcgactttggaatttttaaaatgatagctataatttggaatctcatttgatatttgattgatttaaaggggtgtacacacacccctttaatgagtaaatcaatatgagagtgtggatatatagatgtaaatatatatgagtaaatgtatatatatatgagtgtgtatatatatgtgtttatacatatatcggcatagatatatgagtgaagacaatttctgaaataaagatgaatacaaagtattatttctatgactcagatatttttcaataccgttttaatatattatgtttagtctttttgtctatgtatttctgtttctgtttgtgtgtctggtggtatgggtatgtaattgaaatttacatagtatttatatagtttcatatttttgtttaatttctatttcatgctatatcctaagcatatttatatcattaaaactgcttcaaaacaggattttaattcttgcatattatttcataatgtggatgtcatcatttaatttattcaacaatttttataacattgtacagttaagtgcctgcatagttattcaccatgataaataatattgtaataggcatgcttttgctttaataatattccaatttctgattatttctctaagccaggtatctaaaattttacatgaatttcttttactaataatgatattatatggttagttttttttatataggtgaatttaatttcaaagtcatgtcatctgttggaactgttacatgcttttttctttaatcatataccacaatctgaattagaactagaaataaaaataaaaccaacagtaaatgtaaagatgagaatgatcgtcaaactcagtcaacccattttacattttaaaaataaaactattcttagctacggtcattttaaaaatctaattttcagtgtgatttcacttttataacttatttttaaaactactaacaataatatctaaaatatataatgaggcttattaatttctctttgggtggctcacgttaagtggcaagatttttttttaccaagaagcaattattaagtctaattttccaaaataagaattatttttacaaagaagtaattaccgagaataattttccagattaaaatatcataataatgtgacatgctttatatttttaaaaaataaccctgaagtattttaagcaggatagatgattttcatttttctgctcggagtgattttttaatccatcagcattttctaacgtttcattttaagcctgataacatgcatttcaagaaagtcagccgaagctggtaatgcaaacttgaccgtaaaagatgatttgttatagatagataagagatatgcatatgaataactcatcagagaatgaaagtttacttacctgatctggtgctttaatacgtgttctcactaatcaatttcaattgttagaatgaaacctaagaaatcaaatgtttgttgaaccaattatttgatcagtgtaagcataacctgaaaattatatttataatgtgaacactatagcaatgattaaaagtatttatggatatgtgacaaaattctatcaaatattagggcaaaaaggattattttaactttaggctgctggtcaataatgttgaaagtatttttaccaagtaggagtccatagatctgaaagtaatcaattcagattactaaaaatgaagaagtaaaattttaaattaagactagaaataccacctataggtcctttccatattgctattgaaatcttgagaagtactgggacaggctggtgaaaatacaacagacagtaaaggaagcgcctaattctgcagttaattttgataaaatttcagaataattgaacttttctctttggatatcatagaaaaggtccatttgattgaatgaaaacccaattgtcataacatcagtgaggaatcctgataactcctaagttcctctgttcccacctgatctttggtattgtgcatcttgcttcacttcgagttaactgatttaaatttaatttttctctcctcttccattgccaggctgggacctttggcctacaatcagcaaggggctgtgttccctgcaactgcaattcttttgggtctaagtcattcgactgtgaagagagtggacaatgttggtgccaacctggagtcacagggaagaaatgtgaccgctgtgcccacggctatttcaacttccaagaaggaggctgcacaggtctgtaaatatgacttaagtcctacatattcactctgatagttttagggtctgacttctgtaacagtttgttcttttaaaggaagcacagattgatacaacgtatttaacataatgagtaatgtctacttatttttacgttacttaaaaaatgaaatacatgtcagtttgaaacactgccttaataactgtgtgcaagtactcagtaaaaatcagcagatgctcgtttggttgtgtccctccctgtctgtgactttgattcagccagtcactcaaacactgctacggcttgaaagttaaatgttcgatttttctggtaccagtcttatcttagtttaagctcaaaccccacgccaatgcatttcaactttccctttttcctattgcaaaattggtatccggatcaagaaaagtcaaggtgttttttttttcctggtaccccaaaaacatcttttcatctacttttggctgccttgaaaactatgatgttctaagagagaaataggttggctctagatatttagttcatcaaaaaatgcaggcagaggtttctaaccatgattccctcaagcagtattcttatacatccagccacagccttcacccaaatcatgagctaagaaaatatcacttagcattctgcagatgaaagtaaagagtgaacattagccttgatttatatgctgctaatttcgaactgacccttattccaacaatcactagtttgaatattacctttgtttactaatgtcatggattcaacctggataatgctcacatactctcagcaccatggtaagattttaaaacattgttattcactgttgtggcaaatttaagtaggaagcagtaggaataatatttaaaactatttaaagaaccaatatctttcagacattctccagcactttagatatgtggattttaccataaattaagccatgataagttattctaattgataagttattctaattgataagttattctaaatgataagtttataattgtagatcctctaagaatctgtatatctctaagccaatatctgtataacttaaaaattataaagctgtattttaaaatatactctgttctttaaatccaaagctcactgacatttttacttaatatgaattaatgaggtagtattatacatttaaatacatatagtaacaaattataaatgagaccaagaatattattttaaattatagaaagatgacagcatttaataaatgcagacctactagcattctggcccaaagaaacaccatagaaaaaaaaaagcacaaaacaggaagaatagtaatatgactgaggacatgacttgcacaaaatagcctggatttgtctaaatggctccttcagtaactagttctgggaccttgactgagtaattttgtttcattttccatctgcaaaattcatctattaaattaagataataatagtatctaccacacatggtttttgttacaattagttgagttagcggctataaaatatttagagtaatgcctagcatgtaagtgctatggaagcatttatcattattattattatctttattagttttattaattgtgttatacattgtgctttggcacaggaaaactagctaattactcaggttttctttctatttagtgttatgattccgctgaagaactacttaagataatttctatttgcaagtaatgatttgcactgtcccatgacattttttagcatataaatttaaacataatggtaactatttttcttcttaatgaaggacacatctaaaataaatcatttggcttaaaattagcaacaacagtaataaccaaaacagcaatgactaacatttatttagtgtttactcggtgtaaagtatttttctaaacaccttccacagctggtgtgtaatgctgtgagcaatgaatattgtcatttcataaaaagtgaatttagtcaaatattctaaatatattcagtgaaaatgatttagtcatcatataaccaattaaaagtttactcataacattagtcttccatttgaattcaagtatttgggtttcttccctcacttacatttctttgacatgaaacgctgcactagaaatattcttagtagctgggtcaactgccgctatgtggcatgcattccttgtcttggatggctttgaagatattctcaaacattatttttgcaatctttgaaaaagtacaaaaggtagataactttgtaccctttgaatattgcatgatagcaacaaaaatgaaaaatctatagaaaaaagtcaggtggtaaataaaaatcgaaagtatctttatatataaacagtgtccataattcaaccattttaaagtatttgcaaaattggattattctgttgtgtgcgtttctaactatatacatgatgtaccgaatttaagaagcttattaagcttattggtttttactgcagatcgggctcatcaaggaaaaactaatccgtacagcataaacaaattagaaatgaacttaaaataaatatacaaacaaaatagtaaactttgtagtacccgaatataaggtgttacagttaacatggaatctgataacaccaattctttcctttcttaaacttcataggaaagctaaaaatactttaacttttgaaattaataaatgaaatacatcttatatttattgaacagctcctttctgaaatacattgtactataatataaaagatgaatgaagtaagtttttatttccaaatatccttaagtgtagaactgaaaagaaaataagacaaaccaacacaatataaaactcaacactttgtgtcaaatttttactatttttccccttctttgttttccctcttataccggtgaagcttgtgaatgttctcatctgggtaataattgtgacccaaagactgggcgatgcatttgccctcccaataccattggagagaaatgttctaaatgtgcacccaatacctggggccacagcattaccactggttgtaaggtgagtgaaccacttttttgctctgataattttttggagagatttttgttttgtagagctctgtaattgggcatttcaaaattcaatattacatcacaaaataatgtagaagtattactataatgtgattacagatattaatcaatatcttacagtttacttgtaggaaagatgatgaagtaaatatacatttatgcagctgaacacttgaaatctacaagaggggtaaaaagaacaaaaattctgtaataataccagaaaagagctataacctcatacctaggcacaaggacatacatgtgcaaagtatgaggatatgaggaactaattaattttccaaaaatctatagaaattgcccctgaattatgactaggttttaggtttcaggaagtagttgagatcattctgaagagtcattttaacaacatttagcttggaaaataatcattttttcccattggtagaccatagaaattgacatggccagagtcatgttcagagagatctatctagcatcagcagggatggtaacaatttataaggctgttgaagaaatattaataagagatgccaaaagcctggacccagtcaatgagcgtcagtgaagatatatagggcgcgagttacattttagaactcaggctgatacagcctggtgaattcattgatttggggaataagaaagagaagacttaggatgactcctaggttttgctttgcaatggagtagatgataataagtaccatgtgcagctataggaattataggaggaggagcaagttcaggaaggaaagataatcactttgcatttttatcagctttttgtgaggtattaataaaataaaattcacccatttatagtaatgaattttaaccaatgattacagtggtgtaatcatcccttgtgccccattgcagtgaagtccccatcaccccccatgtgcctactgttttgccttctagcattataattttccaatttctacaacttctgaaaaatagaatcgtagtctgtttttttgagggggggtttgtttgtttctttgtttggcttccttcacttggtgttacgtttttgtaattcatccatattgttgcatgtatcagcagtttgttctaaaaattgcttaataatattccatttgtgtaatgtacagtgacttgcttacctgtttaccatttaatgggtgtttgggtcatttctagtttggggttacaattttgctgtgaacattagcatacaagtcaaaagcatatttatggacaaatgttttctcttttttttcttaagaacactccacatctttgccaactcttggacttttaacccttttttaattttaagaattctgatgcatgtgtatttctcttgtttgcatttatttaatgcccagtaatgttgggaatcctttcatttatttatttgtcatttatacatcttttttgaagtgtttacaaagcttatgcccatttctattttgagttgtttgtttccttagtaatgcattgcaaggattatttatatattctggatacatgttctttaacgtatgttaaagcttgcttttcatatagattgctttttacctagtttcatcatctaatctttataaacactagcttattatctttttcttctatagtccatactttttatgttctacccaagaaagacaaggtccaaagatttctctcccatgttttcttcaagaagttttagagttttagctcttaaatgtaggtttggattccattttgaatattaatttttctatatatcaggtaatggtcagagctcactttttatggatacccaatttttcaaacattatttgttgaaaagactatcctttttcccattgaattactttgactcctttgtcaaaatctatcaactatatatatgtttatgcatttctggactcttttctgcttcaccgatctattcttatgttaatactagttaatatgttaattattgtagctttccagcaagtcataaaatcaggtattgtaaattcctcaacctcattcatcgtttccaataccttttgagtactttagctcctttacatttccacataacttttaaatttagcatgtcaattctttaccaaaaagcctgctaggatttggctgaaattatattgaattgatagatcaatttgggaagaattgacagcttaaaagtattagatatcccagtgtatgaacatggcataactctgcatttttttaggttgttataattttttctcagaaatgtttgtagtttttgatgtgcaagctttgcatatatattgttaaatgtatccgtttcatattttttatcaaaagcaaatgctgtgttccatttcagttttaaattgcttgttactagaatagaaaaatacaattatttttataccttatccttctatactgtaatcttgctaaacttattagttctagtttctttttggtccatttagtgagattttcttgtagataatcatgtcatctgcaaagagagatttacttcctttctaatctgtgtaacttctgtggcattttcttgtcctattgtagtaaactattgactagaagtggtggaagcaaatatccttgccttgttccttagtttaagtggaaagcattgtcttttataattgaaaatgatgttggctatattttacctgtaggtgctttttattgttttgaggatgccccctcgtgtttttagtttgctaagagcttttatcaagaatatgtgttcaattttgttaaatgacttttctgcatctattgagatgaccatatgatatttctttttaagctgttaatatgacagattatactgattgattttcaacatatcaatccagtcttacaatcctcagattaatcctgcttggccatggggattatccttttaaaattatgttgaatcctgtttgctagcattttcttaatgattttggatctacgtttataagaaatattggtatgaacttatttttcttgtagcgttgtcgtcgggatgaggtactgcaagcttcatgaaatggattcagaagtattccctcctcataatttataaaagcgttttcacaatcaatgaggtagaaaacagaaatactttagaggaacccaaaagctcactatttgaaaagatcagtaaagttggtaatattctagaaaggttaatcaagaaaaaagagagaagaaacaagcaatcaaaatcacaaataaaagggggacatcactatagatcctatagacattaagataataatatggtagtaataggaacaagttttgcctaataaatgtgataacttgcatgaaaagaacattccttcttttgcttactttgagtttaattttctcttgtgttccaagtttttttgttttttgttttttgtttttgagacggagtcttgctctgacccccaggctcgagtgcagtggcagatcttggctcactgccagctccgcctcccgggttcacgccattctcctgcctcagcctcctgagtagctgggactacaggtgcccgccactacgcccggctaattttttgtatttttagtagagacggggtttcaccgcgttagccaggatggtctcgatctcctgacctcgtgatccgccagcctcagcctcccaaaatgctaggattacaggcgtgagccaccgtgcccggccaattgtgttccaagtttcttaaggtgaaaccttagatcattgatttgtaatcctttttctctaatatgggcatttgatacatttttttccagaaactactttgtttgcactccacatattttgatatgctgtgttttaattttcacttggtttaatataatctttaatttattttggggataatgtttagtttctaaatatttggggaattttcaaggtatcgttactgttactagtatctagtttaattctaaattgttctgagaacataatctgcattatttcagaccttttgaaaattattgagatttgttttatggcccggaatagtgttcagtttgtttattataacatgtgcacttgaaaataatgtgtattctggagttgttggatgaaaacttctatataggtcaattatccttaacggtttttagatctacatgttctctcagttactgagagtgttggactataactttgtccgtttcttctttcacttctctcaggttttattcacatgtatttttgagcagtgatactaggtgcatgaacatttaggattgctatgtctttttgaaaagttggtgccttttgacattgtgaaatgtctctctttattcctagtaacattccttgttcagaagtgtactttttctgatatttatatagctattgcaactttctttttaatggtgtttgtgtggtatatatttttcacaccatcatctatttcatctccctttttagtattttaatgtgtgccttttttttttttattctgagacagggtcttactccattgcccaggctagagtgcagtggtgtgatctcagctcactgcaccctccaccttctgggctcaagaaatcctctcacctcagcctccagagtagctgggactacaggcgcatgccaccatgcttggctaatttttaagttttttgtagaaatgagatctcactatattgcccatgcttgtctcaaagtcctgtgctcaagtgatcctgcaaaattctgggattacaggtgtataccaccatgcctagcttaatgtgtgtgtgtgtgagagagagacagagagagagagtgtgtgtgtgtgtaaataacatatattcagatctttatttttcaacgaatcttaataatttggccttttaatttgaggagttaaatcatttccacttaatgtaaatattggtatgattggattaagcctgcactttgctatttgcttttgcttgccttatctgctcttgccttttttttttccttattgtcctgccttcttttgcattaatttgtataacatcttctcttgacttttggattattaaatatacctattcattttatttctttggttttgtctaggaatatacatctttaactttccagaatgtacattaaaataatattataccactttacatttagcgtaagaaccttacaacaggaaacctccagtcccctttcctatcctttgtactatattgtcatatatttttacttctatatattatacatctgacaatataagcttacgattttgatttcaatagtcaattatctttttaaacaagaaaatttctcctataactctttttccttgtgtatatcaattttaatgctttaaattcctttgtgtacattaaaattttcatttcatatcatttttcttcttccattaactacttcctaatctttatcattttattcctgttgtttcaggtctgctgacaataattttttccttttttttttttttttttttgttccagaaaggtgttttttttttttccgaagatgtttttgcagagtatgtaatcctaaatactggtttgcagcaatttaattatgctttttgttttctttttgtgtgtttaataattattttttcatgggattagttagatctgttggccctgtaggattatagttttcatcaaatttggaaatgaaagttgtcagccattatatctttaaatatttttttgttcttcattcttattgtctctttctggaaatcattttttgtatgttgggccaattgatattttcccccatctcactgaggttcttatttttttaattatttttgtatctgtattttttatttctgatagtttctattgttaagtgtccaaagtcactgattttttaatgcagcctaacctgtttttaatccaattgagtctattttttattttaaacattgtatttttttatcttttaaatttccttttggacattgtatatcttttatttctctactatactcacattttttcatttattcttgaaaatataatgtttataaacattagcatttttaaaatggtcatctgcaaattccatcttttttattgcaggactattcctactgactgacttttctcctgtttctgagtcatattttcttgattctttacatgcctgataatttttatttggatgccagacattatatacttttcattgttgtgtattggattttattgtatttctttaaagaatgttgaactttatgctggcaaacagtttaggtagtcacgggtcacttggattcttttgaagcttgcttttgagttttgttagggaaggtgcagcagaacagtctgaaagcccttctactaagctgtgaaacttctgagaatactacctagttggttactatgtctctttactctggctgttgaaaatatggcttattccaagctttctctgggctgtaagaatttttgcagcctagggttttccaatgccattttccttcatcccatgcatgcacctatcagcattcagtcaatgactcaagagaacgcttctgcacatctctggaattacctttctatctaacttctttctttttgaacacgtattctatttgccatcataagtttcagcagcctcggcttcctcaaactccactctttgtctctcaactcagctataatgcgggctttgggtttaccctctctgtgttgcagcctagaaattgcctctgtacactgcttcatgtttttttccttctctcagaaatcacagtcctgtgcttcctataattcaatatctaaaaacaattgtttcttggtttgtatttttattttagttggttgtgtactttaacagcttaacaaagaagaataaatactgtaaaaactaagaagaggctgttcaaaagaagaatattcttcagtgcctaatgcaacacaaaggtcaagtaggattagtgctgaagttgttcattaaattgaagagcaataataagggcatttttttatgttagtgggagtcgttccaattgattccactgggttgtgaaatattggaacgtgatgaccaagtgtggtcctgtttgaccctatagcagtaccctatagagatgtaaactttttttcctgctgagttagcacagatgaaataatagactctaaccaccttcacatgtatgataaaacatttgaacctggtctagaatatgctgacctagaggaaaacaagcatattgatgattcttcaaggaagttcagatgtctgacttcaattagacatgtgattagaaaaaataaaaactggacaggacattcatttttctattgtcaatagcattattaagtttaaaatgcaagagagctacatttttagaaagaaatcaaaaactcctcagaatttcaaagtgttcttatgaatatgaacaatgctataagtgtctatgactgacttttgcattttcagcttcaaatccaagcatccaccatatcacttggactcaggagtaagccctagggaaacttacaagagttccgttttatccacagaatgctatgatatagccaaactctaattaaactcttgaaattgaagttgatacctcatgttcaagatataaatcaggataaaatacattccaagtttctatgaaaacgtagttatatgtttagtactatcatttttactgatcattagataattactctgttgactaaagttgactgaattttttgattactttaaaatcaccatcaaaagtctagacttctgaatcgagaaatacttcaccattatgaagaattacaaaaaaaaacaaaactcatagagcctgtatcagacaattcttgcattgctataaagaaatacctgagactgattataagaaaactggtttaatgggctcacagttctggagggtgtacaggaagcatagcggcatctgtttctggtgaaggcctcaggaagcttccagtcatgatggaaggccaagcaaggacagacttccacatggcaggatcaggagaaaagcagggatgccatgcatttaaacaaccagatcttgccggtaggaactcatggtcacaaggacagcaccaagccctgagggatcagcccccatgatccaaacacctcccaccaggctccacctccaacactggggattatattttaacacgagaattagtggggacatatccaactgtatcagagacctctcaagtaatttatttatgagcatgtgttttactgtttttaaaactgggatgactttaatttaaatgaacagtgatttgagatttatagcttccctttctttgtgtcatggataatttctctgtgctaaggtgtgagcatacacatcatttgggctgttattgaagtagaatacgaagcctgccttctttcactagcaggggaatagtgagtaaattctctattgctaaacaaatattacctctatttatgatttaaatttgatgatggccatagtgctatctaaacacatggttaatggtctggtttattctccactataacttcctgaataaacttcctgatttggaaaggtcccaatgtctatttgtactgtcaacaattttgtaaaaattcatgctttggttttatacaattatttggataacttcatattttagttaaagataaagatgcctcacaggataatttaaatttattatttgattatagttttgataacatgattttctattaatacccgattatggcctattttgtttaagtgagttaatacatactcaaagcagttggcaaagaaaaactatgtaagtgaatatgtaagacatcctaattttgaaatttgattctacatctgatgttctttaagttacttggcggtgaggttagtgggttattctatgccttggaagctttgtccatatttataatatacaaataatcacattttagatctttgggtttaaaatatcttctagaagccgcccttattgcagcctttctactgattagcaataattagatagaaaaatacttacctataaagacaagaaataaagctaatcctgataatcatttttttttttttttgagacggagtctcgctctgtcacccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccgataatcattttaataacagaatctgggaagatttttaaccaaatatttgggcatgaaagacaatagaggaggaactggtgatcttggaaatgataatctcataagcaaactactgttagcaggaacagaaacataatactcctggtaatggtggatataagaattaagctgaggagggaaagtgtgagatacacagtgagatgcagccagacttggatctaggagtttggccaggtgctatgcatatgactttaccactgggctgtagatctgagaaggataatagaacagcaccaaaaagagttaagtcacaaagtgcatacaccatatggtggcaaactcagacagagagaggtgataccctttgtaatgccaagtcatgctctgcttgggagacagaaactacactggttttttaaacagtgaaatggaattgttaactggtaaaaggtggttggttactaaaaaaggataaaagaaagctataaggtgtcccgagtacaggtacagaagagcagctactccctctaggctgagggaggaaagacagtgaaggagttaagggctaagagagggcatgctccttctccccacttgcagcaaagctgaggttcagaaatctttcaagagggcgttgctgtcataggaatgtacagcctatggatggtcaaacaaaaccaaaaacaaacacgtcggagtttgtaggcaaatgcatgtctgtagaagctgcccaccgttcttggaggataggagcacgctgggctactgagaagccgacttcaaggtcagagcgtgtgtgcagaccaaagctagtcagaagggtgcctatggagagacaatgtgccctcccaactaaaggcacacctgggattctttctgggccactgggctcccgtgctaaataatacaaaaataatgatgaagattctttttttttttttagacagagccttgctctgtcgcctaggctggagtgcagtggcgcgatctcggctcactgcaagctgcacctcctgggttcacgccattctcctgcctcagcctcaggagtagctgggactacaggcgtccgccaccacgcccggctaattttttgtgtttttaatagagacagggtttcaccatgttagccaggacggtctcaatctcctgaccttgtgatccgccctcctcggcctcccaaagtgctgggattacaggcatgagccaccgcgcccggcctaatgaagaaccagaactcagcttggaagtgtggtgggccgccattatggacttattgggtccttccaaggcctctattgactaagcctatcattctgccaccggatacggagaaatgtctacggggtctacctactgtatcacaaagcagggtgaatttggagctcagaaacagtagatgtataattggcacagctggtccctgaaatgacttattccaagatcctaaatgacattttagaaattcacttggcatttttattaaattgcaagaagatatgagctctgtaaatcaagagcagaaacctttaaaaggataatgtaagacaaaaagacaaatggataagcagaaattaaagatgagagaaataaaattattcaaaagaagttaagattgcaatagggtaatgaaaataagcattggtggtatgtgtatacaataaaacttttcctgtaaaacaggagctgtgaaagtaggataccaatttgagaggtaaatacagcaagaaatgtaaaacaaaggaaaatgattgcagaagacattaggatattatagatttggcagagagaacagagtgatgtactttaagaattatagatgatcctgaaaaagaaaattgattaattagaacagatgtaaaaatcaaaaacaaatctgaagaagaaacagtactgaatcaaaacacaattatgttcccaaactgaaagaactatgttccagtaagttgatggaaaaaaaaaaaacaaacccaagcttcagaaaattctagcaaaaatatgaattatgtaaataaagagaaaatcgtgtatacatcttgggcgaagaaaaacgttactaacagagacctcaaatcagaattgtatgcaagaataaatgccaaaaaacaatatactagatgttacttctcttcaagctctccttggattccccaagtctagtctgatgccctttgtatgttcacatagcattttggacttctcctattatataatgcttattctatcatgttatgctaacatatttacttgtctccctctactagaccgtaaggtatgtctccaaataaatgtttaaatgctacaattatgagataataaggtaaaataactttgtctaaaatttaatctttgagacaaagcagttggaaaaaacccatacccagcccctctctacctcagaaagagagaagacacattttctttctaattcacatagcattatggtttctggacgatcatatatttccataaatgcaggaagcaattttaatgtttatgttcactgatgtttcccaagtgactaaactagaatagtacaaagcctataacagatacatgattaatatgtgtttaatggaagcatagaaacattagaattaaaattttaagatatttcccataaagttgtgttaatggttgctgtttttatctcctctataggcttgtaactgcagcacagtgggatccttggatttccaatgcaatgtaaatacaggccaatgcaactgtcatccaaaattctctggtgcaaaatgtacagagtgcagtcgaggtcactggaactaccctcgctgcaatctctgtgactgcttcctccctgggacagatgccacaacctgtgattcagagactaaaaaatgctcctgtagtgatcaaactgggcagtgcacttgtaaggtatgtgctgctgacatgcagctagggaaaacctccctcaattctgtttccattgctcagttttaacttcattcagtgtttgttatacctgcttcattaagctaaacaaacagatggacaaaatctcattgccagacatggagttttcattgatatgcatttgttggcataccgataaacactgcttttctagagcttattttcaacccaaacccacctttttttctagttggtggagatgatctattttcaatggtatagtgattttttaaaaaatatattagatttgcttcgataaggacaatctgggaggggtggcagggaagacagttcttttaagcatcatcagagaaaatcacagctaaataataaggcttataaaaaccatttctccaaaaattaatctgcaatcgctgtatactagaaaatatatttactgctgtggaagtttagtaaaatttcaacacatataaacgctgtcattacaaacagtgactatgtgcaaatttcagccctcattaatatggttaaatgatgtagaaaaagagccaattaaaaaggtaaaaaggatttttcccctcagatagttctgaaaaatcaattccaggataaatgcagtttaaactgtgtcagaggtatcttttcaagataaaatctatgcaaaaagggacagaggaaacaggaagataaaatctgggtagtggttgttaaaatggccttgagaattgaggaaaatggcagtttctaccatcaagggcttcggccaataccgagtacaatgctgcattcttatatctcgcaattatgatcatatatttaatacatgttatgtgtgtatatatattacaataattatataaattgatattttaacctgctgcctatttcttacagcttacaatagcaccactgtttaagactcaatgtttttatgttgcttttgaaattttcatgagtctttcatattgctcagagcagaactgtagaaaatgtaccacttacatttaagaaacaatgtacaggccgggcgtggtggctcacgcctgtaatcccaccactttgggaggccgaggcgggcggatcacgaggtcaggagatcgagacaatcctggctaacacggtgaaaccccgtctctactaaaaatacaaaaattagctgggcgcggtggcgggcgcctgtagtcccatctactcggaaggctgaggccggagaatggtgtgaacctgggaggcggagcttgcagtgagcagagatagcgccactgcactctggcctgggcgaaagagcgagactccgtctcaaaaaaaaaaaaaaaaaaaaagtacaatacctttagtcttatatctatttaaaaataaagcatttttaaaagatccatgaactcctaacaatgaggttaactacatgtgccatttgagatgtgagtctaatactcagtgttcttctgttttgttttaaattttttaaaaagagtatgctcccgttatgcattctcagggtgatttctcccctaactttgccgttataaactctgagggtctcttgtctttcctcaggtgaatgtggaaggcatccactgtgacagatgccggcctggcaaattcggactcgatgccaagaatccacttggctgcagcagctgctattgcttcggcactactacccagtgctctgaagcaaaaggactgatccggacgtgggtgagtagggaactgctgagccatgtaatggtataatgttagttcctgctggtgtcttttagtcaggcactgaggggtagtagaaaatggcaaaacatttaagtaaccttttcctctgtgaacatttaggaacagcaaaggggtcacgtgccattagagagttggagtaaatgcctttcttatttgttcttaaaagtagttcacttattgataaggaaatagatgccaagtgaaaaagaggaaccttgtccgggaagcattatgttttgagatgggaagagtgagggcaccagagcatgaatgttgatatgagctaacacaccaatgagaaccaggacttgtcacacattcattccaaccaaccttaggcaatcatgatttttggagtgaaaacatgttcatttttcattttcctttaactctttctacatttagattcaatttgtgttagtgtgaaaggctccagtgtccacagatattgtggctttcactatgtgaattagtcaaaaagatttacgtcctgccatgcttgcccactgcgtgtgagttctgttgcttgtgagaacatcatcagaatgggtataggaactgcagatagacatgcagttcgtaacttagttttaaagaaatgtccaaagcgtaaattcagccttctgctgtattttgaccccttgcaggtgactctgaaggctgagcagaccattctacccctggtagatgaggctctgcagcacacgaccaccaagggcattgtttttcaacatccagagattgttgcccacatggacctgatgagagaagatctccatttggaacctttttattggaaacttccagaacaatttgaaggaaagaaggtaagcacaagaactttaatgtcaagtgagaacaagataaaatctttttagaatcacaccatttggagatttatccaattcctcattcttctttttattttgtcagttgatggcctatgggggcaaactcaagtatgcaatctatttcgaggctcgggaagaaacaggtttctctacatataatcctcaagtgatcattcgaggtgggacacctactcatgctagaattatcgtcaggcatatggctgctcctctgattggccaattgacaaggcatgaaattgaaatgacagaggtaaagttagtcattgtttggtgcaaagataccaatcaatggttttgcattcagttttgtcatagtgatttctcttcttgttaacagaaagaatggaaatattatggggatgatcctcgagtccatagaactgtgacccgagaagacttcttggatatactatatgatattcattacattcttatcaaagctacttatggaaatttcatgcgacaaagcaggtaaactctaatagaaaatattcaagctcttattttagagtctgtaaggaaggttattgacctacagatatcagataagaaagattggaaagtgattggttttgcagtataatgatagaagataaaccatggaggcttccctgtgacctggaagaagctactaccattcatcagaaaagaaaaatagcatgagaaacacgttaaagggaaaaaaaaatatggaattcactgcagacatagtgagtttaagatgccagtcataaattcaagagatcatatactgtagatcaggtaaaattaactgttgtggtataaatggattataaaagtgctgagaaagtgacctcttcacccatcaggggaaccaggcagggccaagttggtccagtctcctccaactgtgagcattctaatctgttcaccccagtgtgccatacaatgttgtcattttccctatgcatcatgttgagaaatgattctgaatcactttgaaaaaaatcacacagaacagcaagaatgaatgcaatgttgtcgaacctacatgatgggaatacttcaagggagtattccgtgttttcttatgaccaaaattggccaactgaaatgaggcttgttgggtctgacacttaggaccacactggtaacattcatgataccggtctcagtgtcctggggcagaattaatctcaagcttttaaagaaagaatgtgacacatgagcccaatattatgagtgtaaactattattttccatgaatataattgtaaaaagaaggaataacatattgtcaaaagtaaaaagatgattgtttaatttgaaagagtatgtttacagaacatgggaatggattagtaatgaggaaaatattgaaatataaaataaagagagaataactaatagaggaaccaggagacttccacatcatggaccctcatggtcatattctttgagtagacggttcaccttatccaatgggataaaatgagaaatcatacagatttaggtaagtttcataccatggaggcagaaagttgaactgagttcatataggagacctcaatttctctttcatgtcagtctctgttacattctatgagaatatagaatcgatatatgtttgtaaatagtcttatataataaattattagacctgcctaggaaagcaaaacagaaaaattatgaagtctctcaatggccaactaatgaatataaaaatactatttttcaaatgtttatactggaataagcacacaagacagcagaaaaccttttatttcatgcagaagatccataatgcttttctgattgatgtagagacttttagtaaaagagtaaattaaggaccaaaattcacttttatatatgtattccttgggtttccttttgatatttctcactataacaggagattatttttatatgaaataataaaaaaaatatacttaaaaaacgctgttatctatactgttaattattttagaatatcacatgtaaattaggtggcagaagccatagcagatttgcatgtcttagaaaatagcaggtaatttcgtgagtttgcaaatagattattttgcaaatggttctgtactgcagtaaaagagtttggtagtaaacagaacatcttgttagtggaactgatagaaacaatattgtcattcatctttaattatactttctttgcttctctcacaccaatttcaccttcctacactgtgacactttgtcttttttttttttcccgccctatgtctttttcttttgtcacactgttttacatacctcaccaaatgagatcttttggtttaagtgaccgtttttttgaaactttagaatacatttttcctaatctcagtaaaaactggggtcatagtctcacaatgctaagaacaaataaagctgtcatcagcatttgattttgtaaggcagtggaattgtggcaaaggtttttaaaaggtttgaatagtccccctaaagtaattaaaataaccttgtatctttatttattcaattataaatttaaatctcaaaagcagagagtttaagagtttatattctgtttgaggtttgaactttgtacattgtatcagtgctggcattatcttttttctttgcttttgtttccttttataaagtttaatttaaggaaatagcaacttttgcatttcagtagttatttaaatggaagctggagtttggccaaatccctgatgcaatcaaagccattgctctctaatcccctgaaaaaaaaaatggtgtattgcagaaatatttgttgttgctgccattcaagcttcacttgatttgtaaacacttgcgggtctgttatgtgcattcatgtgcaagagaaaggagaatgaagccagtagctcctcgggctataaaattccatggagatgccaatgcaaagttaccttcttactcccacagagagcccagagaacataagggagaagtttttcttgcagaaggggagtggtttgcttacagctcaccaccactgtgtgtacttacagggagcagagagtgaaacctgaattttaattgaatgtgtgtttcatcaagaccaatcttcagagtgcagattacaatgctagcaaagaacatgcattcataattcagtttcaataaaacctacctatgcttgttataaagtttatgactcaaactccttaaactcctggaggtaacttttatttgaagcaaaactattcattgtcacattttaaagtttatttcccaaacatgtttgtgttaccagttagtccatcataaaatagtcccagtttatggactacatttattttttaatgaaaagggtattaatatgttattttcaattatgattttcttttcaattataatgactatttcaccatcagaaaaggtgagttaagttacttgaaggaattatttaataaagttaagaaaatattattttgaaacattatcctcagaaagaaatcaatattattagattatgcgtgatcattattttctaggtggttttctaaagttcctgaaaggtcattcagagcattgggaagaagaaatttgggatagtagtaaattcaaagcaatttcaccagtgcctgtacgaaataattgaatggggaatgaccttgggttgtctgtttgcaagaatataaatgtctaattaattggccgtgtctacctgaagccactcacattttaaaaagtggggggaatatctttataataacttttcaacaggatatcagacatccaatatactaaacttcttatgatttatgtgaatattttgctaatatgtactcttaacatttgaggaagcaaaaatgcaatattaggatttggtacatgagccccagaaatttaaacagcttcaaaacaatgttaattatcttgatttaatcatcccacaacttatctatgtatcaaaatatcacattgtttaaataaatatagttgacccttgaacaacatggtggttaggagcatcaaccccacctcatgcagtcagaaatccacatataacttttgataccttcaaaacttaactactaatagcctcctgttgaacagaagccatactgataacatagtagattaacatatatttgtgtgggtattatatattgtattcttataataaagtgagctagagaaaagaaaatgttattaagaaagtaataagggctgggctcagtggctcatgcctgtaatcccagcacttcgggaggccaaagcaggcagatcacttgaggtcaacagttcaagaccagcctggccaacatgatgaaacccagtttctactaaaaatacaataattagctgggcgtggtgttgcacacctgtaatcccagctactcaggaggctgaggcaggagaatcacttgaacctggtaggcggaggttgtagtgagccaagattatgccactacactccagcctgggtgacagagtgagactctgtctcaaataaataaataaataaataaataaaaagaaaaaaaaaaagaaaagaataggaagagcaaatatattaagtggaagtggatcattgtaaaggtcttcatcctcgttgtcttcattttgagcagactaaagaggaggaggaagaagaggagggattggtcctgctatctctgggtagcagacgtggaagaaaatccccgtacaagtgaacccatgcagttcaagcccatattgttcaagggtcaacttatgtacaattattatttgtcaattaaaaacaaaaagacaatagaacatacttgaggttgacaaaaacgtgagaaggatattgctgtaggattgattgtttactaggtgatcttaactgactgtcatagtaatctaagtacattctcgctgtttctaggatttctgaaatctcaatggaggtagctgaacaaggacgtggaacaacaatgactcctccagctgacttgattgaaaaatgtgattgtcccctgggctattctggcctgtcctgtgaggtaagctacctcctactaacctgcttaatctcaagtcacttcaggagctaaatggaaatactcccagaagtacctttactgcatacatattcttaatctattttatttaatcttccactcacagtgtgagacacagtggcaagaggataatgttattgatatttagtacaaatcatacctgaagggaaatagttgatcaaaaatttaaagatttgtgaaaatatttaacaatcaggaattaagaatgttttaataagcctatttattatagctgatctattttcttggaccacttctgaagagttagagacatttaaactgcaatgattaggagataggattatactgggttttgaaaatatttttatatagaacacgacaaaacttgtacactaaatagcaggctgttccctttaacataagcttctcagggaaacatatctttgttccaacagtgctgctatgagtcattacagttataaaactatcttttttttttacattttaaaagtaattttaaaactgcttttcaataaacttgctgagatattctcttgtctgccttcaagattgtcaaatttcttaggatctaatttctataattgtgaaatattaataggaacagtacgacttaagggaggtggaatgaatagatgagaaactggcctgggtttgaatctcgacttcaccatacagtaagcctgagaccctgcactgggtgctacacctctttaggctttagcaggtaaacaccaagtccctgagtaactaccactacactttcacctctcccgcagaccccacagtctgaagcctggcatgcatggggcctccaggactgctccagccctacagctgggattctttctcattagtcaggctggctggtgctcacagcataccagttagatattattaaatctccctcacctacagcctgagtcttatgaagactaaatgagctgttaatgttaaggattcatcacagcacctggtgtgtagatgatgtaagttttgatggttaatattattattaatgtaatcactagttatatacccatgtattgattcagttataaataattttatacatcttattttgtaaataggatttgagaagttgtattaagtatggtacatgagacagatgattccactaggtcaaaactgaagtgcaacttaaaaataatgagtatacatttcttgagagggacatggcatcatgaaaagaaaaaggaatttggtttcagtgaatcctacctagctgcactacttggacaggttacttgctctgtttttgctaaatcttgggtttttacctatacatcctaaggattgatttaaatggaaacgtatgtgtgaaaatccctttacaaactgacatgccattcagcttagttaccatcacatggattccatatagttcaaggaaaaagtttataaaataactgcaactgttttgtgacacatgcttaaaatgattttctactctttcctgtgacttctctgaagggcaatatttatttacatgtgtccattttgagctaataaataatcaagtaatccatctccttattaaattgtatttcctacatctatttatacacacactagtaaacttatactggtaagcactgcttatacagtaagcactgctctttccaatatacatatgtacacatagtgtatgggtgaaaactgagactgtgtggcacatatgaaatgagtgacctttccagtgagcattgaagattttaaaatggaggacagaaagaatgtgagatttttctagacaagagatggaatttcctttatcccaggtagcgtttggttttacttttaactgtgtgcacttgatcaatgctcttaattgctgtagaccttcgttattatatagctatccaatctataaaatgacagattgagttgaagttctaaaattctctgattctgcaatattattttgctatagaaaatattctgtaagtagtcaaggttgacctttagatatcttgaagagaaggttattacagctatatttttctgcatttatttgaaataatactgttcacttgtgaacaaaaatgttagtagaatagcaaattattttcatgcaaccaaccttccattctggatttaaaatgttaaaaacctttcttcatatgattgatagactttttgaatagtacattcaaatacatgctttcccattaatttgagtcattttccatcattatatgaaaatgtaaatgagcacaaataaaacaaatgataaatgaaaatcaagaaaaactaagaatatgtacaaattgtcatctgcattagtggcttcaccgtcccatgactttcacttaagcatctatttacagacagtaattgcagtaatatcttagtagagagattacagagataaagacctatctctcataataatgtacctgaagtgttttccacaacccatggcctctaatccattatacctcttatttataattcatcttgattcctaagtgtaattacccaggcataaaatcttatcatcaaagcaagagctaagggcagttttgaaataatacatcccattccagtaacatatgctttgggtcatgaatacacaaagcagttcctctacaatatttttacaaaatgtatagtattctagagacatctgcatctacaggctattttatttcatgtttttatccacaatatggttgcaagtaaacaaaattaagtatcagttactgctaaaatatagccagttgtaaagactcttagcctttgcttgttacctgcactgttatgacagtgcaggcctggtcattaaaaatgttagttttagaaatgcctaattattataatttactatttgcagaaggggccagattaccttcaggagtcaaacaaaggacaccatttcctcaccagatttcttggtgttggagccattgagtttgttatactttatttaacctgtctttgagtgacattaaatataggttattgcccaaactgacctaaactgagctttatgcagttgaaaggttatatgcaggtaccattcttacttatgactttctttcttaaatatggaaaatattcagccttgcgtgtgcagctctctgcagtaatacggaaatcagaaatttgtcaatgatctctaggtcatgttttgatagtttcagcttctatcctgtcttcccatattttaaaagggctttaggcttgcagttgaatggccggtgtctattggatcgccactcagaagctgtcccttgtggctattaaaactgatttttttaaatctccaaataatttatacctatcgtcaacacataaagcccaaaaggcaaaatgtgaaaatagtcttagctacttacatatgcacacatctatcctttatcacttctgttgcacaccagagacccaaagtctctgttttcatgtacagacaagtgttgaggaacatggcatgggtaagttatgttataattttgtttacaaatataacctaaaacaatcatggtatctttatttttagtttatttccagcaaacatagaaaaaactatttgagatagagaaacctattgatttatgtatgacaattattaaacatgctttatctcaagtaatcctcagatccaccctatgaaaagcagaacctaccattgattgagtgcttactatctcctgtacacttcctaatacagttacaccaacatcatcgactataatttatgatccccattttacgggtgagagaattgaggcccatgatcacacacctacacagcaattcaaacctcaatgaatctgtttccaaaacctaggtaaacttgtactcaactattatattatgcagtcatgtgctgcttaacgacagggatacgttctgagaaatgtgtcgttaggtgatctcctcattgtgcaaacatcatagagtgtacatacacaaacctaaatggtgtagcctactacacacctaggctacatgggatagcctgttgctcctaggctacagacctgcacagcatgttattggtactgaatacagtaggcaattgtaacataatggtaagtatttgcatatctaaacatatttaaacatagcaaaggtacattaaaaatatagttttataatcttatgggaccactgtcgtacacatggtcctatcattgaccaaaatgtcattatgcagcagcacatgactgtacaatattcctacattccaggtgaggaaaccaaggcacacagtattcagaaccttactacatacaaagtggtgaaacaggaattaaactcgggtctgcctgattgcaaaatccatgcaaagatacaagatagagtgtttttatgagctccagcacaagcatctatttttattactaaactctgaagaaagaaaggagcgcagtgtgcagccctgagcctaggataggataggtctctacagtctgcttcattctctcctctctaccctcccacatttttgtgtaaatttaatctaattttttgatgaaacaatatattatgaaaataaattaaagatagacgagagcagaagaaaattgagccatgaataatttcaacagtggggaagagaactttggaaaagtttaaattagagtagaaatgggtaagaggagctcaggaaagtatttatttgcttttctttaattccccattgtgttccagaaaggattttagatgggactcaaaaagtaacttttttgcttccaattccaacataatcattctcacaaacttttgtctcagttcaccaagaggaaaaacattcaatattgacaaacaccctaaaaattatttaaattgaaagaatagtgcaaaataatcaaggaaaagagagaatttctgtttttttttttaaaaaaaacagcacgttttaagtttctaatctttgcgttgtcaaatactctctctctctcttttgctacctcatagaaatttaatccatcaggatacgaaataaatcaaaactaatctaaaatgttaaaactgaaagacactttagaagtcatctgagttaacctactcatttgtgggatgaggaaactgggtctcaaagtaacttgcccatatctctcagacaaaactaacataaaatcaaggcttccctattcattccttttatagtaccaaggagtggtatgcactttttatgtatttatttatttttttgagatggagtctcgctttgtcactcaggctggagtgcagtggccagatctcagcttactgcaacctccacttcccaggttcaagcgatgctcgtgcctcagcctccagagtagttgggactacagacacgcatcaccacgcctggctaatttttgtatttttagtcaagacatggtttcaccatgttggccaggctggtctggaactcctgacctcaagtaatccagccacctcagcctcccaaaatgctgggattacaggcgtgagccaccatgtctcgccttttccatgtgcccttttaaatgcacacatacacaacagagaataaggagcttgccagtgacgctgcgctctaattgtctgttagacttttctaagagttttaaaacaaactcgggcctcaactctcccccagaggaattgactccacctcctctagggctggaccggaccacagactcccactatgggcgcttgtctattgtgtcaggctgcctgtcggggaaaaccacagtaataggaaaaatgtgttgtgcgttagagtagacttcaccttagggctcgccttcacatttggacctacaacgctaaactgtacaattcctcgatgaggagtattacttcttgtgtttctttttcttctaagatttattttaaacttttgtttgagcttcaaggaaacttcctctcaatttgtgtgattttttacacaaatttttacagacagtaattacagtaataacttagtagagagattacagagataaagtcctatctctcatagtaacacacatgcatgcacctagcaagtatgtcaataacacaacaattttatatatatataattttatatacatatttatatattatatatattttatatattatatatataatttatatatataatatataatttatatattatatatatataattaatatatatattcaaggatgaaatccatgcacagaaaatccagttttattcagtggtcagcttgctaaagaattggaataacccacactatgaaccacttttaaatagatcttggtttatttcttcagttatgcttaaactaattcttcaaccatcatttccaggacttattcaataataatggcaaaaatgaaccttgctttttaaataatatgtataaactttattaaattatatgattatgtccaccataagacaaataagactcaaaatagtttgaatactattctcagttttatcagcttgctcaaagttgggacattattaaatctcattagaatttattttaggctgtgataaaagcagagagtctcttgattaagtgcttaattgaagtacttttgcattatccaaatcaaaataaacaaggagggtgctagctattaagctagatctttttaaggagcttctttgtatatttgtctctggactgtctaggccagaaccaaagggatgtggaggtactagaaagttcttaatctgatattttttctggcttagtcagcaatcacttttctttcatcaatgggcataagatttttaagtgaaaaaaaaaaattctacttaaccaaggtggtaaaatagtccccttgtaattctccatgggatttgaaaaactgactcctaccttttattcataaatcaagcaatgtctgcagctatgcatgaggagaggactgagcctgaaacacaagacggttttcatcttcgtgccagagctgtggactaccttccagaaagccagagatgtttgttgatacattttcataataaacccaaatgaagatggaagtcttgattttgcatatgtcagcttcactagaagttttctgtttgctttcagatttttattgcaaaaagaaaaaaattatatcagggaaagataaattttattggtggtctaatagtcgcaagacatgtacagcttttattattttggatttcttacttttatagtctttaaattatatcagtataaataatgcatccataacactttttatttagttttttgctgtgtttcattggacatttgctagttatccatcaagcacagtaaaagcagattttaggtgttaaagacattggaattatctttattccatatgacaatgttatttaaaaacaaacatctttttcaagaaaaatactctttggagctttttcaggctgaattgtatctacaaataaaagctttccttggttaaaatctgattacacatggatgccgcccgaacaccttggagaccaggaagaaatacacattaagtatcaaaatcggcacttgcgtttgtaagtgatgttgcccctgccgcaggtgggggaaggccagtctgtctttgcagccactgaagagctcaagcgttgctaatgcagtatttctaactttgctgtcctaattggcttccttttctttcaggcatgcttgccgggattttatcgactgcgttctcaaccaggtggccgcacccctggaccaaccctgggcacctgtgttccatgtcaatgtaatggacacagcagcctgtgtgaccctgaaacatcgatatgccaggtagtcctctgagccttccttgaacaaggtccatgtgctcattcctctttacacatgctcagcatctgcatgcagaggccagctaaactgtaagggaatgcaactgtgtgtgtgaaataaaatatgtaagggaaaaagatattcacagattctgcattttaaaaagtaaggaaaaaataactgggagaaccactgagcatgtcaagaaatagaattttagcagcatcttagaagagcaccagaagacatacctatttaaaaattatgtgtgcctttttttctgattattttcttataaataaactttctataaaatttggaaattacagaaaagaattaagaagaaaaaattcacccaaaatgcaacataacattttaatgttttaagtatttcccaccaatttttacatgtgtttatgaataagatttatataacaccatggatgcagttttatgtcttgtcctttacatttttacctatcatgaggttgtattatgttgttagatattatttaaaatctttacgatctttgtttggatgtcccataatttacccatttcccttagaattgaggtagctcttatttttttatgtttctgctggcaccctgcactctctaccaccatctgcattagaacaatcagaacaatcatgtgttccaccctttttatcgtagtcactgtaagaaattcaggttgcccctgtcaccacttgtccctcaagctgtaatctgcccacagctcatctttgttaagcccatctcccacctctgctcaccttctgaaaccattctactgagccttgtggaactcatggtcaaaacaggcaaaataccccgcagaatcctcctcttccctcagtgttctcttcatcatgctctgactgaaacccaactctcactttgcatgctgctaccccggcagccctcttaaggagtagccatcacctttttgttttttttttcccctgagatgctgactcactctgtcgtgcaggctggagggcagtggcgatcctggctcactgcaacctccgactcccgggttcaagtgattctcatgcctcagcctcctgagtagctgggactacaggctcacgccaccacacctggatattttttttatttttagtagagacggggtttcaccatgttgtctaggctggtctcgaactcctaacctcaggtaatccacccaccttggcctcccaaagtgctgggattacaggcatgagccaccatgcccagctgcagtcgccatcactttctttcactcccttcattcccctgagtctgaaggtgggggcaggttttcctgctcctcgctgccagtttcatattatccatcctcctctacatcagggtccacaacccctgggccacaggaggatattggtccgtggccttttagaaaccagaccacacagcaggaggcaagcagcaggcaaaggagcaagcgcagcttcattagcatttacagctgctcctcattcctggtattactgtactgcctgagctccacctcctgtcagatcagagacagcattagattctcataggagcacaaaccctattgtgaactgcacatgtgagggatctaggttgtgcgctcctgagaatctaatgcctgatgatcaatgatctgtcactgtctcccatcaccccaagatgggactatctagttgcaggaaaacaagcttagggcttccactgattctatgttatggtgagttgtataattatttcattatatattacaatgtaataataatagatagtaataataataatagataataaagtgcacagtaaatataacatgcttgcatcatcacaaaaccatcccccaatcctagtccatggaaaaattgccttccatgaaaccagtccctggtgccaaaaacattggagacgctgctctacagcacccagctttgactctcatgcttccctctatgtgccccctctccatctgcttgtcgaagtcacctactaacctttaaataccccacatcattccttgctgattttccctgtctaattgtcattttccctagcactactcctgtcatcattcttagtgattttaatgtccatgaacttaactcttccatactcttcactttcagtttcttgtgcctctctggtctccatttgaagcgtttttttgttgttgtttggtttttgtttttttttttttttttcccactgtgtcgtttctctctagttcacttcttctaaatacttccacttcaatgtgtgtaatctcacaattgatgcacacacttttttcttgttccttatctcatgctttcactgtagtaaccagcttaatagtcatgatctttcattggtattactgctttgcaacgctcatttccctggctactcctttacttattttttactcaagtgaactccaacactgtgagaatcctaccatctcctccatacctgcaccttctttttttttttgagacggagtcttgctctgtcacccaggctggagtgcagtgacgcgatctcagctcactgcaagctccgcctctcaggttcaagccattctcctgcctcagcctcctgagtagctggaactacaggtgcccaccaccatgcccggcttctttttttgtatttttaatagagacggggtttcactgtgttagccaggatggactcgatctcctgacctcatgatccatgattcgcctccttcggcctcccaaagtgctgggactacaggcgtaagccactgcgcccggccacctgcaccttctaagctgaacgtggctgtagaaaaagacaattgtgccatctaatctcaccttaaattcatgatccctctcttcaaatggaccctttgtgctgctctgcaatcatgccacttttctctcatcctttttcttttccacattcctaggtgattatttcatacctccccctccatcctcaagcctaaacctctcctctcaccccctcccatccttaccctcagttgatggtgttgcctcttatttcattgagaatttagaagctgtcagaagagaggtaacaagctcccactactgcatgcacccacttttctgcatctgtgcccaattattatgactcttttctattactttggatgaattattcttgtttccagaaaagatcacatcttccccctatgttctcaattctacccctctcccgcttgatgacatcactctggctaatctctcctccttcttatattgtcactttttttttccatcttaaaagcaaaaacaaactctcctgactcatttcctttctaagtaaccacttcattcttctccttccatacaatggagagctgtctatcccgtctataatttctcttcatccattctcctttgaattactaaaaacaggctatcacctcctcttctatactggattcaatggctaatctacagccaccagtgttcaccttactatatctaacagccatgtttgccactgtgaatcaccccattcttcttgaaaccctttgctcaatttgctttccagcccatggcattctggagatgttcaaattccatagtggctccttctcagctttcttcattactctgaaatctacatagtggtattcctgggactcaatccttggagcaatttgtttctctaactacattcattcagatggtgatcttacccaggcatgtggctttctgtactgagatattttgatattgacatcccacagtatttactattaagtttatgatttaattttatatccactcattactatggtgtggggaggtaatttttctgcagatatgtattaccactgtaaagaaacatttactgattaatatttccttttccccttgatacattattgtatctgaacatacacaaatttatttcatccatattaagatatgtttcagtataatccattttgttttacttaccttttagctcttattacaatgttctgcttaccttcattttatgttaacatatctgtaaagcaaggtcctttatttctcttctcttctaattaactagatgctcttacatattcttccagctgacacttttatgcactattttaatctcttccacaaattttaattacaatcaaaattactggaattttgattgtaattaaattagcctatttgtaaagaattgctatatttacactagtcactcttctctcttcagatattttatgtcttacagtaaactgttttaaggttgtctatatcaagcacgcatttctcatataaaaattctttctatgtatcttacattttcattttaatggtagtaaacattacctgttttgtttcaacatagtaaatgtactaactggtcattattggtaaaccttaactattagaataggtgtttttacatgtatttgatatccaataacttttattttagttctagaagtttatcagttgattcagttattgttaagtttaccatttttttttttttttttttttttttttgagagggagtcttgctctgtcacccaggctagagggcagtggtgctatcatggctcactgcaacctccacctcccaggttcaagcgattttcctgcctcagcctcctgagtagctgggattacaggcacctgccaccataactggctaatttttgcattttagtagagatggggtttcaccattttagccaggctgatttcaaactcctgacctcaagtgatctgcctgcctcggcctcccaaagttcagggattacaggcatgaaccaccaaacctggcctataatactattatttgcaaatattataattgtgctttcacttgtcaaaagctatatctgttataataataatttcatgtttttaaattgtctcccaaaataataagctttctattttattactgattttaatatgattgccttaagtctttcaccattaagtatgatgctgatggttagtataagaaaaacatttcttgtcatgttacgaaaactgctttctattcctagcttcttaaagatatcctctttcaatcaggataagatatttaaattactcatatgcttaattgtggagagtggagtgggaatgtagatgcatttaagaggtgatcatatataggtttttcaccttaaacagaaccataaatgatattattgactaaataaataacttaatattagccatccatgaattccagaaataattactatcttgctttagtatgctattttttcatcaactgcttgcctgacaaattcaataggcaatttgagaggaaggggttaatctatacacattcttaagcaagaattaaatgtatatgtcttatgcaatcttcactggcatttttagcacagttatatttgctttatatgattaatttagaagcatttataaataatgcagtttaatttcaattttgttaggattaaaattaccgtctttatactgtcctcttttgaccaattgactattatgactatttttgttctctaagaattctaaaagcatgtctattttctgaggaatccctagatgaagtaaaaaataaatacttccattaaacaaacacagctggtataaaccgttatgctccaaatttttatattttctttcatggaactcacaacttttgaatttaggcaactctgttcatctttgaaatggcctcatgaggcaaataagaaatagctgttattactcccacacagtaagtgaggaaactgaagcatactgatttctcttttatgtgcaatatggctctcagtttcatatcatatccattatacagtgcaatgccctctaccttggtatagtggcaagcatgaactctgcagtcagagtgccttgattcaaatcctggcttcaccccttactggtagtgtgagcctactcaatttatttaacctgaatgaggtcttagtttcttcatttatataatgaaaacaataatagtggctactcacagagtttttgtaaggatttgatgaaatactcaataaaaggcttagaacattacttagtgcatggtacgcttcataaaagcaattatgataatgatgatcataaagatgataattaccatacacattatctaccatttatagtcgaagaaccaatcagttgataattaatcaaaaaataagtaaaaaaaattcatgtctagcgctatgctagattttcttactgtctcagtccatttcggatgttgtaacaaaatatcataaactgggtagcttataaataacagaaacttatttcccacagttctgaaggctgggaagtccaagatcaagtctccagcaaagtcagtgtctggggaaggcttctttcctggtcatagctgaccccttctttctttgtcttcacgtgttggaaggcactagatagctctctggggtctcttttgtaaaggccctaatcccactcatgaggctccagcctcatgatgtaatcacctcccaaaggccccatctcctattactatcacactgggagacaggatttcaacatacaaatttttggagaacacagttgttcaggccatagcaagccttaacccccaacatgatgatatttggagatgggcactcacttatcttgtttttctttatcttcacacctttccctgaaaatataaagtgcataggaaagaaaactgtagaaagctttatagactaaatattttaaagaaacccagatcaccttgtaactatgctcttcatcatacctaatgatacttgcaagataattgttgcttcatcctaggcattaataaatcctgtacataggcatgttattatgaatagctcagtgacattgctccttaagaaaaaaaatttttttgaagactaaaacctatgtaatactgagtccaaggggatagcgggaggtaagtgaactaacagtaactagtacacacacataggtagtaagtaggtagatagatagatagatagatagatagatagatagatagatacagaaggaagatattttcatttaatcattgctacaccctgtagtcagattatttctcctattttttttttcacatgggaatattgaagacttagctagctcaaacaactttttaaagataaaataatttgtggaaatattattttcactctatcataattcttattttaaaaagaaaataataaaaataaatctctataactgatcattgctgttgcctgaaacatttaaccaattacctctatcttcagtaaatagacagatttgtaactagaattcactattttttgttttgtaaaccttatttaatctacctaacaaccttgccagaatagagattgttagcattatactaagttctggaaattaatgctaagaaaatgtaagcaacctataaagccttgaacaaaaagtattagaagcaggtttcaaatccaccacaaactgcgttctccagacggcaagagagtgtaaacactctctgctgattaaatgagtttgattttacaagctcaagtgaattatatcttagagtcgggacagaatctgcaaaagtgactaggggtcatgtatggaaaacacttgagaaattgtgagaacataaaatttgtcgcaggatagtaagcaataaaacatctttccaggttttataaaggaaaataaaatgtaggaaactgattgtcatctccagtgaaacttaagtattgcttacttaacaaatatctgtcaactgtggaaaaaataaacagtgctcattaggaatcagaataggttcactttgtcagaggcaatggctcatgcctgtaatcctagcacttttggaggccaagagcggaggatccaggagttcgagaccagcatggtcaacaaaggccctgtgtctacaaaaaattaaaaattaaaaaaaagaataggttcattcaaaataacacatatcaaactaagtgctaggtttactgtatatataatatctgaaaacctagttttctaaatcccagtaaaatatcaagtttatcagacaatgtgatacatcatatctcaaattcagcaaaaaataataactgctattatgtgtccaaaactgtgtatgtaccaggaccaaaacaggtcactgtacagagattttctcatttattgttacaataaacttatgagatagacaagattatttcttcttttattgttgatgaactgatgctagagaaattaaataacttgcttaagtcataaaacagcagaggccatatccatgtttcaaatgctggtttgtttaaatagatgtttgatgagctatttcatagtatccttgtgcacaagattgaaaatatgagccagatgttagccagctgataggttgatgggcatatacgttgctaaaaaaatgtgacccagagtacactctagtgatatctccaatgatgaggcgtaagctttgtatttgaccttgttgtgttcaaaatatctgtaaatgctttggatgatatctatcaaatattcagataatataaagctgaaagtattatctaatgtgttggatggtgggaaaatatcctgacagatgatactatgaattacagttaacaagatgagattaatagaaaagatttgaactcaggtaagctcacttgtttgttcattcctgtggcatctgttaattatgtttccaacatgcaggtctatggcctatggtagatagtaagaatatgaagactgcatgggtcttgccctctaggagcttattctctagtttaggggaaagaacagaggaaatgacacatattagcaattcatgtgaagtaagagtccttacttgattgcagattcactaggtgccaacacagggcattgctatttgtataagatccaaatcaagggaggaagtacatttaatatatttgcaagtcacagctagagacttataatctactatattttgaaagaaaccctgagtaagattgctaaatgtttagcttgaaacaaagatttaggaagtaatagtattcttagatatttgaggaccttccctaggaaaagggaattagacttaattttcatagcttcagaaggcagaacttggatcactcactgaaaattagaatgcatcaaatttttattcaccgtaaggaaaaacttcacagcttatgcaagacgaaaaaagctgtcttataagaattcatgcatttaatgatatctcaaggaaagtatagaaggcattcctgtatggcaagaaggttagattaagtaatttctcaccttaggcctgagatactataatattaatgttatagtcatttgattttgtagaaggaatatataccaacagttttccagtgtgcaaaaaaaaacttaacaaatctaatatattctgatgtattattgaagagatactagcacataccactcttgagaatataattaaacttctcattaggcatccaaaatataggaatttcccctaatggctaatttttatataagaaaaaatactatgtacactatttcaaagcagacagaaaagtcatatgaaaagggtatgtcaaaaaagtttcaaaaagaggctcctgatttatgtgttgtgtgtttgtggacctaaccaggacatttgattcaattaaccaagtttagtatgtcagcaaccctctgaaagattgagaagattgactgtccagagaatattacaatatttgctttctctgttgaagaaattatgtagacttacaggtataagagaaacaaaatcatatttttgaatctcttatttttagtaatgattattggctttaaggattttaattcagttactaatgttatatttaggttacataaaataattcattatgcaattattttactgcaaaagcaaaaggctgaaaattattgttgaagatcccatgtatttttggcacattcatctctataaaataagttcttaaaacactccccagttaacacttattcatcagcatgacaccttgctgaatgacttgaaattataattcatagataattattttatcttggagccattatctctcataatgctactgttaaatatggaatggctcttttattgcttaaaaatggtggttcctttggatggttgaataaaagaggattatggcacttaaatcaatggcaaaatatgacaaatcattttgccctgctaaccacttttctgcaatgacacttgaaatttgggctttttcatctgaaaaagcctgaccagtttcatctatacttcctggaacatgcattcattcattcagtcattcaaaatagtcatcgaatgcctcccatgtttgatgaactaaaaggagcatttaagccagttttaggtcatcggggaatgtttctcagagaaagtgacatttaaaatgagagctgaaatgaataagtgctagcctgatatacactgtagagctaaggatttgcaaatgaaaagtcccagcagtgataaagagtatccgcataatttgagaatttcagatggccccatgtggctacggcattatatgcaaagaaagcagtggctacagctacatatggaggggtaagcacagtggtggtgaaggcgggggtgggggtggcaggtaatgaagctcttccttgccatgctaatgatttgttattcatcctgactgcatttgggagctagtgtaggctttcaagcaagagaaggtcatggtttgatatgttcataggatgatcactctgcagtgtggagaaatcaccagataagaaaatatggagacaggatctttagctaaaaggctattctaataatccaaataaaatatgacagtggccagatgaaaatagtagcaacaagaaagtcaagaaacagagagtaatagactcatggaactgatgatctaatggatacctcggataagagaggcctctaggttgctgaccttggcaattgagtgaatgacagtgacctcagatgaaacgagaaatacaggagtattacaaggtttagcaagagatgaacttcattgttgtcatttcaaatttaagacgcttctgtgttatacaatatttattcaagaagcaattagaagcagaagtctggaacccattagagatatccaggctgaatacataaaatacagagttttgggcacaccattaactgaagtcatagtaatggatgaaatcaccaaggtaaatgtggaggagaaaaaagagatgaggaccaaagttagaattaagggcgtcaattatattgaacagaaagggaaggaagagtcgataaaggagaattcgagtagccgcagaagtaggagaaacatcaactggcttactcttaaagaagccatgggggctgggcacggcagctcccgcctgtaatcccaacactttgggaggccagggcaggcagatcacggggtcaagagatggagacgatcctggccagcatggtgaaaccccgtctttactgaaaatacgaaaattaactgggcatggttacgcatgcctgtaatctcagctactcaggaggctgaggcaggagaatcgcttgaacctgggaggcagaggttgcagtgagctgagatggtgccactgcactccagcctgactacagagcgagactgtctcaaaaaaaaaaaaaagaaagaaagaaaaagaaagaaagaaaccatgggaagagagtatccagaaatatctatcaatggctacagaaaacctacatatgaggcctgatgattgtaagttttgctttagcaacaaagatcttatgggtcatcctggtattatgtttaatggtgaaaccagaagcctgtttaaagggagaatgggagatgaagaagtagagaccaggaatgtaaacaatgtctttttaaaagcttatcgaaaataggatagaaattgtcaagcaatttgagacctcacagattttttttttaagacaggaaaggcttgaccaatttcaaatattaatgagaatgagcctgcaaaggagggaataaagatggtggagaaaatggggaggcaggaggaaaggaaaccaatttaggagtggagtagcttcagacaaaggacggaaacaaatgtcaaagggatggaaaataatgtggcaatatactgaattgtttgccaggaaaccaagggagcatccaaattagagctttcttatctcttaaagtagggtaaggtgtagaagtagaagatttgagattggctgggcacgttgggaggctgaggtgggtggatcacctgaggtcaggagttcaagaccagcctggccaacatggtgaaaccccatctctactaaaaatacaaaaaattagcctggcgtggtggtatgtgcctgtagtaccagctactcgggaaggtgaggcaggagaatccctttattcaggaggcagaggttgcagtgagccaagatggtgccactgcactccagcctgggcgacagagctctgtctcaaaaaaaaaaaaaaaaaaaaaagagaaaaagaaaagaaaagaaaagaaaagacttgtaccttgtcatattggaaaaccagattcatttcacattgttataaaatctgtaaatgtcacaatataatttcaaatataacaccaaaaatgtaaaaaataaatgatctaaaattcactgtggcaatgtcatagtttcactgcaagaaatagcataaactctcaaaaagagttaatagaagttttaaacaaacattaattccatggcaatatctgtggtggaaatgacgtcagctattgtttgttgtgaattgccacacattccctaccaacaattgtctggccattagaagacacatgaaacataaatacattcttcttgattgactaaatgaagcagagcccagtctatgggatatcatccaagttcaagctggcggcttcgtggctccagctgagattatcaggaagtcaattcactaacatgtccatctagtttgtaactgacttttttgtttctcaacttttctttcgatattgtttataagatgtaagtcactattttgaccactccaaatcctgtcttataaaatccagctaaaattcaattccaaattcccttcttcctttttctcaactctcaaatgcaaggatcgcattcccacaagataacattcaatgttgcattcttgctgccatgtttattttttgtcaggtggtttttttaaattattattttcccaaagtctaagtaaatttctagaaggtaggatgttctttcattgcctgtttcagtgcattccatgtagctcttcctaactccttattgcataattgattattgtgttaaatataattctgcttcatgaaaattttaatttgaagctatttgcacactattctgaagctattctcatttctttgtggaaaggtgttaaagggtatcaccccaatgtctcttattatgcaagcataagaaagaagatatcgatctgagattgctagttttagattgactcctctgtatttatgaagaaccacctacatctatgctttccaccttgaggtggtttcagaaagcccactagtgggcatgtgccaaggccacagtatttgtagcacctttttctaacatctcatagagctaaaacctgggatatgaagaaacataaatgcctagaagaaataataaattttagagactcgaagtctattccccaatttagagtaggagaaaaatttacatagagattgattcagggaaaagagaatagcaactcttattgtcagtgtagctacgatagcacagtattagtttctcaaatcaaagagttcctttaaaaatatttatatcaaagactgagttctctgtcagtgataaagtgtgtgtgtgagtgtgtgtgtgtaagaaagtatatgtgttcatagacacacattcatagctagggactgtatgataaattacattctaactatcactaaattaaaaacaaacttcttctcccttttcctttacagaattgtcaacatcacactgctggtgacttctgtgaacgatgtgctcttggatactatggaattgtcaagggattgccaaatgactgtcagcaatgtgcctgccctctgatttcttccagtaacaagtaagattgagaaatataaccatatttcccaatcagaaacgccatctgtctagcacatgggctgtctatgatttggctattttttccatgtagacaaaaatctcaatttaagatagagatatttttaataatatagaaacatgacaaaagtgagtatataatgctctatggttcatttttcctttgaaactctgtcccaagtaaataatacttattaattaaaattgaagtaccaatattaatgtaagacatatttataaaacaaatgatatatatatacaaatatgcatggtttcataaatataccagtctaatgcttgcatatagctctgcccataatatcatctatgaaggattgttcgggtgcatattatataatttttgtggctgtttccatttattttatgtgtttaattcaagattgggaaataattatcaagaaaacattgaaaaattgtacaattaaagcaggtgacttattgttatgctccaaaaaatgtcatctcccggaatcacagcctcctttttcttaagatggtctgagcttggtaccatggaaacacagccctaagaagaaacaaaagctggaatatcttatttcagtgctgtctgaacattctgcactggtttatacattgatgaaaaccctaggtgttttcatttacctttttgcccacactacctgcactttctgttaagtgatttatagacttcagtaaggcagggtagttttactctaagaatttgcttttgaaaataatgtatggcagtttgttcagaattagaattctggacactttatcttgagtgttaaacagccacagagcaatttggacaatgtgatctttgcacctgtgcctactcactttcttcttaatcttcggctttgtgtgcattctgaaaacatttcctgtaaatcatctccttttcctctgaaagctcctcttttttgttggctggaatcacaagccttttacagggtgtcaaatgtcaatttttaggtaagctggatattgaagaggataatatacatggtcttattgttcatccagggaccaagtagtatgtgtatgaaaaataacattatttttgtctctctttccctaatttctccttgatgccccgatttatttaattgttttaaaaagtaagccatttggattagaaaaatttaataattaattgataattccctggtgagtacactataataaaagctacaggagatatacaagagaagcatgccattttttggaggagctcactgtaaaacctgtgtgttaaggggtatcaacttaaatgtaaagaaaattcaaaggcacaaaacaccacacttaatactggaagcttcaagaacatatgaaaagaaatagtagcatgtataatgggtcttaaacaattaatttcaggattttcactggtgggaatagtaggaaattatatgggcaaatgcttacaaaatacaaggcatgtgcaaaacctaataagtaacagaatttggaacatggcgttcagacacaatttcatgatcacagatgaaaatgaatgggagaataaagaccatattgtagaaatccttaaataccagtctaagaaatagttatttaattttctatgtaataaggaaacactacaagtttttattttgaaaaaaaggttaatatgattatggccacattttaggaaaactattatcatagaattgagtataatgaattgaaacaggcaaatgagaaaagcatagagaccaattaaaaggctagtatactagcatgggcaaaagataattagaaccagaagtaggtaatagtaataagaatggagacaaaggaatgaatgtgagaaaatggtttaatacagctttacagattcggaaactaattagatgtgaggggtgagggtccgggcagaagttgaagacaggtttttaggcaggttacccccaaaaatggtggtgctattaactgaaatggagaaaccaggagagagccgttagagaagaaagataatttatgtttcaaataggttcagattgatagaacatatctgtctgaatggaaatatgcaaatagctgcaggaaatggaaatctgaaaattgcaggagcagatgaaggaagagatatgttaataagtgaattaaagttggataagatttcccaggctaatgttatccaaggcgagtatatagaaagaatgaaagacaggactttatgttgggaaaggagaaaaagaagagccaaggcaggagcagtcagaagagagggaacccaggcggcactgccattgacaccaagggagagaagagcagtgaacagcatcagttgctgctctcacaagggagacccaatgaatatggtggcaattgactattgtaattgagcaaataaatgggcttgccgcctgaagcacatagaagccaataacgttggcactggcttcggagaaaagaaaggctttactgcaaaattgttcagcaaggagacaagagtcaggttcaaatctgtctccctaatttgggatatggggaaggttgcaaggggtcagaaggcaaggcaaaggatttagaaatgctggcttggcagagtctgattggagggcttcaaatttgatcacttacagtaaggtatattgaggcagattttagccctggatcttctgggccaatggacccctcatttctgaaggagttccaatgtccaggttttgattttgtccctgtcttgttggttcaaggggaggaatagttggttcctggtgttgttagaggtcaaaatttttctattgaacatgcctgggctacatgacttgcagcttttggctctgttatacctaaaaggtaacttgacattttgttatcaacagggtaggcccggttttggttggtcctgtagttacactctcagagtcattgatgaattttgaccatcaataatgaaagcagaatttgaatttacagttttaagaaatttcaagaataaaatgatagaatactaccctgattggttagcaggatcaataacagggtgtgttttcatttttgtttcattgttgttttatatgatttgtataatttgagtaaatttttatgcaaaagaccctgaaagaatcaaaatatcaaattaaaatggcaagttcagtggctttcaaactttattgattgcatccactgtaagatacacttttttatatcataagccagaaacacacaaaaacttgtgtgtgtagatatctaaatatatgtattatacaccatgccatttatttaattttgttattttacatttttagaaaaaaaattttagccaaaacctactcaatggatttcatgagtcacttatatcaccatctaaagcttgggacgtattaggctaattaacaaagtgaagacctataaattgtgagaagagaagaattaaaatgtgaagcaaagaaaccagccagggcaaagaaaagaggcacttctccccaagacataaaaacagattctgaggaatagatggaggaggctgagatatctcaatttatgacttcaatctgtgcagtcagtgagaaatatggaggcatgatgagtgattactgactcatttccacggcattagttcaagtcctcattatctcttaccaaaacaaatatggtagaaatttaactcttatgacggagtggcagtgctcacacacccttagaagtttccagtgccttcccaaggaaagatcagactctttgagcattagaaaccctctgtaatctgactacctttccaggctccaagccctcaactccattctatataatgccaagtttggcatttcttgcacttatctagacatcattagcagtctgctcttgctattccctcagacaatccctgtgaaatctaatttatttttaaaggcatttttcaaaccctacctctgccacaaaacctatccatagcacagaatgtattttgtacattttatatacaacgaacacattttactatacagaattatttcaatcattctttcaggagatgaacatttactaagcatatacttcatcccaacactatgaataaaagataaaagatatgtgtcctgtcctgtatgtgtacatatctgtgtctcacacagaattgtaaattctttgaaggtaaacataatgtcttatttctttctttattcaagaaaaagttaatgagggcccaactcaatgctaggcatggctcttcgtactgggaatatataagtgaacaaaacggcctgtgtttcctagccttctggagcttgtattttttataagagagtaagataaagaaatagatatataatgtaatatcaggtaatgacaagtactaccaggagaaataaaggagactcaaggaacttagagtgatgaaggtatgattttagatgaggtggtccatgatcttcacaaacagatgagacttgtgcagaaatgtgaatggtgtgagccatgtgaatacctgcaggaagaacagtcccctcagagaaaaaagtcactgcactggccctgagacagacccatgcttggcagataacaggaggccagggtggttggaacagagtgaatgagaagagggggctaggagatgaagtcagcaaagctctaatgaatatctaactctcctgagggctaaaaatcttccagtggcaagaggtggcttggtacaggataatccagtggtgttattgatggaagcaccagcagcatttgcagataggagataagtggagtgtgagagaggagacacggttgacaccatggtttttggcagagcaaatggaaacatggagtggctgttgactgggatggggaaaattagggaaaggtctggtgtatttttggagggggagaaacttacttttagatctgcgaaggtaggcacaatatttaaatcccttaggactaagtgagatcattcagaggagagaggagaagggaacagaaatcagaaaactgaattgtgaagcacgttaagagatcaaggacatgccatagatccaacaaaggaaactgaaaaggaacaaccaatgaactgggataaaaaccagaaggaaatggtttccaggaagcccatttatctctgcagtgtccataggagatgacacagagagcaagctctgtaaattttaaaaattctgttgaggggagtttggaattagcagccatagggaaatgtaaaagatggtcaccatgagaaaagcacaaggatttctgagtagccctgcagacaaaatgataattgagagaagattagggagttgtgaacagaaagaataaactcaagcttcaagtgagatggaatccctactccctccagaagaccttttatgtgatataaggaaacagtgcaatccaccataatatcataatttgaaaaaaattgtatcaactattcaagaattactacattcctatacagtaaacactttattatttttttattgacatttcattattttactataacgaaatgtaatttaatcatactggctctttagagtttctcttgaaatgtctaaaatctgtttcttagagcccatatatgtataagagtgtgtgtgtgtgttcgcgtatgcgtgcatgtgcgtgagtgtgcatgcacagatgcagtcagtatcaggctttaaatgaatgagctaaaaatttggcagagtgtgtcagttataagtttattttttgtgaaggcaaaaataaatttgttggataatgcgtttgtgagtagtagatcaatttgttcacatattttgcaaaagttagagcttattactcattcatgtactattgatgtaacgcattagaagacagttaacattaggtcctaatggcacctgaccaaaaggagctgtgggcctggcctatacaccttattgcctgttttcagcatcaactgatttagtgaagcagcaaaaagaaaaatggtgtgtgcagcattatctttctgccacagatacatgtttttaatttccaagtttccaatgcatcattcagttttatctaacgggaatgcagctgagagaagtttgtaacaacccaaaactacatgctaatatagtttagttttcaagtcttgtggagtctttttttttttaatggaataagatcatcagaaatccaggagcaagacagactggctgtggtctaccagcattgtagtaaaaacattggggaagttttataagacctaattattagaaaataccataaaatagtcattttcatagaaaaagctttccctttcctcacactgaatcacattactttgtgttcaaggtaaaatgtagtttgaaatctggatgtaaattagaaaagatattattttattccaagtgaaacatgtattcacacttcacgtcttgaagcaccagtggccatttgggctgagttttcaagaaaaaaaatttatatagattttatgccctttttttaacctaagagatattaagtaatagctattccactatcagacaatgtgcataaattctagtcagatttttcttttgattagtgaacaataggacaattttgctggatgtttagtatattcatggctgtcacatcattattaaattccagaatattaacatgctttgtgtgatgcatttttaatccatcataaaccaaacaatatatatttgtttactgttattaatggtttttcattgtgacgtcctagccttaaataagaacttcagcaataattataaagatggcatttattactacctaaaagtatgtcccaataaccttgatcatggataggaatactattttataaaataaatggattaaactttttttgcaatccttttctttctgattcagtttcagcccctcttgtgtcgcagaaggacttgacgactaccgctgcacggcttgtccacggggatatgaaggccagtactgtgaaaggtaccaacagccatgaaacgtacagagtaatgatatgtagggactatatggtaaagggtcacaataggaaaacattcattatttgaagaacttcaatatttgcatatcctttagaagtttaaattacaatgctttcaaaaccacttgtgtatcttagaatttgtccaaagaaagttgtttatttccaccgtatgtttagactttatcaaagattccaaactatttacaattatctaacttatgctttagtatatatatatatataattttatatgtaaatataacatttcataagaataaatcaattttcaaaagcttagcagtagttactactaataagaaactggctacacttttcttattttaatgcactggaaaatattgtctggaagtaactgaattcacgtcattgttctgaacactatgactacaccagcaagtgtatacataactcaaaatataaatagtatcaagaatttttaattagtacccagacaataaagtatttgttattcagttttccttttcaataggcaaacaatattatttaaatgttttctcttaccatattgcttatgaaatctcataatgcatgtatacagctgttaaattgaattctcagtgtaatccaaatggtaaattaaggagtacagttccaaactgattgtctagaaaagttgcaattaatatcttccagatatatattttctgtaagatcagtatcctggatattcaaacttgtcaccaccacttttggtatattttagatattatctttaatgtaacagagagttactaatgttaactactaacattatacacacatgatagttttagcataattgatagcagtataaaagttttagaaagatccatagacttcgctcaattccaacagttcagctacattccattttcctcatctataatctcaggaatcattgataggccacctactttacactaatattgtgacaataagtgtgtaaaggacactgttggtgccctgcctaggcacctacactgaagccttctctccaacagaagaggcagaaaggcctgaatgtttacccgcccttcctgcagtggcccatgactaaccagcgtgagagtacaaaagtccagctctttggcccctaagtggaacaagttttgagatcttattttatgctccagagcactccatggaatcaggctaagactgggacatcacctgaaatcatacccttgattagagcttttcttttccatgtcctgcttcacccactcctttgctagattctcctaggaacacttaaatggtaagcttctttgtaaatataaactaatactaattatcagcatccacttaagagtcttgttttatataaccagcaacagctgtattaatcatggcaataagtaactaaataattagggttaagctttataaatcccaatgcaatttttatacatttgtaaaatatatttctaaataaatccgtatgtggtaactctaaacacagtatccaatatttgcatatatataaaacagtggattcacaatttccataccaacagaaattagcagcaattaaataactcatagcaacaccaaatctaaaaatatttccatttgttctgaagatatatacatcttttggatatagatataggtgatacaagtacatacttgttaatacccaccagtgagctttggtattcatggttagactaatatttatttcctgtacctttaaacaccagtaggatggtgactaaaagcatcgctggacaccaaaaagattatctacagtaattcatgaaaaaaaaattatgatatagctacatttatacactgtagttaccattttctacaaaagcatgtgtatagaataggctagaagggtacactaaaataacaattattgtgttaaagcagaatgattacagaaaatttatttgttaatatccagtagtatttaatcgataaaagctgtcagtttgtgtagcatagagatgagcagggccatacagtatcaaatgtgagtgacttaaagtgtttttccagtcctcaaacattgttatagctttgcattcatcatctctaacatataaatgatcaggttatatttctctgaaaaattgctttattcagctatattaaaccaaagttcttggttaaatttttattgtaaccttccaaataaatttgttccagtgctgagagcttcttaaatcatttaaatcatctttcgacctgctcagactgatcaggttaggtctaaaactgcttaaatttcttgagtatccctgtaatatagaaacctctcctcatactttattttcaatactcttgtaataaactctttgaacatttaatcaatctgaatctgcttagaatacaattattttacctataaatgttaagaagccatttaagtggacttacttaaatgctactttcagtatttgtactctttcattgaaaaaaataatcaaaaacatgaatgtataaaagcctaatgtcacaaatcgttttcttcatgttttgccttttctaaccagcacagggtgaattaactttcacagtcagccatgcagatttcacagtctcaggcagctaaagatggtctatgattatcttgccagtatttatagcttttggctccaatcccctactgtctctcaacttcctcacatacttgcctgttgaacaaaaattctaactgtttgttatatttacactgaccatatataaaacttgttgtccaatctgggacactatattaaaaacaggcagtgtttttagcaattaagccaaaacaacaggtaataggaaattgtcctgggcaaaccagaatgtatggccctgctagcattgtgtaaagttaccaaacttccagtgtcataacacggagtgaaatacacttaggtgaatggatgcatagatacgtggaagagtcaattaatggactgcatttagggttcatccagttggattctctttctacttttccaaatcagtgttatatattttgtttgcatatcattaacccacttccacagatacacatgaaaaatccatcttgaggaagatatggcaaaaagaaaagatgaataaaagtaaacagaaaatctgagtagcctattgccacttaacttgcctcttttgcctcattggtaaaattaatgggttgtattatttggttattttgagatctgaaattcatgagtatagggaagcccagaagtcaatatagaattgcactcatctctaattatacaagaggacttaacaaaaaagtttatgatctagagcagtcacagacaaactatgacccacaggccaaatttggcccatttctgattctgtatggcactcaattaagaactgttgttacaggtcagcatttacaatcaatttgatgacaggaggcactaagttataacccaaatgaaggataatttcaaacctcaggaagaatccaattcttctcattagtagcctgatattacaaagtaatttaacattattattattattattattaatgttttcaattccatcaacaacagcagaatgctttagaattttatttctttttcacggcataatcttgatttttcctatgtcctgcaaagcctactgtttactatctgaccctttacaggaaaagttaactaatgtatggactcttgctatcagttttgttgcatcaaaacaaaagaccacacacaacaatgtggagacatgacttgctattaacctcttttgctttgtcactgtttcaattcaggtgtgcccctggctatactggcagtccaggcaaccctggaggctcctgccaagaatgtgagtgtgatccctatggctcactgcctgtgccctgtgaccctgtcacaggattctgcacgtgccgacctggagccacgggaaggaagtgtgacggctgcaagcactggcatgcacgcgagggctgggagtgtgtttgtacgtatactaactttgctgttagttttggaggccttgattccagttctgtctcatttccaatgagaaagagtgactctccccgcccgcctttttttttttttttgcaatagttatactcttcattctttctgacactatctatccaccttctgctgttcacctgctgattgcgtgtccatcctgctgagccaagaacagctgagaaaatcctcagtgtgctttagtcagttcattgaaagacctacaatgaagctcctggaggcattttatttgatttgtccatctcagggtttacagttttgcctcaagttggcattgcctttgtgacagattaaagatgtgagtgtattaaaaaatttagaatcctcctgaatttgtaatcgactggacagatactttaagccttgaatgacaactgatgtttcttttcccagcttttatgaaaatccatgggcatactgcttcataattttctcttgaactacaaaacccgtaagcagtaacaatgaagtcaagtatttttactcacgtacagtaagtggagagcagtttgctctcttgctgtctctcttttttcttactgattctggattcgctagtgccatattgaaagtacattgaaatcagtagctaaatataattcttggatcttgcatacattcaaatccaaaataggttatttataaatttaaggaaggagtgctcttctatagtattcttttcctcaaggaaatttattttagcaccttttatttcaacatttacctattgtaatagtatttgtgcatgtcaacatttcttgttttagcatattgtttgagtctaaatcttaatagtatcttaaatagaagaatttttgtttatgttctagttttataagagttaacctcagaagctaaagctggattaaaaaatacaccaaaaagttaagactgggtgttatttgggaaaatagattttaaaatcattttttctttgtattttaaccatctttaatgaaaatgtattacactgaaaataaatgtgaaggtaggtgagaggggagagattaaatgtactgtcaaatacatttatattgtcatatttagttgatagtatatacacactaattcttcccaagtataatgatatattttaatgataattaaagaagtagactatcaaagtattttataatattgctttcaagtcaaataaattattaacatgcacataattaactagataatatatagatattcttaatgtaaacagtccttgaattattaatcatcacttttattaactatccagaagcaaacttgaaataaaaagatcatattaatgttaagcacaaaaattaaacaatagtacattaaaatctggggtagataatataatgggattatttggggaacatttcttttaaagagaattggcattctgcccatcaacaacaatggctttttcatttattgttgatgatcaatacttttttaacattttgaatacatttatcattagaaatcgtaattcatcttttccctatcacatatgtgggtttctaatctccacttgtcccatgtgatattaagaaaagggccaatcctccagttacaaagctacaccagttttataattcttatttgctttattcttgccccacaaggaaatgtatttacaggggttatacatggtatttagttcagttgctggactggaagtgtttatattctttttaaaagaatagcagtttttattccagaaaaaaatattaaattataggattgtttttgatatctagactcttttgctaaagcacagttaattatcttataattatgctgtatagattttccatatactgctcttaagcattagtgatttccacttacttctaggaatgttttctcttcacctttcactaaactaactctaagaattgttacacagagtatctttagacttttcatcttttctcttcttctaaaatttctcccgttatggaaaaatatgccatgattctatgatcttggcctttcccaggattcggtttctacttctactcctagttttgaaatcagataaaataagacacaagtgaggatgtaattctgacttattctcaattttccttttaatatatttctgtatccttaagctaaattagtgcaagagaccaaaaaatggattcacctggggtgtttgatctgcaggacctgttttagcacatgtaatcatggtggaattgcataaggcctgggggtgagagtaagggaggtagcttggctctagcaagagaatttagatgtagtaagagaaatgtctgcagtgcttgttgttagtatagtactgactacaggaaataaactttctcctattgcttagaataagtaaacactcagtttagtagcatgtattgtacaagagttaattttgcttcctttagttacttccctgggaaatataatttagactgatccacatcatggatttgtgtatttcaaaaacagaaaagaaaagaaagagagacagaaatgcatgataaatgacctaagcctgatcattgtgtgatctcaggtaatttgcatattggtgaaaggaatctatacactcactgtaaatttagtttaggctcttatttctcaaagtatataaaattctgctgaagagatcaggcaaaacaaagccaatgcaggaactgtgaaaggacttcccttggacaccttggtccctaaaagatacttatagcttccagggacagttgccagtgacccctggattttactggatccaaaatggaattttttgcagcacacaggccttttatatgtggattttcactactatcatgaagaatgtatacaaataatctgtgtccacgttaggaacctatttagacatcacagtctctcatagttagtgacctaaattcagccccaccatgcagagtcagttcctgagcataactaagcaatttattcaccttcaaattccaggcattctctaaagtcccttttaccacacagggttcatcataatagtaattttatttaaaggctcaccttgactgagaacttaccatttgccaggcactatattaagcattttacacgtggttctttcattcttgtaacattcccattccttatcatccccactgtgtgataagagaactgaatttaggtaggttaagtcattttctcagtgacttttcagtagatccgtgatttgagcatgggtcagtcttacaaatcttattttcttaacctctatgctggctactgataaacagagaaagcaaacgtggtttagccagtatattcaacattaatgaattcagccctttattcatttactgcttccatgtttagagcccattctacctcgattaaaaataaatataaaacgagctaaaattacaaaatgagaaattttaagtgtatgtaatctcagtaatgacatttattttctgctaatcattgagactcctctaagatttaaaacattatggcatttatggtagattccttttcatcagagattgtcaagtagagactgtcttctatgcagaagaaaagatactagctgggtgcccagattaacttcacagcctctttttttctaaaaggaattatttgggacagctttacaatgttatgtaagttggtgagttctgaagagatattttattaatttcccaaattaagatttcttcttgataagttaatacaaatccatcctcctctttcaactgtcattcatagttcacatgtcattttataaaatgagaacaactaacctgccttcaagaaacttaaaaatgaacaaagaagccattatttgcttaacagtaaagtttagtattttgaaacacaaaacttggatttgttcatatcctattttctgtaaactcatatcattaacacagaataacccatgtgatgtttaaaatagattatgagtggcatagtaaaatgtattactctcctagagaacagaaattaaaattagtatctgttggcaagatattacttcataaaaattgcctgaaatagcattttataaatatcaaattggtgttgcctatttttaatcactgcatagtggggtttttgggatatatcagcttttattatttatagtcacaatttacttaaattctaacatatatttatttaaaataaaacatacactttgcttgccaatttgcaaaagtgatcatgaactatgttttctacttgcaacctgagataagcctagctaaatgtggtaattttccttaactctgtaaaattggcaacttccaaccacttggtgaaaccggaagtctgaagttttatcctatcttgatctacagagatataatcaacattgtcgtttttaatagccagttgccaccaaagatctgatcacaataatgcagagacctttatatattatcactagaacactgttgtacatttataatcaaaaatgattaataatggcagtgattgccccctatatatgggagcagaaacaaaatagaatgtggttatcactgtaatgaaaacaggacttactattctgaaaaatgatgataaacatcagttgatctccagatgctgattactgatctaacactttgcttgttgtaccccctaaatgtcatcctctctctgctcgtactcactgctcaagtaagttcttatttgaaaggacagtaagtatgtcatagttttctgtagtctaagctgtgtcatgttgttcacatccaggtgttaggcaatctataaaacatcttctgttcaccttgtttgcaccttctactcatttgttttgttagtaaaagatatttgagtttcttgttgtcaaccttagcattggtccaggctaacaatgtgtggaatggcaactatcaccgtgattctagatgattttcctagttgttagagatcagtctcagtggtttgtatattattgaggaagctgttctgctagctgattaaggagttgcacagttgaattatcgtatagagacagctgatcactgttgcctttgttttcagcaagttttatttgaagagtaaactaaactctactttgattgcaatttctactctggcaaggctcaggaggttttattgaccttgaaagacaaactaaaatcacataatcttaaagttggaagaaataagtaaactagcctagccttctctttttctgtgacatccacaaaacagacagcatcctaatgcaaggaagcatggtgttatgaagtggctacagaaggtttgaaacctagcttgcaatttgtgtgacattatttaatttcctaaacctcattttcatcctctgtaaaatggatgtaaaatgctacatacatgtatgtgaagtatctaagcataataggtgctcaataaattctaggcattgttatcatcattgttattatgtgaccatttttttccccaaagacctgatgttttgtgcaacgcatcagtttctgatgaaatattttctttagtttaggctgactttcagtttcctgttactatctctaattctaggttcttcaagtcactgaaaaccacttttatggccaccttacatttctcctgtctttaagcccttcacatgcattatttatagattcataaacactctggttgtgactatttttctcatctgtaaaatgaggatatgaatggtacttacctcatagaattgctttaaatattaagtgagataatgatggcaaagtataatacattgccagtcatgtagtgactgttgtgtagataaaaactattatcccattattatttatagtactttcaaagtttccattagtgttttgaagagttacaccatctttgaaccacattgaacttgttttcccatgtattatatatagaattttatttaatatatataaaacacatatatcaatatttaatatataaaaatatataaaatatatacatataaaacacatatcataaaacatatatataaaacataaatatcgttacttggtatgtcgacaaattcatcagtctcagctgaggtctacagctttcctctctattcaaagaaatgacaggttaaaaggtcttcttaatgactctggaatcaaatttttatttgagaagatatttattttaaaatagaatgactaaatacatcttaataagccctaaatatatgctaatgtaaaagtttctttttgaaggggaaaaagggaagtgagaaatagaaaattcagatccagggaaccgtcaatggcattcatctaggagagttaatttaacatacacacattaacacataattttatcttttgttaaaaatgtgtatttactcattttattcctatttgattagagcagagaatttatgtatcgctacctaaaattggttaatagctttcgccctttcaaaaatactcagtgtcctcattttagcttcagcttctttggtttggatgcagtgtgtgattttttttgtgacagtaagccagtagttattatgcatggggaatcctggtagaaatgcagtattttgtgctaattgctaacagaaagatctgtaatactggctgcatgatttgccccttacatgtgcccagccataacaatctgaatttagtactgtgtttgttaatattagacacaaatttatcctgacacttttataggcaaagcctcggaaacatttagtcatgtaaaatataatcatggtcttgaaatatttgcttttgctcctgtgcattttaggcaggatttcactttgtaaccttattagtattgctgaatttggagaatggtttggaaaggttctttgaggtcctgattgtaagataggtgttcatttacactgagccattactgcactttatcaaagaacagttgtttacagaatgtgaatattccatgtctctacacactcttcagattttccctatgatagtaaattacatttggttttaatttgcattccatttccaatgtttgttgccagacactttggactttttgagggcaaataaaagtagcttctggtgtaagtgaaatattttgtgtcagaataaaatagcaaaccattatgtaaagggcactttccccatgtgtttaccttataacttcatgagctagacttgtacagaagctttgaaaaaatccccatggctgtcatattcataagtctctctgacccattcagacagatgttagtatattgcttggagcgtactataaaacttacctttcacttatggaaatgtgcttgtactttgttccccaaaaagcaaatacagataccataagacatgggataataataaacctttggacacagaaacataaaatggaatgtatgagcccttgaaagagcaattaaatacattttcatttcaacagctgaagatgaggaaccaaaacagatgggcaggggatagaataaatgagagaaaaatcagtattcatcatgcctcttggcattctagtacaccgtagcatattacagtacatcagctctagttctgcattctggtccctgatttattcttgtatgaagtaaaaactgagaaaacgataggtactttccttggaaatttctggaaccatctagtaaggagtatctagccatcctgttatcaacaaactgattcaattccttcttggaaataggtaggttatatattattaaataaattaaagaataatttaatgtttgctatcaaaggcacacactgccctaaaaagcatggtgaaacatcctattatcattaccaagtatctttaaagatcttggaggtgaaaaaagagcaaattgcttgcttgcatcctaggaacatctgcccaaaatacatcttcactagaggtcaaatggaacttttaaaacaatgatgaacttgggctcagtgagagaagaaccttcctattcttcataattcctaataaaattataattgttactactgctgtttttaacctatgaattgcagcttgaaagtctctgatctgaatcacatgtgcaaaacttgaaaaagtgtgtcagttatcgattgtatcagttatacattccaaagtttagtagcttaaaacaacaagtgcatacactctcatgattctgtaggttggcaatttgggctgagctcagttggacagatcttccactgtcacgcctaggggctcccagatggcctcaagcccaaattggggcctcaactgccctttcctctctcacgttgcctcccttcctcaaggaggctaacctgggattgttctgaaggcagcaggggtccaagagtgtgaaagcagaaagtgcaaatttcaatatgttgctctgccacattctgttggtcagagtatgttgcaaagctaacccagattcaaggggaagggaagtagacttcacatcttaatgtgaggtgtggcaaagaagtattaacagtaacctttttttttttttttttttgagatggagtctcactctgtttcccaggctgaagtgcagtggcatgatctaggctcactgcagcctctacctcctgggttcaagtgatactcctccctcagcctcccgagtagcgggactagaggcacatgccaccacacctggctaatttttgtatttttagtagagatggggtttcaccatgttggccaggctggtctcaaacttctcacctcaagtgatctgcccatctcaagcctcccatactgcttggattacaggcctgagccaccacacccagccagtagtaaccatttttaattgtccccagaaatgatcatcgctttgatctgtcagtcatggtgttctttcctcctaaagttttgtgctgattttcttcccgtccatctctccctttcctgagtcaaaactgaaatccttcaggcaggtatctgaatagtcattcttgttgatcggacagtctctgcctctgcaatcacaagatagttctctttctgtctctaaaccattgtttttaatgtattctcctgttcctcacacatctgtgaggttttctatcttgttctcacattcagaagttttcttccggccaaccccaacctcttccctcttcccctcttcccctctctcttctctcctaacattctacctccctgatcttctcactatttcatgtacttgggcacatgccatgctcaaacattaacccttgccattctctttgtccaaagtgttttgatacccttctctcacaaaaatattagcccacaaatatttactgaatattaactgtgtacaagaccctttcctaggcaccataaccaaggtgtttaaggtcccttctttaacgaggaagaaagaatatataaataaattaagtaataatgtagcccaaacaggcataagtgttaagaaagcaaaggaaatgcagtagtgactggcgcagggtatagggctgggggtggtggggagtttcaggtaacagtaattttagaatcatcagggacttgctctctgaaaaagtgacacttgagcacttgacctgaacacctaggaaccaggtgggagaagaccaagggagaagaattctaggtagagaagacagcaagcaaaaggacctcttccaaatccttgctcccttgaagattgagcatccctataatttatcacctggtccagtggttttatcctttggctacatggtttttcaattactggaatatttttaaaatacagtggttcacgcctatgatcccagcacttggggaagctgaggtgggaggatcacttgaggccaggagtctgacatcagccagggcaacacagcaagaccccatctctatgttaaaaaactagctggatgtggtggcatgtgcctgtagtctcaaccactcgggaggctgaggcaggaggatcactttagcccaggagtttgaggccgcagtgagtcatgatcacaccactgtactccagcatgggtggcagagcaagaccctgtctcagaaaaaaataaaaatagaaatactgatggttagaccttaccacagacccatcaaaaatcatattctgtggtggtgaggagggaaagagcccaggcatctgtattttataaatgttcatgtgattccaatgggcagccaaaggtgagaaccactgatccacaccaatgttgtcacattctaatgtgcagagataatgtgggacgcagattctgatttcctagatctggggtagagcccgattatacatttctaataagcttccaggtggtgccaaaactgttggtctgattgctactcaaagtgtggtgcacagaccaacagtagcaatatcacctgggagcttgttagaaaagcacattctcagtcagagactaagagaaaccaggtgatcaaatcacctcctgattcagaaatactagggggtgtggaccagccctctaggatttccgaaagtcctactggtggttctgaggcccactaaagcttgagaaccagactgtggatcttggtgtttagacacagtcaatttggcacttaactgagttctatgttgtgttttctctaattgtttaatgtggacaagtctgttgaagtttgcattgaacggggctatgaagccaaaataatcttttacttggtttccatgcagtgcaaatttggtttcattctggctaggagaagagtaagagatatagccctagttccagacttctgctctggcctccaaagcctctttgttcattcagcttgtgaagcatcaggagcttgcaaagcccctgcaggtgacgctctacagttgtcacctgcaagaagctgcaggtgtcacctgcaagaagctgatttattaaaagccctgccagggcagtttaatccctgtgaagtgatattgtaactcacctctagctgctgtcctatcaaaaaatcactctccgtcctccttctctttgtttacaagcaccagttaatggttttctctccattaagcagctcaggggactgctgtttagagacctaattgaattcttgccaagtttgggcatgatccagagctgctccaattctcggtattttccatgctatgtattttcccctattctaacatgtatatagcattgatacctctatctgcagaatgtaagaaattgtaactgtatacatgagagtatattataaatgcagtagttcctgctccttggcgtgcagatacacctcattactctgcaatgcaaaactaaaaatatacatgttttttaaatctgctaaaagattcaatatatgttaattttggaaattatacgactatttatgagatctattccataatgaagagtcaacaatccatttgtctctctaccaattctaccacctatcctggcccctaccaccaaatttgaatagcacctctttgatggccaaaaatattatggtgagtgtattagtccattttcgtattgctataaagaaatgcctgaagctcggcaatttgtaaagaaaagaggtataattggctcatggttccatcaggctgtacaggaagcatggctggggtggcctcagggaactttcactcatggcagaaggcaaagctggagcaggcatcttcacacaggcagagcaggaggaagtgggggctggaggtggcacacacttttaaataaccaggtcttatgagaactctgtcatgagaacatcactagggcggtggtgctaagccattaaaaccactccagtgattcaatacctcccacgaggccccatatccagtattggggatgacatttcaatatgagatttggatggggacacagatccaaaccatatctggtagaatattagcattcttggctacttaaagaatatagtttttctagcctttagcaattatttatctataagactgaaagaggttaatcatcaaagtagggatttgtgagactgcatctaatcatgggtggtaatagactgaagggataaagaggaacagttggcaaataaataagtcaataaatattatcataagaaaacactatagaaagaaaagttatttttattttgactttttattttattttttggggggtggagtctcagtctgtcgcccaggctggagtgcagtggtgcaatcttggctcactgcaacctccgcctcccagtttcaagtgattctcctgcctcagccttctgggtagctgagactacaggggcccgccaccacgcctggctaatttttgtatttttagtagagacagggtttcaccatgttggtcaggctggtcttgaactcctgacctcaggtgatccacccacctcggcctctcaaagtgttgggattacaggcatgagccaccacacccggccttctttagactttttttttttttaattattctactcaatagataccaagctaaaaatttatatactttttgaatgtgtaatacataaagcatgtggaggtcaaattactatgactttctccagtgcaatctaatggagcaccacacatttagactctggagcatgttttattccctgtggacaggttcctttcgattgctcatgtagggatttagggggtacttttaatgttatattctatgccttaaaggaaatcttcaatacttgtgcaatacactttttctccccaaatctatttgctcctcctctttggtccctcagtttatattatcgcctctatttcaggttctgggcgacatgcatatctgttcttttgttgttgttcttatctttcctcaaccatcatccatttgatagcattaatattctgagatgagtagtttcatcttccatggaattattcttggaccataaaatatttcatagctgaattctttgaacatctgcctgggatgtttagcagaagtaactactctttgtcacttctctttcacagtttgtggagatgagtgcactggccttcttctcggtgacttggctcgcctggagcagatggtcatgagcatcaacctcactggtccgctgcctgcgccatataaaatgctgtatggtcttgaaaatatgactcaggagctaaaggtaggttggtgcagtcacaagcaagggccagggacaaggtgacagaagcttcacaagcggtattggctgtaattggtaaatgttcttcccacagccccaaatcaagggacacaactgttagggaaattcagagactttcttaaccagtgtttttcaaactcaagaactataatatacagatttctattaagggaaaagagtctcatgtaccccccagtgtctggcctaaatcagttttattatgtcacttaaatatgtgcaaacataaaatcaggtataaactctttatacttatagctctataaaattaaaacaaattaatccttacaaaaccaataaaattcaaattaaaaacattaatataaagtaacatgattttggctgaatggaaattgctgcttgcaacaagaataggatattgactattttcacacagttcttccaccagagatgatgtggtaactcatttctcctaccttaccacatttgaaccagagagccccctacaaagggtcctgaaatgaatgtgagcatcacttgacaagtttatgtgactaacgtgctcagtctgccataggctcaaacacacaggcaaatgtaggcactgagatcaggtggccatattcatctctcaggtgcctagcctgggatccagaaatgcttacattaatatttaaggttatcatcaaaatgaaaacacatgattagaatcttgtactaaagagctagaactagtagacctttaaaagttcttcaacaagcaccagtttgataaacactgttctaaattgtggttaaagcttttggtagttaacgaggtaggagaaaacattaaagaaattggggttgtttcacctgatggaaaaagatgaaaggtgtcaacttactatcagtcaattatcagatatttattaagaaattatagaatacctcagcattgcacttggttccctggggatttcatgactcttttaatatcttcactacccttaggaaatgtagattctatgtgctttaaaaataatcattaaacaataatcaagcaattagcaagaatacataatgaccatgtgttttacaaacattcaaagtacattagcgcacagagactggagaaatcagtaagattcagggtaaccagagaatgtaccattactgagagtataatttctgttggaatttgaagtgtagacacaattttagtagagaagtatttgttgctttagaggaaggcatctaagatttattcactacacattggtagatattcttttaggaaatatattctttaattctgaccataacctttaaggtaagtattattatccctattttccagaagaagaaaccaataatgatgataacaagaataactaacatttattgaaaagctaggcaattgactgaagtcttaaatggattaccatacatagcttttacagaaactccaagaaataggaaagaagttgtcatggtctgaatatttacatctccccaaatttatatgttgaaagtctgtcacagtccattggagctgctgtgacaaataccataaactgattagcttataaacaatagaaatatatctctcacagttctgaggctgggaagcccaagatcaaggtaccagcaatgttcaatgtctagtgaaggcctgttcctcacagagggtgacttcttgctatgaccccacatttaattcatttaatatctggatactgaggaaaaggatagctagctctctggggtctctttaataagggcactaatcccaatcatgaaggctacattctcatgactcaatcacttcccaaaggctccacctcctaatatcatcacattgggaactaggatgtcaacacatggatattagaaggacacaaacattctgccttctgccgtgtgaggacacagggagaaggcagctgtgcttaacagagccatgtgagcagaggcagtggtgtgaattagatctgtctggcagatattaaaagtcagacctgctagtgaaagataaggctggagacttcagtgaggcagggtgatatgatggacaaccttgaaagccaggcagaggaacctgagtttaccttgtggtcctggtattcagggaagtgaagagttttaatgaaaagaatgccgatcagttattttccttgtatatggagagaatacagaaaaataaattaaactagaaaagcaaacattttagttgaacatgaaacattttaaaactaatacttaagcaatggatgatgaagtaaagaggatcctatagaagaggctccaatttgtgaacatcttctaagccaagggattcagtgacccatccacttctggctggatattgatccagatgacctggattatccttaaattctagtctttcttgattttttattttgttcttcttccatcattcacttgacatttgtatactgaggatcaccttctggtattataaaaacttaagttatttcacctctttgctcaatttctttaactatgtcagtgctccccaagcttcagccaaagaccatcaaggacacacatgtgatggaacaaagtgggatttattaacttgttgcaacaaggggcactgaacaccatgggggaattgtgggctgtctcaataagaaggtgttaggaataacttctagtatttgaggctgtgctagataacttaaggttagcactcaactgggtgctattcagaagtgggagtaattctgtgagtattttgtgaatcctatctagagggaaggaagaacagagggaggataaagctatgattaataaggaggcagtgttcattcatattagccaggaaatgggaggttggggtagttttgtggtctacacaaaacccgctatggttttgtctgcgcttagacattacagggtagtctctttttttctgtttcattcatcactggttcagagtgaccttgtctaatttagtgtcctatgagattatttatgttccataggaaaaaaatatggccctgctgttaggccagttcctagcaacaccgaggacaggccagttagttagcgcctagccaggtctctatgttaaggcctgccgttctcttttttacctgtgatctgtgtctctgttaattggaatgggagccttaaatgggccaggcaaggagtttatcttaactctaccccttactgactgtgtgatctcgtgcacatttttaactgtcttcaagacagtttgctctttcatgaaatggaataatgcttaccccccatagagctgttgtgaaaattaaatgaaaaaacaaaacataaaaagcctggcacatagtaatttctcaataagtcactgcaatttttattatttgcctgaatatttggcatgacactcaatgtgtaagtgcccagttgaaatagtttccttatcttttctttgaaggtgagaaggctaagttccttttatatacaaaaatgtgttctgtcgaacactatcactgcaaggccatttactaaaaatgtttatgggatggaatctttttcagcacttgctgtcacctcagcgggccccagagaggcttattcagctggcagagggcaatctgaatacactcgtgaccgaaatgaacgagctgctgaccagggtaaggtggcaaaattatgaatcttctgaaagcagatagattatgtcaatgaaggaaaattacttcaaagttctgaaatgcaaatcaccttcttcctaattcccaatttggtatataaaatagatgtattctgacttgctaattctgcttcaaatcaaatcatagaaatcagtagcacgcagaaaaattggggatacctggaaattgtcaatggctaaaaagtccagaatgacagtgtattttgagaactttattcagtagcctccgtggtaaagtttgtatctgttctgatttccaaaagcactatctttgattgtgtaaagagaaagaaaaacaaatgaaaatgcttgtggtctctttcatctcatcgtgggatttttgcattagtatagaaatacagtgtaaatcagtctttccacacaaaagaggaaatcttctctattgtgagactccaaagtgcttaagacactttttaaagtcagaatgtaaagtccatgttgcatttatcaggctttttaaagaattggaaattttaaattttcaaaactgcgatggtattaaaaactttttgcagttagagaatgaagaaaacaacataaagcccgccatcttgtggccagaaatatgcatgaagctagaaacggggctgcaaagtacggatttaatttgattatctaagagctttaaatgataaagagtattggagctagaaggttcctggggattatcgagtccactttgtattttaaagaagagctgcctcgggccatgacagtgaaacgaattaacaatggccatacaatttgctaaactcagggacttaagctggacccagtctcaagattcccactggcccagtactttttctacatagcctgctgtcggtttaggaaaatatccacaggaaaatcaaataggcttctgagcacataatgctaaacaacggccctgatgttacaatagcatactaaacactttttcagaatctcatagcaacaatatagaatgtacagatacaacacggagtttcttgccaaatgtatgtagacattagattaaattgagtgcatttatctcatattaatttaatatgaaataattcatatttgttataaataagaattttctaacaggtcatggtagaataaatcaatttaacaagcacacataaatgttcataacatacaaagcctaagttacgtgttggcagatgaaaaatatgaatgaggctcaatctgtcttcaaagaactttgagatgtgtgtgtgtgtgtgtgtgtgtgtgtgtgtgtacatcagcatttaagtgtatggaggaccatattagacaactgcatgcaggtatataataaaacatgaaataaaataaagtcggaagaaattctggagaaatatttaataatagaataatttcatctgcttaggggtaattagaaaaaatttcatgtaataaatggcatttcattcattcattcacttaactaatactttttgggagtctctcatgttctaggaattatgacactggggatagaagtgtgagcaaaactgcgcagtccttgccctcattggcttagtatagtctaatgatctgacgttagagacacaaaaagtatttctttttttttttttttttgagacagagtcttgctctgtcgccgaggctggagtgcagtggtgcgatcttggctcactgcaacctccgcctcccgggttcaagtgattttcctgcctcagcctcccaagtagctgggattacaggtgtgtgccaccacacctggctaattttttttgtatttttagtagagacgggtttcaccatgttcgtcaggctggtcttgaactcctgaccttgtgattcgcctgccttggcctcccaaaatgctgggattacaggcatgagccaccgcacctggccacaagaagtatttcattaagagtgtcagatctttattatgtctcaacctatactctttaccctttccagcagattgtctcatgctatgttttttaaacagactttattttttagaacagcttaaagttcaaagaaaaattgagtgtaaagttcagagtgttctcatatctactccctgcccccacaaccttccccaccagaatggtacatttattatagtcgataaacctaagttgacacctcctcatcacccaaagtccatagtttacattagggttccctcttggtattgtacattctatgggtttggaaaaatgcattatgacatgtgtccaccgttgttgtaaaatatagaaaagttttactgcccgaaaactcctctatgcttcacctattcatacctccctcttccttgacccctggcaaccactcatatttttactacatccatagttttgccttttttggaatatatagctggaatcatacagtgtggtactttttcatattagcttctttcccttggtaatatacacttaaggtttctccatattttttcatgactttatagctcatttctttgtagtgttgaataatatttcattgtttagacatatcactgtttacttattcattcccctactgaaggacatcttggttgcttccaaattttggcagcatgaatcaagttgctgtaaacatctttgtgcagacttttgtgtggacttaagttttcaacctatttgggtgaatataaaggagcatgattgctggatggtatggtaagagtatatttagttttgaaagaaattaccaaaatgtattccaaatggtcttttctattttgcattcccaccggcaataaatgagagtttctgttgctccacatcctcaatagcatttggtgtttttagtgtttggattttgtcattctaataagtgtgtatggtatctcattcttgttttagtttgcaattccttaatgacatatgatgtcgagcatcttttcatatgcttatttgccatctgtatatcttctttggtaaggtgtctatttaggtctttttccattttttcattgggttgttttcttgtcgaattcagagttttttgtatattttgggtaatagtcctttatcagatatgtcttttgccattatttgcttcccctctgtggcttgtcttgttctcttgagaagtgtctttcacagagcagaagtttttaattgtaacgaagcccagcttatcaattaggtttctccttgttgagcctttggtgttgtatctaaagactcattgccatatccacggtcatctagattttctcctatgctatcttctaggagcgttacagttttgcattttacacttaggtctataatccatttttagttaattccaatactattttaaaataaactttttactttacagtagttttagatttcaaaaaacttgcaaagagagtaccaagagccttcacatactccattcccagtctccccattgttaacatcttacattagcatggtacatgtgtcatatacatgttatatacatgtgtcatatacatattagctcatatacatgagctaataatattgaaatattaccattaacccaagactgtattcatattttttcagtgtttactgaatgtttttttactgtttcaggatcccatgcaggatactacattacatttagccattgtgtcttcttagggttcctctagactgtgacgacactgtcaaaaatactgtaacagtgtttctgatgactttgagagtttggacaggttcatgtgtttggtaagctgtccctcaattggggtttgcctcatatctttctcatgattagaatggaattatgagtttttgtgggaaaaacttcagaggtaaagtaccattttcatcacatcaagaacccatgtgaccaatatgacttattactgtggatattgaccctgatcacctgactaacatagtgtttgccagatttttccactgtaaagttactcttttatgcccttttcatactctaatactatttttatctgcccattcttcagattcagtaacataaaaggcgcagaaataggactactgaaagcaaagatcactttgatgggttgagaagggggaggaaatgtaaatactcattaattacttttttcctaccatatttataattacaaatatatcttccatgcagaccataaatactcaagtcaacatgaccaattctctctttccctgtggtcaagctgcatgacaatcaaaaggtgaattaatacagatggaattataattagagagttagatggtttcattatccaaaatcaggctaagcacgctaatgcctctatctcagagtcatgaatgatcctgcagttgtgaccagggtatgagaaatgcagtggccacaacttccaattacccatgactacattagaggagacagtgctctagactaggactgcacattggaattaccaggagccctatctcacacccataggttgtgatgcagttggtctggggtagagtcagaccactgggatattcaagaactccccagattatactgataaagaattactgtgatcctgtagttacctaatagctaagactctcttccctctggaaaatgccttaattggtactgccaatcttttttttttttttttaaacagagtttcacccttgttgtccaggctggagtacaatggtgtgaactcagctcactgcaacctccacctcctaggttcaagcaattctcctgcttcagcctcccaagtagctgggattgcaggcacctgctaccatgcccagctaatttttttttttttttttttaagtagagacagggtttcatcatgttggccaggctggtctcgaacccctgacctcgggtgatccacccgcctcagcctcccaaagtgctgggattacaggcgtgagccaccatgcccagcactactgccaatctttgttatgctcctttttctctgcttggttggctcaccagtcacttgatacagtctttagatttaagagcacatgtcaaggttgatcctgcatgactgctgtaggagctaccctctcttctttaagggcttttatattttatactcattgtttttaaatggagaaatctaattccctaatatccctgggtaaagaagacattattccacccaagaactcatatttaaaatgtattttgatatattttaattcatgtataaatataaagtaaaaaaattacataatcatatatctctttcaatgcattttgatttgttgccattttattttactcactggaagaacccaagttcctcacatatgagaatcatgtttaacatattcaaactgccctacagtatgtgtgaaatattaagatgctttttgatgatgactctacttacctctatagctattgtccttagctcctttcttttttcagagccaaaattttttaaagacttggagacaagtctgtatttatttctcactccactgctgcctggattttcactcccagcccactactgaaactgtttttataagataaccaatgacaatctggtaactaaatccactggatacttattaattttacttgaaatctctgcagctttgatctttccttccttcttaacatactgtcctctctctgtttttctcttaattctccaacctttcattctaaggctcttcctctcatcatcccttcaaagtcggtgttccttggggactaggcctcagtccatgttttccctcactgtataacactttctttggtcttcaattgccatgtacaagctgttaattcataaatctatattttcaaggctgacttcattctcatgctttggtcctatgtgccttactatggattggacatctcaaactaaactcatcatttcctcttaaagcccattatttctcctgtgtagaacatctcagtgttttatccgccagtatatgcccagtctcccaaagagaaattagcaggttgcccttcactctactccctctttcatccttcatcaaattcagtttccttctatggtgactctttgtaagccttatccaactctaacctgttgttatttatatggcagagtgaacattctaaattgcagatcctatcatgtcattctcttccttaaattgtactatggctttccacttttttcaggatgacatacagtgctctcccaccatgatctaatctctgcttctctctcatctctccccactactcatggtctggtcatctggacccctacggattgagggtataagccagaaacctacaaattttctttggtgcctctttcttcctcatgatgctcctgcttatccaattcattaccacacactgggcttccacttgtgtgtatggcattcatctctactaccccactctcatccaatctcatattgtgtagtttgggattaccacatttgttttttagctggtctctctgcttttactcttgttctcctccaaatctgttctccgtaacgtagccagaatgaatgtttgctattccaaatgtgaatacgtcatcgcagtgcttacaaactcttcccctgacttcccttaggctcgtaggataaagaccaaaattctccccttggccacatctcccatcacttgtgcccctggccatctgcactccagccatactgtcccccagccactttgtcccaccacaaagcattgccacacatttctttattttgccttaaaggtaatctacctctccctacattttgttaatttctgttaactccaatttacctttcaaatctcagctcgtgaaagccctctgtgccatcgcaggggttccaagattcctcctgtgcttatcttataccactatttttcctctagtttgtagttataaatttatctacatgatcatttgacaaataactatatagtccaccagactatagactccaaatgggcaagaaacctttttgtttcttaccacagtatcaccaatattgtacacataataggtgttaagtcaatatttgtttaattaattgtgaatgattttaaaagcatttgaacaacaagatggaaatgtagacaaacccaaaataaacatttattttgcactctttaaaatgtgttaaaatcaggcatatatttataattatattgttgaatattttgttttcattgataaacacctcttaactatttatattctgtaaggggagaatgctatgtagtagattgaactgtataaaatattaaaattttgtttcacttatattgtattttattgcctattgaatatcaaatttaatgaaaatgaaacatttccaaaaggatgaaactagtttttaaacgatttaagtgccaatattataagtttacaagattttatttatagtttttaaaagatttcaactgctaacagtgttttttatttctccttttatatttttaaaagatatatatataatataaaacaagtcatatctttttggtttggaacttttaaaattggcacgtgaaatatttaggaagaaattccacatggaactggctcattgtcattccacggggtcagctggttgctccttctttccttgtgtgttgttggtccttatggcttgcctgatgagtgcttcactaccacttagacatatggagctggtaatattggaagatgacccttgagagtatcatataaatgatttgatctgaaatctaattttagcaggaaaccatatgagtccacaaatgcaaaggtagacagtatctaagcaatgttatctattcagtagttaggtttgctccattagattctagttttaacataaagaaggcagaaaatgaaacacactggtcatatccaaccaagaaaattatgtgcagattttaagaggcacagtagaactgcttgagctaaagcaggaaagtaacagctacattgttcagaagtaaattaacgtgtgcctaatggtaatgcatgctgcctagacataaatactctaaaaaacaaaacaagaaaaaatagaaaaagaaatgggaaaaaaaaaacctagttgagtgaatgtcaacataaaagaaaaggtaatcaaaggcaagagagatacaagatactgtgtaaggcatcatttacaaaggaacactgtaaagattgcagaatagaggtaagagaatgttaaaataagaaaatccaagatagagaatgaaaggaagattgtacaacatattaggataaatgagaagttatttgtcaaatactcaaaggacaagataatagtgaataagaagaaggatgactaagagatggagatggtaatttaataaaacacagaaagagccaaactgaatcagacagatagttcctatcatgtagtatttagcattcattcataacattatcaatagcctgtcctgggtgagattgatttttgtgaattttgctttggcagtgataccactatctatcaccactacccataggtgatagtgcatttgtcataggcttctttatgaagtctctcgtgggtatttttgaccagggtgaatcttcaacttaattactgtgtaatgagacatgatttttaaaaatatatctagatgatgttctgatatgattttgaaatgtgttaattgactgaaagtcaaaacttatatacttaaagtatacattaactggagcagtgtcctccactcacctagaatactccagtttttcatgtattttactactctttctggatgttagccaaacacaaaatagtgttgggtacaaacaaaatataagtctgtgagacaaaaaaaaagtgtatttcatctccaattccctgtacatgtaagttcagataagttacttaacctcctcataccttccttttcacctgtgtaaaaagagggatgatgccttctatatatctctaaattcaggaagagtaagtgagacacacgagagtgctgtaagcctttgcaaacatgtatataaatttggcataactattcacaatagcaaagacatggaatcaacctaagtgcccatcaataatagactggctaaagaaaatgtggtacatacacaccatggaatactatgcagccataaaaaagaatgagttcatgtcctttgcagggacatggatggagctggaggacattacccttagcaaactaacacaggaacagaaaatcaaatactgtatgtcccacttataaatgggagttaaatgatgagaacacatagacatgtagaagggaacaatgttcactggggcctaccagagggcggaggatgggaaggatgagaggatggagaggattaggaagaataacttatgggcactgggcttaatacctgggtgatgaaataatctgtgcaacaaaccccattatgcatgggttttttttttttaacctgtgtaacaaatctgcacatcctgcacatgtatccctgaacttaaaagttaaaaaaatataaaaaatacaagtaattctgaggtacagatgagcctgactgtgtaactcatcctttagcatgctaacccgcattaagttgatgcttttggtgccgggaacctcacgtctcctcctcttctggaatagcctagagaggaagctcttcttctgtgtttagagggaaggtatctccttcagtaagcactgtgctggccctgaagagtcttcctaccctcttcctgccccctactgccactcccaccccaccagcgtggaacttcgtgtgtattcaaaggtccagtttgaattactgtgaggccagtggctagaaagcagtgtagttgggactggagattcacatgcctggctcttctcccaagcttcaactgtagctcttgagcagcagcttcctctgagcttctaaaaaatgcccagaaaattgcccagccaaccacatttcctggcaagcatagcaccaggcatatggtcagtttgagtgctattagataggctttagaacttccaagggatcattggtttgattgtcattgtatccaccaatcacccaacatctatgacccacgacaatttgccagacactatgcttggcactctgaggaataaaaagagtaagacagatccctagccttttctaatctatctatctaatggagatatggcaaagcacctaacaaagtcactacccattagagttgtgaatagtggtaataataattatttttgaaaatctaagaaaagagagcatgtgctagaataggtaaggagggcttcactgagaagatggagttggaattgaatctcgaaagctggatttgttttggataagtagagaagagttaagaagcaaaagtatgaacaaaatctttttttgagaatgttccaaaaggaagtaggcaagaagaatggtaataaggttggcaagattggttaggaaaattgttttttagtcctgtatataacaactttagagaatatttactataagttaggcatcatactaggagctggatatatgataaacaaaacagaccaagttctcacccccttagagcttaccttacagttggagaggttgtcaataaataggtgagccaattactaagtaattctcaaatccatggtgctatgaaggaaacgtcctgctgcaggaagtgtggaaacctaggtagcaccctgggaatggccacgctaaggagaagcacttaaactgaaagctgatgggtaacaaggacccagtctttacaggtgttgaggagaagctcattctaggtaaagacaatgggatacaagaaggtgctaagaagggatgagttttgcatatttaatatactaaaactatgccagggaggttgattgcatagggtcttagtgctaattgttttaacttctttcttatcatggagtttgtaggattcttgacaatttagtattgaagtaatcatataatcaatactaagaataaaatgcatgtgaatgatgactcttacacattactacgtaaatgaaataacctgtacaacagatcataagccagaggaagttaagacaatgaatatgatcttgatcatccagaatttaaaagagacagtgtatgatatacatttactttttaaaatttagacactttgagttataaataagaattggtccacttggtgtgaaattatgatcttttggtaatacagaaaatatattgatgaagaaaaagaatatattttaagtttaaattataatgtacattttctgtaccataagagacactagtggtattgatacattaatccgtaaggtaagatattggaagatgaccaaaatatagatcaagttccttattatggtgttcagtaatatgtgaaagtaagagtggtaccataaagttcagtcaagtctagactagaaaaatatccaaagcagtttagactacgaacatctttttttttcttttcttttctttttttttgagacagaggctcgctctgtcgccaggctggagtgcagtggcgtgatctcggctcactgccaagctgttgaccttagttagtgattcagaagtaacatttaaataattgggtatgagtatgtgtgtgtgtatgtgaatgtgtttatgtatatgtgtctgtgtgtaaaaagttatttgacccatcagacctttgagtgcaaacacgtgcaggaagccaagtttaaggaaattaatggaacataattacaacactcaccagaaaagcaaggatttgagtaacctagggactggatgcacagtttatcccaaaaaaatttttaaatccaaaagtgaaaataattccattattaatgttttagaagaataaatccagagcattataatactttggttaatactctccaaattattgtgtatatgtactgcaaattatacagaaaaaaattttaattttccaatggattcttatcctttcatcctttcatttgtgatgttaacacttgcaggatgagaagttagatgataatagttggactttatattccttcatttgtgcaaaaccttgaaaactttcataaattaaacctcttgctgcccttggaaaatcacaaaatgcagtacaattcctctagcgtcttttaccatgttctgtgctggccagacatttagttctatttaaaatccacttacgtatattttaaatattaattctctggccatgcctagtatgcaagcactctggtacaagattctagagtgttaatatgctgccaacttggaccttattcaaaactatattgagacagtttgtgattctctaattcattatctgtagttagactatccatatctttttagtaaaagagaagaaggcttatatattagcatatgcaacacatagaaaaatgaagtataaacctttcagggtactctaaaccttgtaatttttaaagaaacaatgttatacacacaccatttttgtttgactaaatatggtatattttaaccgtgaacacgttgaatgcattccagtgtgtcaaatgatattttaaatgtaaatagaggtgaatgtgcctgagaatactctttgggaggtggggctgttttggggttctgttttactttgctgacactgctgcatgattctgtgattaacaagcatatttctggtgctatcatatggaaaagttagcatttattctcccttaacattttattggcatctttgatgtgttataaaacaggcatttactactgagtagctaagcatttctccctctttgtttctttaattaacgtattgatctaaaacaaatctataggatcaagcttattgaggcagacagcctgtttgtctctcaagagatcattgctgcactccacacactttttcagtaaataaaatatggacaaaactgcaacatgtggaggctgaagattccattaaggacttttggcatctgtaccttaaagatatttcaaaaataattgtgctttattgcttcttctctgccatagcatataacaagcgttttttaaaagaccaaatacagctctctgatttccatttaatggaagaagtaataaagtttaattgtatacgtgagcatggggcatcatttgcaatacatctgatcaataattcatcgattgccgttggctcaaagtaatatttgaaagaaaatgcagccagtgggagcttatctagctgtagcttcatcatctctattaattatgtgtttcccgaatttggatcattaggctaccaaagtgacagcagatggcgagcagaccggacaggatgctgagaggaccaacacaagagcaaagtccctgggagaattcattaaggagcttgcccgggatgcagaaggtattagaaagaatcacattttaatcatcatttctcccaacagaaaaacacagaaagggatgacacaggactggaatttctcttgttataagtgacatctgtaaaatcaaaggtagagtttcaaaaagtagtgtggttaagatattcaagggtattatctgctgagaacctgtgacctgcagtgttaaattagcgacaatagtgaattagcgacaatgagggcagaatagcagtaaattcttgtaacatggctattataattacataagaataggcaacttttgttttgttattgtttttatttgaaagtatttaaagtatttttcattttcaagcaagctaatgtcatcattccacttgatacattaaagcagcactttagtttctccaaatggcttttcaaatactggggactggtttttaatgaacatctgttgcttgggatttggatgtgctactttatgagaagctctggtgcatttagctcacaattctctaggagttagttcttgccatctactaacatgaatgagaaagtggaagccattttttggcaaaagcccaaattaagaaacttaaagaatacagataatgccccatccgcactcgccccccaaaaaaacctagtccttaaatatctgttaaaatataataaacgtgcatgcatgtttagaaattgggaaaaatgctttttgttgttttttgcttgaagcagtaaaacatttttcttgctctgcaatattatgcattttagatactttgcttcataatgtagccaaataaataaggatgtgagatcaacttcaaggcagattctgactgataattcttaggcatcactggccaagaagagacaaactcccaaatgttcaccactgcaagaagcaacagggttttaatttgagagctaatttgaggcaaaggtgtgaggttctgaaacagaaattatttctgccagaaaaatctcagttaattcattgtggtttatcctctgctagatgaagctgttgtactttccctagtattattttccattaatgctacttgaagtgtccccctccaacccaaaacaacaacaacaacaaatcccactgcaggtagagcaccttcactctgagcggatccccaaaggccctagtcaatgctccaggaactttccttttctttccattgacatttcaaacacccaacacctagcagcccatcctggggactcattttcaatttgtttcaatcaaacactggtatgagaataaatgctagcatatgttttagtagatcctattatcaacactgcttactttgttctctgcaatgaaccttccatctcccaccaaagagagatgcatattcatggttacctctttggtcaatatgaatatttgcttcttctgggtgcctagggcctctaggtactatttgtacaatttgtggaccaacaggggtagactggagatggagatttatcccaggcttgctcaccaccccaaatcccacgtctatacaccagagaaaggattacccatcaccaaaggtgtctctcgttccctaaattatgcatagatcaggtggtctgattgtgtctgtccagatagggcacccttttctaatttatgtgaagtgccatgtgggatagctatactttagggaaataagaacaccactcacttttgcctgcaggcactatttggtagaattaatccaactgttaaaattgaatgaaaggtcaaatttaaattgtaccagagcaacactaaatgttcattgagatgtaatacaaagcttggcagtttaatggagaaaaaaagagaaagtgggggaaggaagggaggggagggaaggaagagaggggagggaggaaaaaggaaggaagggagggagggaggagagggaaggaagggaggggagggaggggagggagggaggaaggaacagagggaggaaaggggaagggagagaggaaagaaggaagggaaaggagggaggaaggaagaaaggaaatggaaagaaggaaggaaagaggaagggggggaaagaaggaagggaaaggagggagggaggaagaaaagaagaaaagggaaggaaggaaggaaggaaggaaggggaaataagaaagggagggacggaaggaaggactcaccaaaggctttaaagtaggttatactgtatatccacacctctttttctctctctctaaactataataatgagggataaccatcagtacttttacatttttgtttgtcagttgtaataaattgctgtgggaaaagtaaatgcttcagactgacatttatctatttcagctttatgtttggatagatgtactattcatcctatctttcattatgagtcatgacctcgttatagataatcaccttctattcatctaaggcattcttatctcactataattttataatatctaccgtgctatgactcctgattagttcataaataaactgttttattccacgcattattagaattaatgagtggacataggtaaacccattagtgtttatttcctgacatacaataggacttaatcaatgatagacacctttccttcctgtttctcagatcagagtattactttctattcttaataaatttacccatcagaggattttgttttcagtcttagtatgaaaacagttttgcttctcctgaggaatttttacttacctttatagatactgtatgcctcttaagaatcctatttgtattccctgctacgcgtagtctactaagatgcttagtagtggacttaggatgcactgcattgaacgttatggcatggttttctgtctactaattctttccctaatttatacaacttttttttttacctgtagtgctatttccttttattttaattttatctgatattaggatttttaaaaaattacctaaatcctcctttgaattaagttggaaataaataagtaaattccaaagatacatcttttacaatcattttcaatactgtgggaaagaaaatatattgaagtgatagtgcatacttttgaataagagatgaaaaacacattcatctttaagaatgctcagagaagttccagatcctatttatacataggatctggaactatatatatgtatataaacataaaactgtatgtttatatatgtctataaagagtgaaacagacttctattaaaatgatgcttcctttccttttttggtgggggagatttctaagaaaatcatattgcctagcaagtgatagatgcctatgagagaaatggaaaatgacagcattttaaaatttaactttcagtagaaaaataatggaaataaaaattaaactagacagttcaccatacaaaaataatgttaaatgagggtaagtaaagcgcagtgaaataatctggaaaataactataaaactttaaaacactaataataaataaatgttatccaaattaaactggcaagttttaatgggccatgtgtaatttatctgtgtcccgatgaggccatatttttctccaaaacccatatctaaaatttgtttttcataatgaagataaagtagcacacataccaaaaacccatttgaaagatgctctcatttaatccaaaaagatactgaaggcccatgtccattttggggagcttgtattttttttacataacatgggttgcaacaaaaagctggccatggaatagcagtttattccataagcagccaatatatttgctaaaatgtttgttcttttggtcctaaccacattgaaatcttctgggactatttcaataacagtaattgcaacaattgataatatccaactggaaaaaaaaaaacaacctcatgactgagctgcacagtgatgtcctatagaaactttatggggtatgtgttatatgttttgatgtttttcttttttttattctcatgtttttattttcctttttactttaagttctgggatgcatgcacagaatgttcaggtttgttgcataggtatacctgtgccatggtggtttgctgcacctatcaacccatcaaaagaagacatttatgcagccaacaaacatatgaaaaaagctcatcaccactgatcattagagaaatgcaagtcaaaaccacaatgagataacatatgacaccagtcagattggtaattattaaaaagtcaggaaacaatagatgctggcaaggctgtggagaagtagaaacacttttacactgttggtgggaatgtaaattagtttaaccattgtggaagacagtgtggcgattcctcaaggatccagaaccagaaataccatttgacccagcaaccccataactgggtatatacccaaaggaatataaatcattctactctaaagacacatatacagtatgtttattgcaacactatttatgcaaagagatggaaccaacccaaatgcccatcaatgatagattaggtaaagaaaatgtggtacatatacaccatggaatactatgcagccataaaaaagaatgatatcatgtcctttgcagggatatggatgaagctgaaagcttcagcatcctcagcaaactaatccaggaatggaaaaccaaacaccacatgttctcgctcataagtgggagttgaacagtgagaacacatggacaaggaggggaacaacacacactggagtctattgggggttgtggggagaggaaaaggaaagcattaggacaaatagttaatgcatgaggggctttaaaacctagatgatgggctgggcgtggtggctcactcctgtaatcccagtactttgagaggccaaggcaggcagatcacctgaggtcaggcgttcaagaccagcctggccaacatggcaaaaccccatctctactaaaaatacaaaaatcagctgggcacggtggcatgcgctataattccagctactcgggaggctgagacagtagaatcgcttgaacccaggaggtgcggtcgcagtgagcagaaattgtgccactgcactccagcctgggcaacagagcaagactccatctcaaaaaaaaaaaaacaaaaacaaacaaacaaaaaactggttgacgggttgataggtgcagcaaaccaccatggcatatgtattcctatgtaacaaagcttgctttcttaatacatgatcattttgctaaagtcatttttgtgcaccttaatgattgcttcttgtttacaaatggttttaatttaaagaaattatgtatgccatccaaaagatacagccatatttgccttttccctttctctatctgttgtcattctttttccaccagattcttctctgcagaagtttagctttgagaccagagcacaagagaaatagtgagactctgtctctcatttttcccttcctctatactgcctaggcccagaatctaaattagatcaaatttcaaaagatatttcttatgaaagctgatttatacacgcacacacacacacgcgcgcacacacacatattcatttaacaaagaaaaaacatacagctttagcaggttgggaagtggcatttattaatatcatcttcattttaaaaagtgagtacaaattatatcagtagttacttacatgctacaattggttaaagtcagctatacagatagcatgcactcagactaaaggatgagatagtaccataggtagagccaaatctgctactgctttcttgaaatctaagaagcagaaagcttcttacatttaatcattggtactctggaaggcttcccacctagtttgctggaccagggagctttcaaactaatcagcctatggttactgtgattctgtaacaaaattgagacacagcctaggtgatgtatcttactgacaatagtggtgaaatattgggaggattctttggcatatgtcaaggtataactgttaggcagtgggtcaagaaagagccaccctcactaacttctaggaatacagcacctgacaataacttctaccacagggctaggaatggccatatttgttctttaagacatgtgattcaaatatttctgctaattaaaccatggctgtcttagcccatttgggctgctataatgaaaatatcatagattttgtgccttataactgaaatgcatttctcatttgtgaaggctgagaggtccaagatcaaggtgctggctggtttggtgcctggtaaggagctgcttcctggttcagagatggctgtctccttgttatagtttcatgtggtagaaagggcaagggggttatctggcatcccttttataagagcactaatttcattcttgcccttatgacctaatctcctctcaaaggctctgtattaatctcttctcacgctgctataaagaactacctgagactgggtaacttatgaagaaaagacgtataaattgaccacagttctgcaggcttaacaagaagcatgactaggaggcctcaggaaatttacgatcatggcagaaggcaaagggaaagcaaggaccttcttcacatagtggcaggaaagagagagaatgaaaggggaagtgccacataccttcgaacaacctgatcttgtgagaatttattcactatcacaagaacagcaaggggggaggtttgctcccatgattcagtcaccacccaccaggcccctccctcaacatgtgggtattacaacttgagatgagatttgaggtggtcggtggggggacacagagaaaaaccatatcaggctctgcctccaaataccatcacattgggaattaggtttcaacatatgaatttgaggagaacataaacattcaatctacagcattggctatcagggttaaagtactgactacaggaacttttaaaccaaagacatatataacgaaaaaagaattataaagatgcattgtggaaagggtatattagacattgaaactcaattctttctactatcccagtgtttctcaagctctagggtacatcagaagctctgagaaggcttgttaaagcccagattgctggtcctcacccccagaatttctgagtctgtaggtttgtggcagggcctgagaatctgcatttctaatgggctccaaggtggtgatgctgctgctgcttataggggaccacattttagaaccactgtactgacccaccttctcacatacccctctgcctgctctgcttgtcctgactatgtacacctgtttcaggagctctgcccagtgcaaaactctctccaagaatagaaattaattttcaggaatctctatgtcataaggagatcttcggatacacccttgaatggtagaaaatgcctcttggccaaccgagacccctcattctaggagttttcaaaggtaatattatagaaataagtattcagctgacaaaagagtttgagaaaacatctctcttaaattcaccaaaaaaatgtcctatagaacacactccaggaaactttagtctaaaactaataatataactgtgtaaatgtttcaattcaccattttaaacttttatttgacgtagaattcttttctcaaatgaaatcctgcccagaacatcagcctataaagcagactcttggcagaatagacatcatttgtagaaaacctgaagcacctggagaatcctacgattccaaggagtacagtttgaaaccccatttaatgcataataaacacagacccttgtgaaggatgctattgctggaaagtgtccttgaagcctaatttataacccttctcctagaagggttataagtctagaccagtgcttctttcttcactcctttaaaaaatgaacacaggagaactatgtggaaatacaagggcaggttcattttcagagatctcatcactgagtgtatttccacactcagtatttttaaactgactgatagccactgctatgactatcttatcagcaatgcagagcttgcgtttccagcctccaagtgttatgctacaggtcactgttttttttaaactcttacctgagtatgcttcgacctacttctttattttaattctttctttcttttgaggttagaaacaccatgctttaattgctgtaacccccaaaagaaatataatattgagaaacatattacatttccctgtttgttactgattgttgtcttaactgcctctgtggttcccagcaggaacactcacggcaaaatactcttcatttggagatggtggtgcccagcagatgctgaataccatgttttcatgtggcatgtttgtttactaatttacaaaatttgttttaccccctgcagctgtaaatgaaaaagctataaaactaaatgaaactctaggaactcgagacgaggcctttgagagaaatttggaagggcttcagaaagagattgaccagatgattaaagaactgaggaggaaaaatctagagacacaaaaggaaattgctgaagatgagttggtgtgagtagatgagttattattttttcttttgacaaactgagatttccagataatttacagttttctaaatttttatcacacgtataagtaaaagatgctttgtttttccaacctggagatatttgctatgttatctatcatctatctatctatctatctatctatttatctatctaccatctattatttattcatttacttatttaattgtactttaccattgttccaaaatgaatcaaaagcatgttcttgcctacatataatcaagtaaatgatcttttctggtgctgctccttctgtaattaggctaatgagtttgttttgttaatcatctgcattagggacttttggactatcagttgatttttgttttaataaaaatacctttggataaacaaagttatgactttaccattcatatattggccaacctatacattttatcatcttaagaaatgctgaaaagaaaagtcatcaaataataaacacctaatactttcaaataagagttgcgaatatgagggttgggaaaagtgatagtgattttacccatgctaaagaacttttatgataacgcactcaataaaatagatacatctctacattcatagtcagctaacttcaaagtggtagtattactaatacttaaataatttatactaaaccagcaatatcagcacaccagagaacttgttaaaaatacagattgtcagaccccctcccagacctcctgaatcagaaactttggggatgggacccagcaaaccatgtattaacaagcccttcaggggattatgaggcatgttagtttgagaattactgtctttcaagtatttagagtttcttaatgactcgaaaattatcactttagaaaaactaggtaagttaaatccaaaaacttccagatcaatcagttggaagaaaaagaaacatagattaaaattatgctagtctactagcatgacaatgacctagaattctgttcacagtttctgagcaaacataacaatattcatcattacattcaaagtaatagagaaaaggtctcagtacaatgaaacaagtggattgtttgattttggtatgtgaagtgaatcttaaaactcatttcatcaatcagattcctagaatgacatgattcaaaatgttattttacttacaaatttaaaaggtttcttaaaaatctgtttcgcttttattttaattaattataaatggtctcaggtaccagttttcaacttgatttagcacacagtgaatctattttacatgttttcttattttctcattcttttcatgttagcatctctttgtaacatggtttaataccaataaaccctaaggcagtgacatgagctcattgtctattattgggctgggggtggttacagagctgcagaagcccttctgaaaaaagtgaagaagctgtttggagagtcccggggggaaaatgaagaaatggagaaggatctccgggaaaaactggctgactacaaaaacaaagttgatgatgcttgggaccttttgagagaagccacagataaaatcagagaagctaatcgcctatttgcagtaaatcagaaaaacatgactgcattggaggtgagtcttaggggcacttttatcttaatctcagaaggttggggactgcgggggcagtgttgaacatggctggactattcaagttgatgcacatttacaaaagtcaagagtgacaactctgaaagggggcttctaagaaacagaacaagaaatgacttttttttgtttttgttttgtttttaatgaccagttaccatcgcccaaagaatcaaataaaattttgataaattaaactgttgaagatatttaagaacactgtgatacagtggaagaagttctttacagggagtcaggcgaccttggtctcaatgacaactgtgccactatctagacatacaaattgggcaagtcaattaatctgtaagcatcagttccccaaatctacaataagtgcattatactatagcatacatatagggtatcttcaaatattcatatcatattattttgcagctttcccaaactaattcacaaatcttgttcagagatcttgctgccaaaaatcatagaagttccctacactttcaaattcaatctgagcacatgacaaatagctcaatgaattgagaccagagcttggaaaaattttggttcctctttttctatgcgctgtgttctatgcaaatgatcttttagaaggaactaacatgaatagatcaggtctgcgttattttctcctccttttccacacagataacagttacttctcaactcaagaaattatgggcagcctctatctttttaagagttctgatggaactagaactaaaacagattcctccattattttttcttcttttttttccaatttctttcttaatcttaacatagtaaattatcacttttcctaagagtaaactcagcacatataacagcagcaccctgtatgtgatattaatatttaaacaacaacaactttctccccagagacaaatttacctttgctgttttcaaagtatctgactccaacaggtcagaaaacagcagcagacctatacatcttctaacacataatttcaccgtcaacagtaactcagcaccctctggcatatagtatgtatgtagaaatgtttgttgaatgacagtaacaattgaatacaatcaaccaggattttttaaatctattcatttctattttcctttagattaagtagtaagaggaagaattacatttttttaatatattttatttccgtgtccctcttctgggacttagccttgtcattctggtagaatattgaagaggcttactttttttcttcactgatgcacctaaccaatttggagtctactgacatgctagcagtattccagaaatactgctgtgaggcaggatgctgggccactgtcctgtcacaggctccagcatgattcaccctgctcggtgacacaccagccgtgtgacttacccgaaggtgcacctgtctattttatggcaaccgtttgataaatgaaaattacctgtgtggaaagcatagtaagtatttgagaaatatttcaagaagagttatatggcacagtcaatagtacctttagctattcgtttcttttagtgatgtttaaaaccagaagtcatcattcttgggcacccctacaaatacctggagcttatgtatagtcggtattgaaattctgagtggtcctgtttggattttccttgtatgtgccacgtttaactaaagacttgtttaaaagttactggataaaatagataaactaactgaatcaatatgaataaggcatagattatttatggttgcttaaaccaaataaataatttggttgctgccaaaatggctgaaaatcacatggggtgtttgttaagccaacaggtttcatgggctcccacctagagagtctgtgtaggctgctctggggtttggccccatgtgtacattctaacactctccctgggctaatctgatgcctatacaggttcgaggaaaactgacacattgcatctatttgattgaataataagctgcattttaaataaataactcccttataactgtgtccacaatgaaggtaacacaattaatacccaactcaaaaactttttatttattttaaggtggcatgtaattttctttttaaaaattttatcaagcctctaattcattcaggaaacgtgctagacaccaaaattgattgtgtcagtgatgagcccccttagagcagcagcctcagcgtaacctagcaacttgtcaaaaagacaaattcttggaccccatccctaaatgaccaactcagaaactctgagaatggggcccagaaatccgtgttttaaaaattcctccagtgattaagatgcagcttcaaggttgagaaccacgggtataaacactaaaacaccatctctgattacttcaagtaacttgtatttagtgggaggtacacataagcaaaccactccatacgctaccataattatcacaggcgtaagcaaaggagggagtctaagtcacccctgagtttaggaagagctttgtagaggccctgacacttgtgctagatcctaaaggataagcactgggtcacagaagaataaagagaagaacatttcagaaactgggaaaaacatatacaaaggcatggaggaaagaaaatgacattttgggggaaagttcagtggtttgataggcttggaaagaagactgcatgtgaacgactgaagggatagaaagaaagagaagataggcagagtgcagaccttcagttataagagaatcgcattgtgagactaagctaaggaattggtttttatcctgagagccataggaagcaattgaaatattgcagtcatgggttaaaataaaatgttgcagaatttgagtggctcacttaaactgaataaatggttttttatcggaaaatagtgtgatattaggctagaaaagtaggctgggataatatttatctacatatctgtcaggtacctaccatatcaaggtactgttggtaaccagggtatttgaggttgaatagaaatgattcctggcctcaaagaatttacaacctcctgaaaaattcagacatgtcaacctttcactctacataatactatgataatattgactgggagattcagcaaaagtttcacaaaaataacagcatcatagcagaagtggagaggaattggaagaaagacagagcaacaggaaccccagccagagctttggaagtgtaaggtgatcttaggaagtgtccagtacagcagaaaaactttcaaaagctacgtaaaaatctgtagcagagaaggctctggaatttggagccagatcatagaaggctttggatgcagccaactagatggtgatggagttggaaaggcatttccagcagtggagagagggctaagggaactggggacgtcatgggaagaaaagagaagacaaatatttcagtgaagcaaaataatatgtattgagcagtctatccccaaatctaccattatatccttgccaaagaaggcagtgcggatcaagtaaagagtaagttgctacataaagaatacacaggccagcctgagcaacatggtgacaccctatctctatagaaaaatacaaaaattagtcgggcatggtggtgcatgcctgtggtcccagctacttggaggctgaggtgggaggattgcttgagcccagaagtttgagcctgcagtgagctgtgatcatgccacagcactccagcctggatgacagtgagacaatgagacagtgagacagtgtctcaaaaaaaaaaaaaaagaaaaagaaaataaaagaaaacaataatagacaggaagatagcttttgcaggttcctgaagaatctaccacaccaacacaccaaaaaaaaagaaagaaagaaaaagaaagtgtccaatttgcaaagctctggaataaataaagatctaattaattacaagttaaaagtagaaatataatcaaccttcatatccaaacaataattgagcaattatacttatgccatactttttgtagaataattctccctatacataggccttctttctgtttcttaaatactctaagtttcctatcttaggtattttatatgctacatcattttctatctgtgcctctctttgtttttattgtactcatctaatctttctttaagaatatattatacattaatttactcattcattttatctctcctccacacaagccatgaggaacatgtgttcttcctcacatcccccaatcctagaacagtatctagcaaaggcaaaacagattgttttccgtgaataaataaagtgccatagaacaaacccagatactctatacttttgtcaatatttgtgagctccaaatttccatcttttctcggttcaaagctagaacccatcagtatctaatctgaaaacaagacacctctaaaatttatttaacctcatcccagcactctgggaggctgaggcaggaggatcatgaggtcaggagatcgagaccatcctggctaacatggtgaaaccccatctctactgaaaatgaaaattaaaaaaaaatacaaaaataaaaaaaattagccaggcgtggtggcaggcacctgcagtccctactcgggaggctgaggcaggagaatggtgtgaacctgggaggcagagcttgcagtgagccaagattgctccactgcactccagcctgggcgacagagtgagactccgtctcagaaaaaaaaaaaaaaaaaaaaaaaaattatttaacctcttgatcatcatttctgattgagtatgctaagaagcacattttgatctttgcttttacaaaagattctaactcactactttattgaaatcaaaatatatatagctcttcaattaacacacgtgtggaaatatcttccctgtttccagtggcacagcattttaaattaccttgatccattaattcaaacaagccatgttgtaaaagattcttgtgtttctgtacatgctatactttaagtcagctcatacaaaagctaagggctaaaattggcagttgtgtaaaagaatgttagacccttggaagataagatatgacttgtaatcagggagattgtaatcagggacattgggactcttcccacatttgttgtctgtgaagagtgaatgacatatcaaaacttcccctgaattagtgatgggagtagctgaatgagccaagtgtcagcagcacaagtcccaggaatggacttcattttcttttttctttcttttcttttcttttttttttttttttttttgagacagagtttcgctcttgtcacccaggctggattgcaatggtgcaatcttggctcactttaacctccacctctcaggtcaagtgattctcctgcctcagcctcccaagtagctgagattacaggcatgcaccaccacacccagctaattttgtatttttagtagagacgaggtttcaccatgttggccaggctggtctcggactcctgacctcaggtgatccacctgccttggcctcccaaagtgctgggataacaggcatgagccaccgtgcctgacccatttttatttatttattaaaaaatatttattgaggaaactcatctacatactagagatagtgatatataaaactgtctttatggaatttgtgttacagtgcaggagacagtcactaagtcaataaataagcataagctacgaccataaagtctggatgcacgggctgataaacataagttgtttactgatatgtaataaatggtatgttgcatgatattgcataatagattcaatgtgttgtccttcattaacaatgtgtagttcaacaggctgtgcctttctgctagtccctgtacatgtatctgtgatgcattggtatttctgatttttattacctaatctttgtttttagcaactcccggcaaaagtaatcaagacgaatcaatctatataaaaaagaaaataatattgtctatgtttctaccactctgtagaatataattcagataaatgggttctaagaagaacaaaataaggtaattataatagttaaaattacagtgttactgggtgccaggcagtgttctaagctaattcttctccaattttacaatgtctatcaatcatgtggggttcttgttaaagtgcagattctgagtcagtagttcccaggaatggattgagattatgcatttctaatgagcttccaggtgacgctgatgctgctggtgaatgggctgcacattgagtagggagggactaaacattttgtatgaaggtaaattacttccttaaggtttcatagcttgggagtgagcagagctgtgatcccaaaccagaagggctgtcacttggatgtagcttttaatcactgtgccctagtacatagagaatgattgagacaaggataggtgctattttagataggtaatcagaggagtggctattaccagaatggagggaggacacaagccaaagagtaggaagagcacatagtgggaatatctgcaagtgcaaaggcttagaggcaggaactagttgtatgtacctggcaacatactgaattggtcggtgaagggaaggaaagaagggtatgaaattagcactagctcagtgcaaattttaaaactgtgatttctataatagaagagatagtattttcgtagtcaaggacccaggatctatcattaagtagacaggggtttaaatcttaatcacactgtactatgtgaccttaaaggaatcatttaatatcttagttcatctgagctgctatagcaagagaccaaaaactgagtggcttatatgcaatcaaaacttatttcttatggttctggaggctgggaaatccatgatcaaagtattggcagatttggtgtctgatgagggaccactttctggttcatagacaccgttttcactgtgtcctcacatggtaaaaggatgaacaagctccttcaggtcttttttataagggcagtaatcccgtttatgaagtctctgcttcatgacctggtcacctccaaaggccccacttcctaatcctatcaccttgaggattaggatttcaacatatgaattttcaggggacacagacattcaggccactgccctttacttattcaatttcccacttatgtaaaaagtgatcaacatgggatccaaagattggaataacaaaatgcttacaaactgtctggcacatattgagatctaaatgaattagcattattgtctatagaaaaaaactataagtggtcaaagcttaaaattataattgatgcagttaaatctgtaggtagaatggtgatttcaggaataggaatgaatcagaagtataaagaataaaataagtaaaaaatagaccccaaatggagaaatagcaatatttgtctctcactgattttactcttctaggccaggattgagtttcatgtacttttgagacaagctatatgttccaaagaaaaattataatctattctctcatgaaacagtccattaggttgattcttccatgtgatggtttctctatttcttaaaaagtattttccctaagtttccttaaaaatctcacttcaaatttcacagaactcccattgaatacatctgcttatgtttatgctcacaaagtactcatttgtatatagattctagaattcaatatgtagtaccaatataactattcagcacttatattttagttagaaatggatgctccatctttctttaaaagtagttttaattccttaactagtatcgcataacttttcttcgcttggatgactttctcacaatgagaagaagaaataacctgtacaagcctctacatagaagaactcttcaaggactggctaagtagtttatatttttctcatctagccacatttcaacatgatgtaccttttttgctaagcttttattcaaacagctcaggaaagtcaggaatacaaggggtaggattttatgaaaatgcaattttgatgtcttgttcataatggtctacagaaaaagaaggaggctgttgaaagcggcaaacgacaaattgagaacactttaaaagagggcaatgacatactcgatgaagccaaccgtcttgcagatgaaatcaactccatcatagacgtgagtattgggtaaaactcaaaagagagatgataatgaataaatgggagccgatgagaaagctcagtaatagaagcaaatactagtacttgttttcttgtggagataaaattatttttgcattattctactgtgaccatgcctatctattggtgacaactggaatatcactttgttctcccaatggacatgagtgtttgtgtaagtgtactcacacattcacacatatctgtttttgtccacagcgatgaaggacatttcttgttcctagagcagcacttacaatctgcttcaatatttatataacattagttaaaagacaaatgtaaatttacaaacaggcttttaacatgtaatgtctaatgcattacatagagtgatatgtggtcatagaaatgcaaatggcctaagagatcctaatgacatgtatacctatgaagtggcattgtttaaatagataggcttttcttggtctaagttggtttcttaaatttcctagtctattccattaaataatgactttaattctctattctttttgctatgttagtaagtttgaagtttcattttaaaactaaacatgtgggccaggcacggtggctcatgcctgtaatcccagcactttgggaggccgaggtgggcagactgcctgagctcgggagttcaaaaccagcctgggcaacatggcgaaaccccgtctctattaaatattcaaaaaattagctgggtgtggtggtgggcacctgtaatcccagctactcaggaggctgaggcaggagaattgcttgaaccagggaggcagaggttgcagtgagctgagatcgcaccactgcattccagcctgggtgacagagcaagactctgtctcaaaaaaaaaaaaaaaaaaactaaactaaacgtgtagttatgtctcatagagaaattagtaaaagagaggaggcttgaattcacttgcttaaaatgccctcttctctacatatcagtatgttgaagacatccaaactaaattgccacctatgtctgaggagcttaatgataaaatagatgacctctcccaagaaataaaggacaggaagcttgctgagaaggtgtcccaggctgagagccacgcagctcagttgaatgactcatctgctgtccttgatgggtatgtcatttgtttttggaaatgtttgtgtattttgatgcttgtccaaaggttttgactagcataaatagtagagaatcattttcaaatcctgatttctgttaattatgaacacactagctatatggcctttctgtggataggcttaattaggagggtctgggcaaagctttgctacagcagcatcaaaagtctgatttacaagtagactcaaatatggcttagtaggaagtgaacatagccctaggctacacttagaaaaaattattttctgttctttattaaaaagcacagtggttgccttattagcattttaaataacatatatgaaaatacattctgtttcaaatttcagtttcatgtttctaatggaatcaaaacaatttattgttaaaaggatggcttttgaaaatttggccccatacgtagtctttaagtcttttttatttttcctcttttaagctccagggagacattacattttctcctgtaaaatagcagcttattctagctgggattattacaaaggtcataggagggagagtaaagagggaagtatacatttgacttacaaacagccttctgtgtataactgatatgcttttcctacaattttgggattgtcgtaatttaatagcggtgctattagccccaagaataatttgcccagataaatctacatcacatgcaaagctttgttctcatacttaatacttactgttataaagaaaaaatgctaatgtttgaagaccttggacaatatatgaactatcattttattttatgtcaaacttttgccactttataatgaagggtgggtggcagatgaaacacaaagctaggtatcatcagatccaggctctaagtccttacttggggacatattggtcatttggcctgaaacaggccatttaaccttctgaaattcacttggtctcttctgggaagtgcacctaccccagaaagattttgtgaaattaattccagtaatgtagtacaagtgctctgaatctcacagcatgcttcacaaataaggtgaagaattgtctcatatcacacacctgctagagcacctggttgcagagacttttggaggatgctatgggtatttaagatatgttggtagtatttcatagctgaattattagaaatataagtttaggttatagaaaactataggacaatataataagtagatacttcactattatttggaattgtcatagatatattggccatgatcatttggaagccagatttcatataattaggacgttcttcatttgagtaccattgagtgccctgacattccttttttgaatcatcccaccagaatccttgatgaggctaaaaacatctccttcaatgccactgcagccttcaaagcttacagcaatattaaggactatattgatgaagctgagaaagttgccaaagaagccaaagatcttgcacatgaagctacaaaactggtaagaaacaaatggcacatgtgctgggaatggaagtcaacctttttgaatttttcaaatgtaagtcagtctggaaaatcccagtaaattggtatatttgttttgggttatttttgaagacctcttttaaaatttgcctaaaataaattctcggtatgctataattatagcagaactcttttctcagtcacccactaccactgttagggtcttaaaattatctcagaaaccaagcaagtttgtgctaccaactcacaaaataaaacaggcaaagacaacactctggatagggaattttatcaccattatctcaaatggcattagtaaaaaagaaaaaaaagtaaccattgtatataatcacacacaaattggttacatatgaagtttggctataaaattcactttttaataaaaacatactggatcatatgcttctaaacaatttataccatgtttatgaattaatgaatttttatgaatttttgaattaaaaagctcttaacctttggctacaatcattgttcgtaatacatttggaacaagtattttagagtttgggcattccaagttctatcacattatttgaatgccttcaatggtgacaaatctttatgctttagatgtaaagcaacattttgtacatgagttgtgtgatagtaagttggtagtactatttcaggttaaaaaaatctcataggaatcatcctgaataaaatgttcagaaccatcatttatttattttgtttcacatagaacctaccaaacacatgagaattttttgggggagaaatctgattggacatttgactgtgagtgaaatacacataagcagtggtgttaaagaaactgatcaatattttctttgcttcagtgttgggcaaaaatactttctaggatttaggggatattagagatatcccctaaatgaaccagtcttagcaggttcattttgtgatcataatgaaacatcatattctatgagcaatttgtactgtttttggtttctcttgagtgagccctactaatgccatatgttctgttgacttcttattcaaaatagtggcatgatcattgcagaagcatttctatgttcagttatcctttcagaatgaatctacttttcaaatctaaactaaattttaatccatcttctgttagataattttctattttaaagaccctaatttcaagttcaccattttcatttcacctgttttattgtatgattattttcagcacctaaaatggtgcctggcaaatagtaggcacttataaatgaatgagtgtattttttcattataattgacaccttttatgcctgttcataatcttttataccaataaaaatttgctgtagtaattgcttcatccttataaatttcttgtaacattttatgataaggaggtgtttaattttaccctaatttaatacctttaggaaaaatcattttttgccaacatgaagtgtgcacttacttcttaccacccatgcttatacatggtaggctaaccaacctcaaacagagagtgatggtgagttgtaatgcattacaccatgtctgctgttatcattattccttctctctttccacaatcatttaaaaataattaaatgtctgaaaaattacaaaataagtgctatagagaatcagtgatttattaaatgactattggataagaaaaagaagacaatctgtcccagaaattttgttggaatgtttttcatgaacagaatgaataaaattttagtttaatagatcagtataatatagttctactttgctggaaaagaaatatatttgaaaagcattacgttgagtaattatctagataggactaacatcccataaatataagatctgatataaaagctatagctcaacagagaagaatgagattaaatgtattattaagtatagaagagttcaaagcttaacaatacagaagagtcctctactcctttgagtctagccctataaagaaggaagaatgttttcaataacttaaaaggaaaaacaaagaaacaatttatacatttgcaggagaaaaggaaaaggtcaagtagtagagcaaccaacgaccactatgaagaaagtggaggtcagacaatttgagaagaaaaaaagcattgaaaataccataagaaaagaaacaaagaaatgatagaaataacctccaagcataattaagacaatgtttaaaatcaactttgattttttaaaaatttacttgtcttcctatatataaacacacatagacaatcaagaatcacactgaaaggaaaatatgagtgagaaggaagtggatcctttataagcaggagaaagctaatacgatttgtttgtactgcagtattattttgtaaagagtaatagctacttgtcttgcataactaatttctttaaatatcagaatgaaatgttattttaagaatttagacatcatgaaataacaaatgctatttttctattggtgtcgggtgaggaaagtactataaagcatttgttttcctacatataatcaccaagaaaatatctcatttagtacttctctagagggtgcaaggaaaacagaaaggagatatgtcactcataaaatggaataaaaatggaatatggacatcagtaattttttctcatcttagttgctttgatcctataagagactctaaaataacagagaattagatgtttttaaaacatttccaggtcatagtaaactcaaagcctacattatctatcagatcagatttttaaaattgatgaatgtattaatgttctctagaaggacagaactaataggatagatgtatacaagaaggggggtttactaaggaatattgacccacgccatcacaagatgaagtcccacaataggccatctgcaagctgaggagcagggaagccagcccgagtcccaaaacctcaaaagtagggaagctgacagtgcagccttcagtctgtggttaaaggcctgacagcccctggcaaacccctggtgtaagtccaggaatccaaaagctgaagaacttggagtgtgatgttcaagggcaggaagtatccagcatgggtgaaagatgaaggctggaagagtcagaagatctactctttccactttcttctgcctgcttttattctagccacactggcagcttattagatggtgcccacccacattgagggtgggtctgcctcttccagtccagtgactcaaattttaatctcctttggcaacaccctcacagagacacccaggaacaatactttgcatcgttcaatccaatcaagctgatactcaatattagtcatcacaagtccaccccttgtcaacttgaacccatacacatctcctgaaatcatacataatctccaaataaagacaataataacatcataattatacctaacataatacagctatcccttgtacaatcagaagcacactaatccttaacctaaatgctattacataaagttaacaacacttaaatgctgatatgaagtcaataaattttatgtcacatgataaaggaaaaagaaagcaaatgaagatattttcctagtacaagtgtatacatgcacaaacatattcttaacagaataaggaggaaatatatgacaattacagtcttcatttctgcaactggccacgtggttgtagctggtattgatgactaccttcttctactaaccattatgtattccctttgccttctgcaagcacctcagcgggtcatggctttttacctggtggggtgacccaaacctttattctggaaggacctgtgccatttgtagtcctgtctggattgggttggattgggttgttgtagtttcccattgaccttaaacacagaggatggtaatattaagagatgccctatgggatctcctgtattccatgcatgctcttccttgccttcattgtggaatagtagactgatttcaccttgatattctgggtcaattacccagccaacactgaaacccccttcttagcctgttgacttggaggtaggagggccccaattggccaggtggtaatcttaacttccagtttaatggaatcattgttgtatcccttggtgacagcattcttccctctggaactaagatgtctaggccagcagaacataatgttgtgggaacaggaagcaaaattttgctagtgggtcactagtggtgatggtgagtggtgccacttccgcttccaccccttgattctgggacacgtgaacactggctatgggagaaacagtaccatattttggacactgattcaaggcatacacagccttctggagaactttgccccagtccggcaaagtattgtcacctagttggcattgtaattatgacttcaaaagggcattccacaattctatcaatccacctgcttcaggatgatgggaaacatgataagaccagtgaattccatgagcatgagcccagtgctgcacttctttagctgtaaagtgagtgccttgttcagaggcaatgctgtgtggaataccatgacagcgaataaggcattctgggagttcacggatggtactcttggcagaaacattgggcgtaggatgggcaaatccatatccagaataagtgcctattccattgaggacaaacctctgcctttgcatgatggaagaggtctgatataatcaacctgccaccaagaagctggctgatcaccctgaggaaggatgccagacggagggctcagtgttggtttctgctgctggcaaattgggcactcagcggtggctatagtcaggtcagtccatgttgctgagcctatgcataacctccattcctgccaccatggccactttgttcatgagcccattgagcgatgacagggtggctggggaaagaggctgagtggtgtacacagaatgagtcatcctatccacttgattattaaaatcctcctcagctgaggtcacccgttggtgagcactcacataggatacaaatatcttcacagtttttgaccactcagagaggtccatccacatacctcttccccagattactttgccaccaattttttaatcatgcttcttccaagtccctgaccatccagccaaaccattggctacagcacattaattagtatataattacacatctggccatttcttcttccaagcaagtgcacaaccaggtgccctgctcaaaattctgccccctgggaagacttccctttgctactgtccttcagggatgtcctagaaaggggctgtagtgctgcagctgtccacttttgggtgctacctgcatatcttgcagaatcatctgtgaaccaggccctagtcttctctgcctctgtcaactgatcatggggaactccctgtgaggccatcagtgcaggcttggggagagaaggcagggtggcaggagtggaggccatgggcgtttgagccacttcctcatgcaactgacttgtgcctttaggactggctcgagcctgatcatgtatataccacttacagttgatgatggaaggctgctgtgtatgcccaactttatggctagatgggtcagaaagcatccagttcatgaaaggcagtttaggttgcatggtgacttgatgacctacagtcaaacattcagtttctaccaaagcccagtaacaggccaagagttgtctctcaaatggagagtagtgatctgcagaagatggcagggccttgctccaaaatcctagaggcttccacctctaggagtcacctatgggagcctgccaaaggcttcaaacaggatccctgtctgccattgacacctcaaggactattggatctgctaggtcatacggcccaatcggcagagcagtttgcacagcagtctggacttgttgcagagcccacttaaaattggcagcctttcaggtcactcaataaatgggcccattttaacacacccaggaacaatgctttgcatccttcaatacaatcaagttggcactcagtattaaccatcacagtgaatgaatagattttctatgacgttgactccttggaatgaccaccagaggcaataagcacactctcagtgacacgaggatatgaggccctcctctgcccatttacactggaaatgtcttagatgtcttagtgcttttcaatcaggtatatccaaacaacaaacaaacaaataaaataagactaatgcagaatgaattccatagttcagattcttcaagataatggaaaattatcacataatctccacctgttttgaaacattatcttctttccttcctttcctccctttctccctttctctaagtcagtggaatagtctagtttaactttgatgtagaaaatttaggcagtcctcaacctctctaggtatgctgaattaaaaaaaaaaaagaatgacatttttaattcccatggcaaatggagttctcctctttcttctgttcctcttcttcaccttgcaatgactgtcattttgtaaaactttctctctgtctctgtctctcttactcacacatacactcacaatgttccttaatatcttctaatcctgaatttcctttctcaatttgtttagttagatcttcactagaaataagtattagaaattgggaaaagtttatactggttgtattagggttctccaaataaacagaactattaggagatggatagatagatagatacattgattgatagatgacagatagatgaatggatggataggtggataataggctggtagatgatagatggatgatagacagattagatagatagatagatagatagatagatagatagatagataatagattagatgatagacagaaagaataagagatttattatgaagaattggcttacgtgattatggaggctgcaaagtcccagtatctgtgagctgcagatccatgatatagttcactttgagtccaaaggccagagaatcacgggagctgatggtacaaaccacagttcaagaactagagagaaaatgagatgagatgtcccagctcaatctgtaaggcagaaaagaagggaaggaattcctcctttctttgctttttgttctattcagccctcaagagattgggtgatgcacagcaatattgaggagggcaatctcttttactgtcatccagaaacaccctcacagacacacccggaaataatgtttaatttaggtgcccatggccagtcaagttgacacatacaatttacaatgacactggccttcaactccagtgcacaatgtggtcttcctctttattctccaaattcaagttctcttacttgctacagttgtccatatttcttgggaaccatcattctaaaaaatgttgaccaggcctttcttaggcatttctaggaaaaataatataaaatacagaataaagtgaggggagttcagatataatgcatttctcatagaaaaaatgatagtgggatggttagtaaagaactgtgctgtgtaagcaagatgtaagctttaaacaaagtgaagaaaaggggagaagcctagaaaaaataacattatacagaaagagaatattcttaaatatgtcaacttctcttatagcaaatttcccagtgttcattcctaatacaaggagagtaaaaactccatagaaacctcaaaaagagctttttcttgcaatggggttaggtgtctaaggaataaacaggacttttgaaactttactcttatgtgacagatcagtgaggaggaaacacgctgataagaagcactgaactactacaaatacgcttcatttgctataaatacacttcattcactgaactataataaaattcacttcaaaaggaatgtgaacaaaatgaaagaacttggatataaaggggcaaaagtgaacaaaaagatagaaaatgtgtacaaatctaagtaagcattatggaaagcataatgataataattattaaatatgtggaattaaaaacaaagtggaactaaaacacaagagactaataaaatggaaaatggggcaggtagtcagttatttaataaaagtttttaatattcttgaattctggggaggaaagcaaaaagctaattaactttagttttcactaagaatatgtattaaacattgaaaaaaaatctggaaaaataaaattgacaatattcgagttctccagagaaacagaacaaattggaagtgtatatatacacagatatattatatattttaaagaattgactcatgagattgtggggtctggctgcagggaataggtgaatattgccgtcttgaatccaaaggcagtttggaggcagaatttcttcttcttcaggggacctcagtaattcttcttaaggcctctgactgttggatgaggttccccaacatcatggagggtgacctgctttactcaaagtctactgactgaaacgttaatcacatctaaaaaatacattcacagcaacatctagactgctgttttaccaaaaaccaagtaccatagcctagccaagtggatataaattaacgatcacaaacagctaaacattccaaacaagcagacagagagagaaaaaaataaagaaatgtgaaggggaggagaattttcaatcaattctggaaaagacaaaaaaagagaaaaagagaaacaaatcataaatataaaatataatggaattaaatccatatacaacaatcagggtaattatcaccagctgcctcaagaaataacccctgaaatctcacatgatggacataattcaagtttatgtctcacatcacaacacaatgtgagttataccaccttttgcatcttgtagtgacaccatacagtgtagcctccaaggcagggaagagaaaaaatgaagagacatgtaggcccctaccatactggctcatgaagcctggaccacgtctggtctgagtcattgaccagaagtagccgtgtgccccaagctaactgtaagggaggtctggaaaagtaggaggcacataggatatttgatgagcactaactatctctgcttcaggttgtcttcataataaatgcaaacattaaaattgacaggttactatgattttcatattggattaaaatgtctaaaacaaagggattcgtctatgtatgacttacacaaatactgcaaatcttaggggaacagaaagactgaaaatgagagataagatacactatgcaaactctaaccagaagaaagctggtatgctaccattaatagcaatcaaaaagactttaatttttttaaaagaattattaaggacaaagaaagtgatcatgatagaataaaaggaacaaggaaaactaaaaaattatgagcctgcaaggtcataataacaaagcctatggataaataaagataaatatatcagaatgagaacattttcatatatataatagggaatgattttaccatatctctcttaaaaagtgatagatcaagcaaagagacacagattttaaaagtaccttacacaagataacttaatggccttatagaactctatgtcaactagataattaattctacatgccccattcgatgaagtaactcatgaaacaaacaaaggaccacaacctagatcataaagcaagtatcagcaaatcctaatgatccaatagcatctagactacatcctcttatcataatgcaatacaattagaaattggtacaaaacaattgacaaaaagttttaaaataaaaaacatacttcaaagtaatccatggcttgagaaaaaaacacagtttaaatttacgaagtatttaataacagaatggaaataaaatttcacctcaaaatttgtgtgtgcaaataaagtggtaccaacaggaaaatgtacagtttggaatgcagatattaggcaagggtaagaactgatactaattatctaaggtttctgctcaagatgtttaaaaaagtacacagaaagaaataaaaataaaagcagaaattaatgacctaaggaaaggcattagacagggttgacaaaacagcaagttgattcttagaataaactagcaaataaacagaagacaagaacaattaagcaaagagagacaacacaaatgaataggatcaagaatgaaaaggggatcataactgtagatacattatagattgaaaaataaaaatggatatattggaggatatgcgcaattttattcaaacacatttgaatacttaggtgaagtaaacagtaagtttagagcaaaatttactcaaaaagaaatagtacacctgagaactataaccgttaaataaattgcatcagtagttaatacaacaaaataacaatatgtacaaaaatgtaaaggacccattatgcaatttgttcccaagaatggaaaaagaagaaaaatttcctcagcttattttatgaggctgatacaatcttgatggcaagccctacagaggacagtactacaaagaaaaactataggccagttatttaaatagagaagctacaaatgaaatattataaaacccagttcaaatgtacatattttaaagatctgtaaatatacagtaaaacattaacatttgccagatacagatgatgggaatagaggtgtctgtattaatttctaatcgtatctatcttatttcctacttaaatagtttaattaaaatgaacctcagaggagatagaaaatctgtcctgcaataaaatctgttctaaaataataaagaaaataggtctaaaatgggtctggaaatgaaacaacaaccctcatcctttacaccagcaagaagttctaaatttctttctttttctaaattcatgatgcatacatgttttaatttcttttaaatgatcagaggctgataattgcaagcaacaatcccctaacctaacttttctctcaactaagctcacagctccaggatcaacaattccaaatctttcaaatattcttcttttactacatctcttagtaatattattgtgccatcacgtatttcattaagtggggcattatctatttaattactgctatgatgaaggagatgtagttcacttacagaatatcacatcacattttcccacccttcagtttcccaatataggtacattactgtgcttagattcttcatttttaacctaatatactgagagcattatttcctgtataaatgatagactctgcactctttaagatgaagctatttatgtcctcattcttccctttagcttccttttttcctcgtcctctcagcttctacctctttaactttgatattgtgatggtcaataacatttacattttatctataaccataattgtgccatggcagaatacagaagtcccttctctgaagacattttattccttaaaggactccctttgattttttttcagtgggccatttgatgcttgattgccagttgctctgtgcagaagagaaggggtattttattccataaaataacttgcagtgaattattcctttttattttcacaactgactctcattctctaccttacctgttctttctgaggcctggccttctccaaattttttctatctccttgctggcatataccctatagtgcaagttgtgggtacaataactgcaaaagattgaggagcaggaactatctaaataaccatggtggctgggtgcagtgactcatgccggtaatcccagcactttgggaggctgaggtgggaagattgcttgagcccaggagtttgagaccagcctggacaacatggcgaaaccccatctctactaaaaatacaaaaattagccaggcatggtgacacatgcctgtaatccaggctactcaggaggctgaggtgggaggatcccctgagcctgggaagtcaaggctgcagtgagccaagatcatgccactgcactccagcctgcgtgacagagcaagaccttatctcacaaaaaagaaaataaaaggcccatggtggtgtggctaggaaagagtgccaaccctgtccaaagggaagctttctttgctgaaattatacactttctttctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcctgacctcgtgatccgcccgcccaaagtgctgggattacaggcgtgagccaccgcgcccggccgaaattatacactttctttgatcaacttctttttactccgtcatagttttattccccaccaatctcccccggacagtcactccattttacttagtctcttggtactattctcagaattcaaattttaaattaattaatctgtatttctgaagagctgtttgttttcttactgtatattttgctttctccatgggaaagatatgcttgggagcctcatgcagtcttggtgggagttatgtaaccactgggccagatatgtcagggcacacagcatggtgagccattccctggccagttccatcgcccagagccagaccctttgggccctacacagactgcacagccccagcatgtgggggcttgtataagggaagttctgatgtcacaggatccttggggtgtttcttcaccagctggaaacctctgtggccagtggcacctttgcctgagttttgctgaggtccactgggcacattccgcccactcagcctggcaggctacacttggctcacactaccactactgggctggatcccacacctgccaagggtgattcagggcagagtggcgaggggtgtgtgagtgagcgtgggctccagccactgtgcacagctaagcgtgccagctgcagtgggctgggcagctccaggtcctggctctatgtgaggctgtggctgaaccagacatactacaattggcttccaccactggtaccagggaatgcggtggcacccaggagcttggagatgccaggaaccacagagtctgaaagagggtctcacagccctggctcagggagtccataggtctcagctccccaaaaggccacagcccttctctcctgctcattgctgtcaacatggtgagctggggaagggggtgtgtttcaaccctgtttgtgttgtagctctctcatttccaccatttgcgggggggtcccaagttcttgtcccacatcctggaagaatgaggtttgcagacaactggagggttagcaaggtgaagaggtgctttattgagtgacagtgcaactctcaggaggcctgaaatgggtagctccgttccacaggcaggtaattccagcatctgtgcagcaccctcaacagaggtgagacacacagtgggtagctcctatccacaggtagatcatcctgttgtctgcccacgtctggctgagtccggggttttttatgggcctcagaggggaggaagtgtatgctgattggtccatgggtggccatgagctggcccaaaaaaagcaccataagttctcactccagtttgtggaaccgacagtccagcccccttccttcaggcagtccctggcttgaaggtggagcttcactgagggcccacccctttccacccaggaacctgtatgcctcctgccaccaccaacctgccatccacggcgcccactggcacccaggctgttcatgcctagggtcaccttcaggcccatgcagagccaccctcaactcccccttggcctccctaatgtgctccttggcacccaaaatccagaaggggccaagatagtagggggctagagtgtcagtgctgccccgagcatatgcacacctggctgggttgcaacagcctcagctttgctctgaaatcagcctgggtgccgggaacagtgagagaccaggaagaaggagcgggcacttctgagcctgtaggggaagagaggtggctgagggcacagggatgcctgggtccacagctggctgggtggctgcagctgcacccagtagggcagggttcccccaccttcaactcggaaggggacatggctcccacttgttcctggctcccaccagctctgtggagcacaaagccagacaggctgacactgccattactgagaccctcttgctctcagaagagttttcatcgcctgctccctctgttttcactgcttggtgactgtggtgttttgttttgttcctatttccttttctcagaaaagaaagtctttagaattaaaatttaagctgacaatagatcccctctccccagggagcagaaatatggatatccctaaaggtcttgagtgtttcggtctttcactattttatactcaatattccatgatttttatctagatatgcctggtggacaacaggtgatcgccaaatataggttgtccctcccatctccaaattctgatgctagaaatcaggaatggctatgatagtccagattttcagaattgataagatatttatattaccctaagagatacggaagttgaacagaataaaaaaattcaaaataaaagtaaataaaattactttctttccctgtttagtttgagatcatgtgtaaatatcagtgaacgtgatgtcatataggatttttttttattgatcagaattaggttcaagttgtgttctggaaacttctaattaaattgagggaagatgctagcaggccagaatttgggaattagatgatctggctccaaattcaatacatattgtctatgtaattagctgtgtcacctaatgtaccaataatgccttttcaagaaacactgtgcagtctgttctgattcctccattggcttaattcctataataaatatagtttccaaagtttataacttaattttcagaatttatttattttaattgacagataaaagtggtatatatttatcatgtacaacatgatgctttgaaataagtatacattgtggaatggctaaatcgaggtatttaaaaatatgcactacctcacatactggtcatttttctgtgttgagaacacttaaaatctactctcttagcaaagccatgctggctttagtgatttttttttttgtacatgatactctcatttgggtcaataatttttttaaaagtctattggaagcagagaaataaattttttgacccagccttagatgtatttaaaagttcagggcataaaatgatagatgtctcagggtttgtgtcatcagtcggaaacacagaactcttttgaacaatgccacaatgcaatctaagtttgatctaattttcttcaagacaataatgctcttggtgccatcctacctgctctttatgatttctacccgtaggtagaataatcaagaggtgagattgatgttgtttttgattctggacattaactagagggaaaattcgaagccctctaagaatggtatctaacttaatagacacctctccattacctttactcaaaactaagactctttgtggtatgggcccaccccacctctagtagccagctgctagtccagtgtctgtctcactgaagcagtctagtggtacacataggtactgagcaattatgtctgtcatgctgtaattgaggaaaaccatccttacttcattttatatttttgaatgctcccttgattgtccttcttggtgttcccataaagctaaaaattcacactcacgaattttaaattatcatgagcaatttgggggatttcctattttatcactgagtctcctttgagtgctcagctgctttcaatcttgacagatactcatctgacccatctaccacccttagggtatgctatgcgatgccagggacctacagccttttaagagatttttgaccaaagccgtctctttggggtgtttcttgactcattttttactcattatttaattttaataacctatagtacttaaaaatgtacagtactatataaagcaccttaaaaattgatgcatggtgattttcttattttaaaattgtgtatgattttttaaattattataaaagcagcttatgtctattatagaaaataggaaatacagaaaagcaagaagaagaaaatataaaatgtgcatacgagtaattacttttgtaatatcattgtatatctactcatatcttttcctatgcaaatagtttttctacaaatgggtgatatttatataactgtttcataacttactatgggaatgaacatcacatacgtattttaaaaaatattctcaaaaatatatttttaaaatgtatattgaactagattctgagaatttacatcattattatagtaagaacattatccttgattttgattcatagtctaacataccaaactctaaatttcttctgttactcactttacataaacacattgcagccagtcaccaacccttacatatatccctgcacagtttgagcagttttctttattgaaaatatttttaatttaaaatcattttaagttttatattatcttggcacattaacccctgtggaaatgtgtaagacttctcttctaaaataaattatttcataaagagagagagtaatagaataagtcataaaccatgctgatgaatttttagttactactgtctttaaaaagtaaacaaaaaaacagaaaataaatattttacatcttttacagccaactctttcaatgagttcaaaaatttcatctctaataaaaaagtaatttggggaacatttaggaaaaaagcaaaatatataaagcaatgtaaacaataacttttaaacttgcttgtttagaaaatcactggggtacaggttagtcagcctgataaactctaacttgccttcacacctccctcctccagcagagcctcctctgacagccaaacatctaggcatttctgtgttccattatggtaatgattgtctttttttataagtgactatatttgtttgtctttcctcttccctccactccagttccattagggaaggcatagtctttccattttgaatatttggtgcttgagataaataaaaagttttgttgggtaaataaatcaattcacttatctattaatcaatggcagtatgctttagcaagagtaattatgaatatctaataagtagtaggaagaggaaaactaacatgtattaaaatgcaattacatgccaagtcatctgttgaatcctaacagactttataatttcattttttcctgctataatgacgttttaaattatctcacattttcttaaacaattattaactaataaaaacatacagcaacttacataaaaatagactctgttttgcatgatatagttgaaatttttatataacttgtatatccatatgtatgaatatatatatatgtacacagactcagaaagagaataccaagaatttattgtttaaaaaaaaaaacctctaaaaagcaagaaacaaaatatcttgcaactcaaagaatctcatttatatttcacatatgctgtagacacagctcaggaactcagatgtgatgcttatgaatatgtataaagtataattagcttagaaaatgctgcttcatcacctgtcctgatattgttgatgtgcttcaataacttaccaagcaatgctggaaaaggttctctccaaattccagtgagttgaaacggtgcttttcacccataacatgttagtgttttccattcccttatcatgtgaaaagcctgtcctttaaacccagattgctggcagactgcttgtaactgacagttgtatgccataagctctttactttaatattttagagagcttcttgaaacattgaggcatgtcttttcctccaaatctcttgatttttaacctctcaattccacggtgcttgcatgaggtgactattctcttttctctggcctatactattacaataaccaattgatggctccttttttcccacacagctgcccaattcatcttcttggactacagctctgatcacactctcctactcagaaactttcaaggcctccaaattgctcattgcccagtttccttactcgcacattcaaaccttccagaaattgactctgacctgtctaatagccttacttctccacattgcccttgacgaaccctacaaacttagggagctgaaatactcgctctcacatccacacatcaaaagtccctgcctgcctccctgcctttccttatactatttctactatatcttctacattcctgtatatactacctgtctcctttcatctgagcaaggaatggttgactaaggatccaggaagaaatcactgacttcctaaaaagcagggaaaaaaaaattgcctggaagcaaagagcaggtgatattcagaaatgcaagaagatagaaaattagcaacacggaggtctgtatcagtacatagccttcagtcagggctgtcatgtttctggatgaaggtgcaagagccagtggaaaatcaatacattgataatcatccagccagactaatcagaaaaaaatcagaaaagtcaccaactaccaatatcaggaatacaagaggtgaaatcactacaacttctgcagatagtaaaggatgttaagaggatattatgaacaattttatggcaataattcaacaatttggataaaaagggcaaattctttgaaaatcacaaactaccaaaactcacagataaataatctgaatagttctatattcattagagaatttaatttgtagttcaaaaccttcacacacacaaattcagttccagatgactttacttgtgaattccaccaaatatttaatgaagaaataataaactctttcagaaaattgaagaggagaaaatacatccaacctcattctacgaggccagtattactctgataccaatggcagacaaagatagtttttaaaaaagaaaattatattatataacaatatccctccatgaacatagatgtaaaagttcatggcaaagttataacaaatcaaatctaatgatttactcaaaggattatacatgatcactaaatgatattaatgccaggatgtaagattggtttaatatttgaaattagtcagtgtaatttaccatatagcaaactaaaaagcaaactatataatcacctcaattgatacagcaaaggcatttgacaaaatgcgtctatttttttttaaaaactgcctactaagagtaggggaacttcactacctgatcactataaaaacctattttttaaaaaaacctaacagctaaaatcatacttagcacaagactaagattaggaagaaggcaaggatatctgcttccattacttccatttaacattgtactagagagactaaccagtacaaggggcaagaaaaaggaaataaatggcatccagattgaaaaataagtacaaatgtttttattcacagatactatagaagtctaagcataaaatcctggtggttcatgcctgtaaccctagtgctttaggaggctgaggcaggtggattgcttgaggccaagagtttgagactagctgggcaacatagcaagacctcatctctacaaccaaaaaaaaagtttaaaaagcataaaataaaatgctatctattaaaaaaaagttactagaactaataagtgagcttaccaatgttataaggtacaacatctatatgtgaaaatcagtcatttcaaagactggcaaggatacgttggaagttgaaattaaaaggttacagtttacaatagcattaaaaatgtaaaagaccccctacactgaatactctggagataaataaaagaaaatctaaataaatcaagagatataccatgttcatagatcagaagattcaatattcctataatcctagtttatacatattgacctacacattcaatgcaatcccagtaaaaatcctagcaaggttttttcctaaaaatttacagatatgttttacaattcatatggaattggaaaggagaaaaatgttggaaaggttatactacctgacttcaatacttactaccaagctatggtaatcagagaatgtggtgttggtatcaatattgacaaatagattattagaatagattaaagagtccagatatagatccagacatgtatggtcaaatgatttatgacaaaaatacaaaagcaatacaaggtatatttaacaaattctactagaggaattgaatatccatgaacaacaacaaaaaaaatgaacttcagtctgtatcttgcaccatattccaaaattaactcaaaagagatgctagacctaactgtaaaacataaaaatataaaacatctaaaaatatataagaaaaatctttgtgatcttgggtaaagcaaagattcttagatacaccaccaaaagcatatcctcaaaaggaaaacaaaattaacaacttaaatttcatcaaaattgagaacttcttcccttcaaaaaaaaaaaagcacttttaagaaaatgaaaagataactacaaactagtagaatatatttccaaattacatatctgataaaggacccatatccagattattcatatgtatcattcaaaactcaaaaataagagcaaataacccaagaaaatttgaacaaaagatttaaacaggtcaccaaagaaggtggaaaataagcatgtgaaaagatgctcaatgttattagtcataaggaaaacacaaagcaaaaccaaaatgatgaccagttagaatgtctaaaattttaaaagacaggttataccaagtatcaacaaagatgtaggcacatgcagctctcatacactggtgatgggaatataaatagttcagatactttagaaaacaggttgataatttcttaaaaacgtaaacataaattaccatatgatccagccattctgcttctgtgtatttactccaagataaatgatggcatatgttcacccaaaaatttgtacacagatgtgtacatatccctatgatgaaataattaccaataaaaaggatcaaatatggatacacacacaacatagataaatgttgaaactatgttgagtgaaagaagccagacaaaaagagagtacatgcagaatgtttccatttgtataaaattctatgaaatgcaaacctacagtgatggaaagcagatcagtatttgtctggggacagagggaagagaaggaaggatagaagaaagagattcaaaagaaatgatggatatattctctaccatggttgtggtaatggtctcatgggtgtacatattcaaaacttatccaattgtaaattggtttgcatggtttatttatgccagttttaactcaataaaagtattaaacagtattagtcatctctggtcatagtccctccacaatttccacaacttagattttagcctctttcactgttgtttgggccatcttcctcttttctctcttaccaattccatttattttcttttttaaattctttttacttttttttaatttttgaaacttgtattttaggttcaaaggtacatgtgcaggttttttatataggtaaactcttgtcatggaggtttgttgtatagatttcatcacgcaggaactaagtctactacccaatagttatttttctctgtttctctccctcctcccactagctaccctcaagtaggcctcggtgtatgttgttctcccctttgtgtccatatgttctcatcatttagctcccacttataaatgagaacatgctgtatttgattttctgttcctgcattagtttgctaagaataatggcctccaactccatccatgttcctgcaaaggacatgattgcattcgttttatgactgcatagtattccatggtgtatatgtaccacattttatttatccagtctgccgctgatgctattccttattttcttatgctcagcaaatcaaccttttctctccactttaatcctgtgcctcactttgcacacctgaagttagctttaaaattatgacttttaaatgcttgtcagattacattcttacaaaaaggtattcacactccaaggcactggggaaagctgttttctttttttgtctagtttcatctagtactataaatggcctatattatcttgacaattcaggattgtattatcatccttggttattttaccacaataaggttggcatctactgagacctactttacctctatacattttatccctttccaaattgactcagactcctgagcttcaaaaattcctctctccactttttagagttttctcttctctttgctcattgtcggacagattgtcagctgtcacttctgctgttttcatgtgtttgtttagagaatcttcacacattctttcattgtaatttcctgtctctaaattgttttgattcagaaaacctataaccaagggagtaaaaatgacgtgtaaatttggaacaaatatagaatctgagtgggtaacctgaggcttacttcgtgagttaaagtacattgcatctgtgtcattaattttgacactcttttttttttttccaagatgaatgacacttatgtgatgttactgtatctaattcccaagagaactgtagcaatgagaattcctgtttttcccagcagaaaacatcatcagttttctggagaataatttgccaaggttgtcttttgcaagaactatgttcagtgttcttttttatttatgtagatgtttccaatatatctttttgtagatatgatagcattgtacaatcaatctgttctatgagcaatcaattatttacctgaaagctgttagaataatacattaaaataaatttgaccacagccataccaagttctgtaatcttttctagtttaatgttcaaataatgtgactgataaaaataatgtaactaaggcagtccagatgcctttaacgagtgttatgtctgtgataatctgagttcagatttatatcttcaacagtaagtatttagcactctccaacccttcttgcacttgcaatacttttccaatttaaaatttacacataagatcctgtttgatttatctcttggtatatatgaattatgtaatgattgctgaggagcaaacactattaaaatgggtaactagacattcaagttaaacattccttttcccatatcattctattaactttgtgtcaccttttttaatctgagtctaaacaaatatatctttgcttggagataattgtggctcagagattgtcatttagaagattgtgttttgccataccgctttaagatgcattttttaaaagaagcagtgttctttctcatttcagcacttgggagatacaggaaatgctcccctctcagtccacaactagagtgaaatttgcttaaggataaagtcaggggatgtgtttagttcttaatttgcttgacttctgtagcacgtcataatgctgctcagttatgtccttacaacaccgccagttatcatgcatcgagtcacttctgcatctcttaatttccatagtgttatgctctcctaatttctccttttcctctgtggaatgccagtcaccttgccagctccactttctctgcctactccctaaacattgaagttcctaagaactctgttctagatcttcttctcataccgtaataaacagtctcctaactttaactaccgaatatgtgctaataatttacaattctatatctgcagcccagagctctttcctaaaggcaaactctgtgtaccaactgccttctggatccctccactccattattctatggttttagatgtatgacatttgtttttctgtccacaggcaacaggtcctcggggtttattaaaggaagatgccaaaggctgtcttcagaaaagcttcaggattcttaacgaagccaagaagttagcaaatgatgtaaaaggtcagtgtggccatagtttttattatattccagttaatcgggttgttactgataagatattctatcacactattggagaatgtaatttctttagcatgatttttgtgatgattctataatctatttaatgcaagtaaactttctcactagttttacaaaatgttgtctacctatctcacttcaagtagggtaatatctcataatttgtaagtcttatttctatagcatcacttcacctatatctaatgtatagtaacttttagtgtaataagtttttaagagtatcaaacccaggccagccatagtggctcacacctgtgattctagtgcttagggaggccgaggcaggaggatcccttggtgccaagaatttgagaccagccggggaaacatagcaagatcctgtctctacaaaacattttttaaaaatttagtcaggtgtagcagcgtgagcacataggcatagctacttggaaggctgagccaggaggatcgctttagcccaggggcgtgaagttaccgtgagttgtgatcacactactgtacaccagcctgggtaacagagtaagatcctgtctctaaaaagaaaaacaaaattaaatacatttttctttttctgagatgaagtctcgctctgtcaaccaggctggagtgcagtggtgcgatcttggctcactgcagcctctgtctcccaggttcaagtgattgtcctgcctcatatctgggattacaggtgcatgccaccacacctggctaatctttgcattttgagtagagacagggtttcaccatgttgaccaggctggtcttgaactcctgacctcaagtgatcctcccgcctcggcctcccaaagtgctgagattacagatgtgagccaccgtgcccggccctaaatacatttttcttgtattttatttctgattcaggaatcaaaatgcacaaaatatctactgccatattatgggttttatgttaagaatatatcattaaacatggctgctctctatatgagccattacaattattattttatgcacttatctcttgtctcccatttgaattgccacctgtttctctcttcagtttcattccctaccattttctgtctcatatctgtctccctacccttacctaagtattcataattcctcccaaacatgctactattccaagccttcatgttttcagtattatttcttccccttggaatgccccatccttcacctctcttctttgcctaactgctttcttccagaccttcaggatttagttcaaatgccatcatttccaggaaacctaacacctcatctgatttacatgccccctctctggtatagttttctcataggcttgtcaaaccaccacaatcatggactaattaatattccatcttcttttacaatttttaaaacttttttattgatgcataacagatgtataaatttttggcattccatcttcttgaggaaagacatggggttttgctaactgtgtatttctagtatgcataatagtgactagctcaaatgaggaaatacttattttttacaataaatggtgttggcttatcttacttatcttagaaagagaagaggttttaaaatcatttatatttggcatgttttggtctcagtagaagctgatatgaaattacaagttctatctcgattataagtaaaattttaatagtacaattcttcaggctgtgtattacaggtgaaataaaactccctacacacataattctgctcagcaggtacctcttattacaatctgaagaatgactgtaagaagccaaaacctgtgttcctattggacaaatggactcaatcccgtgactttgcggtcactccttcctatctcatacccttgcccagggctgggaatagggaggaagggagcgaggtgattcatgcaagtgcaagaaccaatcctgtctttaagattttaataataccagggccgtgccctcgcctctatttccccacaaacactggtattataaaaatgaagaaagaattttattttcagccattttttttccaagagaaaaagaaatctaaagacaagcattgtaggaagggttaggagacagaaatgttcattagtttaaatttattttttttgtagttcaggtagtacattatttaaagtaatgaaaacccacaaactactcaagtaataattcctctagaaaaccaagccaaggctatgacggagatgggaatgttttcttgctacattatgacatttctctgatttgtggccaattacggaggttataaaatggctgttaatcagggaaatgccatatattactaccaggaactgctgaaataggccctacagagcaaaactcttgacagcagctattaaaatagagatttagtcatttctctctctatggtgcctggagttagaaggaataaaaatggtgaggccagtataccctccatatttctaatttgttgcttggttcaattcagtacagttcagttagtttgtgagcttcagtcatgaatgacttagtactgctccctgccatttttatgctgtccttgccttgagggaatctgaacttgccgggagcaatttgttttgctttttaatttttgaatatacatctgttaaaagtaaatttgcccttgtgtgagtttgagatttgaagcctgtctacattgcactgatcgaatgtttgtggagataaaaagtattttgttgatggatatgaggcttggtacaaattgatgactgaaagagtgaaaagatgaattagtaccaccaggtgaatgaacactgctttgcagatagacaagaaattttttaaggccgggcgcagtggctcatgccctgtaattccagcattttgggaggccgaggcaggcagagaagtgggagaataacttgagcccaggaggcagaggttgcagtgagccaagatcgctccattgcactctagcctgggtgacagagtgagagcctgtctcaaataataattaattaattaataataaaaatttaaaataatttttttcagtaaaatgccaacttcattttctcatggaatgtgtacgaggcaaggaagaagtagaccttggtttattaaaagtttgagaatattaagattttaaaattatacatcttaccttatattgactaacttttcagttttatttccttcttaatttatccccaatttttgtctttgcccaagataaatgaaattatttaattacttagaaaaataataggtaacatgttggccaggtgcggtggctcgcacctgtaatcctaacacttcgggagaccgaggtgggcagatcacctgaggtaaggagtttgagaccagcatggccagcgtggtgaaaccctgtctctactaaaaacgcaaaaattagctgggcatggtggtgggtgcctgtaatcccagctactcaggaggctgaggtaggagaattgctggaacccaggatacggaggttacagtgagctgagattgcgccactgcacttcagcctgggcaacagagtgagactctatctaaaaaaaaaaaaaaaaaactaggtaacatacctataaaatagataacacaggaaataaaaagacctattccctggagatctatgacagctcattttaaaggaggcggtttgtctcatagcactgtagcctgtggtatataattacagttaacccttgaccaatgcaggggttggagagcatggacccctgcacagttgaaaatccatgtataacattagactcttcataaacttcataactaaacttcataacataaactttataaactaaaaaaagaatctattcccaagcccaaataatgaatcagtgcattgcttgacatatggtgctgtcccacacagagaacagtatgaaacattattccaatcattaagttttatcaaaccagttgaagccttccttctatacagtggtcctccaaacactcagtcattccgttcagacaagtgggtcttgaagattctgagatcatggatgtaatacacttgcaaacgctaacctgttgagattctgtgttattattttatattttaaaaataagagaataaactggaatactgcagtgctgctaaaccaaagtatgatataggagtgcaattgtgactaagggatccttttattattaaagatatactccttttgaatttgcatattaccctttgcctgaatcagcctttccatagcaggcatgcaaaagacaagcaaaatctgctctattgaccacaattttagactaaaaggatgaaattaagcctgggtcccctggcctactgtggtctggagaacaaagcagtcttttccaggtgaaattgctgatccctcatacaaagttttgattcctcctttagagtgtgaatggtggaaataaaaaaataaaaccagggtggacttccattagagaaaaaacaataagtggcaaaatagtggcaaatatagaggggcaggttctattggaaagattatccctaagagcgagacgtagcttgtcatatccaaccccaccatgtgagtagaggacaagaaacaaacattcagaacactcctgtatatcatctcagcaagagacaaaggcctgtgcaataaaaatggggcttagagctaaaaacttatctgggctttgttgtgtgttcagaatcagagtctgagattctatggcgttttttgcaagtaagttaatttagaccagaaataaacagaaatgccttcaagagacttacagataacataaagggatggtggggcctgtgttaaaccaaagactatttgtcttatttaaaggtattcaaactcaattttcttgctgggcaaaagaaaacaagcctgcaagcccacagtcaccatgtcctagaggagccaaatgcaggtgttgatgtctggtggttttagtttttcattccactggctgcagaggggactcccttttatcccaatatcctgaatctttgcagaacctgctaccagacaagtacaccttccctcctttcctgaagctcctactatgaccccctagtgggaggaagagcatatgcaagcatggtgcttattgcgaacaagatctaatttcttactttcagatcagaagagggtttctccataacctgactccctgtgaaacagtcatctctgaggttcccatatgtggtcactctagtatgtatgtctgtctgtgcagaataagtaatcagatatacagcacatcccaaacttgtgacagctactagggaaagggaagcacaggagtaacaatcatgaaagaaggctagaaatataaaggttcaggaaatgataccgttccgaatcattgtcaccaaattcaatgattgcctgcataatgcagaaaattggagggattttttctaagaagtacaaagattgggtgtagcaaccttatcaaatcaatttgctggagacctaggagagaaatacagttgtagatttcaacttctattcttcctcactcgggtgctcttctttcctacccaggtctcaagatcctgcactgggtatttaggttgacttaggggacagggtctttagaaatctcaagaagccaaaatctgaacacagtcacttatgcctgtaatcccaggtcctttcaaaagtaatcacatttccatgaatttcacccttgtgaatggggcattctttcagggcatttatttgtgccctattcatattaataaaaaataaaaattccatttgagaaactcaactggatggaatttgaatagtcaaattaaacatttccattaaaatttataaaaatcgtcccgatatttagttgaaaagtgaggaatatatacataggtatacatatgtttaggaaatataaaaacgaaataaacttaggttctggaccaagtaatttaaataaaaaaggaataaagtcataaatagcattattataataaaaactggtaaaacacaccaggacaattttcaaaccaatgtcagtgtgttaccttttacttactgcctatggtaaatccagcactttctcatacatctcccagtttatttctcatatcagtcacatgaaggaagatgttttctttatttgccatatgtaaaaagggacagaaatgacatttgaacccacatcttccaactctgtgtcctatagtgatttcattgtaccagactagatttcagagaaatactgtgtagcagttttattttgagatcgtacatagttagttctaatataactaagccctaatttatatttagcatcatgtcagaaacatgataaacaagagtaactgctcattattaatgcaagtgacttgcaactctgccctgcgatttttattctggatatatctatcttgtgccatttcaatgggcatgtgacaaaggaaaattacactgtcattgtgttcccagtcgacccttgctactctgctgcttccattccctcattgtgagtcctgcttttgccaaactaattctagcacatttttcttctactctatgaggaggagatgagaaagggagagccagacttaaagacgtatgtgtgtgtagcctttgagttttggtggatgtgatctttagagagaaagtagaatgactaggcttctgttattgggtttgagagctgaaggaataaggagagggaatctagaaaataaaactatggattataaattaaatcttcttcttattctccagaaatcacaagtaaaaaaattcagttggattttcttttaactatcgataattctatgtcttcacccttgttacaattcaaactgaatcacaagagttctttcttacttttagttatggatacactatgcctcctctgtcttttatttaaaatcagcccaggagtgcttatttttctaggttttcctcgctattattttgtaagttccattttgaaatctgcaattcttctctgaatagcttctactcatctaattctatcaccaaagctacaaaatgtttagatgtagttcaagaaattccagaaactactttagaaaaaggtgatcagcgtaagaaagggcaaattaataaggatcagagtcaagcagctgaaacattaaaaaaaaatcagaacagggttggaatatacacattgtaacttgctagtacaaaaaaaaaatgcagagaatcaaaattagcgctttggaacttgagaggcagcagtaaaaatattcttcaggtcagtcttctgaataattggcccagttgttcagccagcattttgctatcagaatgcagaaagtggtataaacccagggatacccttcaaattaatgatctttctcaccatacatgaatatcttgcttgccagaacatttgaatgctccattattttaaaaactaaatccaatcaagaagctaagaaatgaaatttctacagttccattttcttaagtgttgaagactttcaagctaatatcaaaagagcagccctttattctcaaagaatttgtatagatatcacagtcataatcagactggctttatttcagagagtatgcttttggtagcctatccaaagattttattttagtataaacagtaaaaataacagaagtattataagaaagatgaattgtgattgacagaggagaaaatccaattacttggaaagtatattttgtgggcttagaattgaaaataataatatattagtgactgaactagacatattgatgttttagagccgtgctttgctggaatattttatgctttgtttttcagtgatgtcaggtctttggcttggaatttaacaacagacactttaaacaatgttatgtgcttatattagtataatctgtagtataacagaagtttaaggtgtctgcctataaaaccctttatatgaagtggagtgaatcattaattaatatgtcccgtactcttcttcacatccagacaccgatagttcagaatcctccatctatccacctttccctttgctattcttcacagatgcaggccaacaaagatgaggatagttctccagctgcccatggcctgcacagttcctctaatgagccacatgcacaacctctgagaggggtgtgcacacagtcaaatcaagactgctgtagctctattctttggggcgtattctctcccacctgccttctctgggtaccaggaaagtgatgaaaatcagtcttggtgttgacaaataacatgaagatagcaaataacattcttccccagttaggtggtttaagttttttaaaacattgaaaaacagaaatatatgcacacagaaagcaatttagccagcacaaccgggtataaaatgagaagttttagtacattgtccctcacggcactattaactgcctcattcattcccagtttctacccactattaattactgtaaaggtttttggcatgttcttctctacccagctcccaccagcccctaccatgccaaatgcttgtatatgtgtcagcatatatatggtgcatcttgcttattttcatggaaaggtcttaaggtttatttcacatccatatccgctcatctacttctttttatagattgcacctgtaccattgtatgaacatgctgtgtggatataaacagcactttaatcttattagggtatttttattcccccctccttttttttattacaaatgaagagctaatgagtatccccaaagataaatcttttacaggtatattgaagggtaaatttctatcagtagaattgccaaaccaaatacatgtctatttaaaattctaataaacttattaacttgctcttcaaacaatggaatcaatctgcacgtccactagcactcttgtgaacacttggcattatcatacatttaattttccccaatctcaaaaataagaaatgacatcttactgttgcttagttttacagttctttatgataatcttgagtgctttttacgaatttcataaatgattatgtatgtttattttattgtgaactacgtattcttatattttcctcattatccttaaaaatatggaacactttgcatatttgcctgccagttttgcacatagacaatgctattctactctgaataattacaacttggttatatatgttgcttaggtgaggcttctctgatttctgtaactgtgaccaatttctttaagacaacaaaggagaaaatgagaggaagacaaaggaaaggaggaggacaggaagaaaaggttgagggtgatggtgggaggagcattgctacccaaaatgctctactaatccctagttttgactatcaatccttggtagaatgcagtagttagcattgtttatggaatgggactatgtggatttgaataccaccactgccatttattaaccatgcaagcttaggaaatttactcaacttctctaagtctcaatttcctcatttgtaaattggagataatagtagtatatacatcatcatatacatcatacatcaatgttattgtaaggattaagtaaaacaacccactgaaactgaagaacactaaatgcgtgtaacatacacattcaatgcttgtcaggcattactcttactaaatacttgtccatcctatccaggagggactagaacaacttctctttcttggtcctttctcagtggtcctcctcacttggggactctgtcttgtatttacatgttgcatttctgtggagctaatttaaacaattagtacgcatgtcccaaaacaatttttatggcataagaaactattaaaaatttacctaaaaaatgagctgttgtatccagtcaagagaggtaaataatattgtgggaagtataggatttttcatattttgttttttcaatttgaattttcactaataaatgatgtaagaaaaagaagacagatgaactccatttcagtcttaagatatatttgcagtttaatgcatacctgagtaagatttctaaacttatatcaacagattggatctttattttctttccccttaatgatttcaaattttactctttatattgttgtactcgaatttaaactgcttagttactattacaatataaattaatctaaagtttagagaatattaaaaactagtggaaagcagctagaaaacttatatatgtaatattaaattatctctagcaaatggcatttttgaatattaaagataacattgctaaagtatcaagagaaaaaaactatataaaatttattggacccaatttgtaaaaatattgttttctttatgagaaaaatgactattatcagatatgtgctaaatgttgtttttccatttctttaatgtgtatttttgtccaaataaatattaacaaatattattatactgaagttggaggattctgctaaacaatcatatctgagattttgaaaatctaatccaatgattcattttggtaataaaagtttttaaataagtggaatcaatgggagtgataacaagagggcataattacaaatggaataaaagactaattctttggaggtttcttctctataggaagatatcaaattaagtcagataaagatcagataccaagaagaaaatgtcattgttcaacatgtagaagcatccaataattcaatgataataaaaacacatatttttaaaatatgattggaaatatatttatgtatagatgccaataaattaaatacattttcttgcttttaattaattttatattaaaataacctgaaattgcacatccaagtataagctcagggatgataaaacttatttaatccttttttttgttttttattcgcagaaaatgaagaccatctaaatggcttaaaaaccaggatagaaaatgctgatgctagaaatggggatctcttgagaactttgaatgacactttgggaaagttatcagctattccaaatggtaagcattcaggacactaccaactgtgtcagttgacctgaagttttgaagactgttgttaacttttaccatttttttctaagattattctggtactattatctggaaattagatactgtttttcttactcatgaattcttctttgtgagaatgagaaactaaaccatactttgcattatggtattttttatcttttattgcctttagccagtatccttaggaatgtgttacagaaaggaagatatagacatcttattattataaaactcatccttcagtattggcaggggattggttccaggacccccccccacagatatcaaaattcttgaatactcaagtcccttttataaaatggcatagtatttgcatataacctatgcatagcctcccatatactttaatccctagatcatttataatacctaatataatgtaaatgctatgtaaattcttacagtgtattgtttatgaaataatgacaagaaaaaagtttgtccatgttcagtacagacacaaccattttttcccctaaatatccaaatatccaactctccaaggttggttgaatttacagatacagagcccactgacacagagggacaactgtattgtcttctgtgtttcagcccaagaaatcgtgtattagtgaaatagaataaatcacatagacactaatctctaaaatactgatgtaccaccacaaagacacagtttattaaagtacctgcagtaataggtgatagcccactgcattctctcttgataaaattcaatttctttaactattccaactttcaaaaacattagtggtcaaaccatgtctgtaatatctttctacctattagaactgctggaaatttttgcatggtattagttcctgaaagcacacgttattttaaagatactacttttactatttttatattgttaaagcatgatataataacaacaaagattataaacacttattgagtacttaatatacttatgttaagtgtatgtaatcctcataccaattggagcaaaaacatttgcttcatttgcttgcatcaattggtcatatatatatatatatatatatatctatctcaattggttatatagataacataagtatagataacataggtaacattcagaatagtcacttcactactttaagagctaattaggtattcatacagatacagaacctactgacacagaaggacaacttgtcttctgtgtataacataagttagcactaacacttaacatcagttaagatactgttattatccccactttacaggtgagaaacagacagaggatactgaaggccattgttaaaagtggcacagaggaaacttaaaccccacagtttgatttcagagcctatgatcttaaccactaacctatacacactagtagtcatctataggtacaatatacaaattaggatcaggagacaaatgcacatatttatacaacacagttaatattaaaatctcggtggtttttacttttttaacgtttaaaaacctgagtaacttttcagattttcatgtccctttttcagtagtaagtatatagaaaatttccaatgctgaaaacaagtataaatgcatggcctaacatacctgaaaatgtttctctatcctaaaatgaaaatacgttagtttccctccaacccccaccccaacccctgccctgctttggaaatgcagattaaatcttaagcctcgttttcatgaagctcatgtggataaatttatctcgtgaataagttcagcagcaaatcacaatatgatcttatacaatgaacatttagaatagtcacgtcactactttaagagctaatcaggtattcatagcaaaagtccctgagaaaatttaatttacctaaaaaaatttgcttcatttgctacacctgaatgagacaaagttcagccttttccctttgtaaatgtgtccgaggtcagccagccacagcctcgctttgtcaagcatggattaagccactaactccacaccctttgttttgtttttcataccctcatctgctgacagatacagctgctaaactgcaagctgttaaggacaaagccagacaagccaacgacacagctaaagatgtactggcacagattacagagctccaccagaacctcgatggcctgaagaagaattacaataaactagcagacagcgtcgccaaaacgaatgctgtggttaaagatccttccaagaacagtaagatctcctttttcattgtgatgatgtcatttatttcctctcactgtaaaagtatcccagacctgtaaatgctcgagttggaaagaccctcatggtggtgtagtctgccttccttctttcatagattggcctcagaaattgagtgtcatgcagttccaaagctggaatccaagtcttctagctctgccccggtgcttttttcctctgaaatttttccagttgagaagagattaggaattctcaaggtgtgcctaacattcagcagagagatgcaaaacactttttaatccgtgtgtgtaattaaaaacacagttgtacttgggtaattatatcctcagaactggcgaagtgtcatggaacatagaggttaaggggcacgttcatgaacagacttgttagaacaggatatgaaaatgatatcaacttgaaatgcattaaaatttgaaaatcttgatattttattatttagattccagttacatcacatttctgggaaataaaaataaagcatttatctagtttctaaagactattcacatctcttatatattatataaaattatattgacttaaggatttactgagaaaacctgagagaaaatatcataacttatattattagttaaatatagtcaaaatattaagattttaaaatgcatttttccttttccgtcaaatgatacaaggctatattgggccaggtacagtggttaacacctgtaatctttgcactttgggagcctgaggcgagaggatcacttgagcctaggaattcgagaccagcctgggcaccatagcaagaccccatctttacaaaaaatttaaaaaatagccaggcatggtagtgacattgcacctgtgttcccagccacttgggagtctgaggctggaggatcccttgaacccagaagggtgaggctgcagtgagctgtgatcacgccactgcactccagcctgggtggcagattgagatgctgtctcaaaaaaaaaaaagggggttatcttggtatccttgttacatggtttcaccaaaggagatgcttgggtaatctgtgcttttcactttcaagagactagccctctttatatgccaacatttttgggggggtatcaaaatatttggagtataaaaacaaaagcactgtaattggtattatatgccataaaattcaaatgctgtttgagtggggaatggagcctgatttcagcatcctagcctcaaatcaaatcctatggatgctatgatataatagacattattaatacgactccttcatgagcaaggaagagtacaaacacatataacataaacttcagagccagggtgaaaaaggggagataaaaacattttttaaaattttttaatgtaagcccagaaatggcttctcttgtagctcaaagtttacataataacttcttatgatttatgccaaatcacaatattcccactaaaaatgaatgaaaacaaaattttaatcaaatattactatctctgctgcttacttcataatttaagatatatttttaacttttattttaagttcaggcgtataagtgcaggtttgttacataggtaaacctgtgtcatgggggtttgttttatgaattatttatttcatcacgcatgtattaagcctagtacccattagttatttttcctgaccctctccctcctcctgctctccaccctccaaaagaattccattctattttagattgattctcaactggtagtggccttttgtcatatctctgttttaatcctatcctctattatgagaaatagttaattatctataaatattaattaaattgggtctgttttctatcttactaaaacatagaaataatttttaaaatacaaatagtggccactaaattatatattttgtgtacttttatttgataacaattgcttcagttaaaatggggtgcatttataattagtacctgttatgaaaaataccatttttagtcactactttataatatttatagaaaatacttcctcatgaatttataatttttttttgttttgcttccatgtgaaattgcctgcagaaatcagtacgtatatgtttacttatataccttttagtaacgctcatgcttcattgcctattgcaaaaagtttcagctttgcatgtactatattttggttttgctttaaacattgcgtagctattctttccactgttacagtattaatggtagatgcgtaaaaggaatcttcctttataaaaaggtcatatgtggataaaggtgatataaaatgtttttaatagtgttataaaaagtttggtcaggcgaagtggctcatactctaaccccagaaatttgggaggtcaaggtgggaggatcacttgaggccagaagtttgagatcagcctgggaaacatagcaagactctatctctacaaaaaggaaaaatgagtgaaatatctgtatgatagccacataaaagtggaaaactgaatttctctatagaattaactagattatgctgtttctgataacacaaattcaccccaacacacgaatgacttaattgcaagaggattaaaatagataaggtctacactgttgttgtttttacccactgaagctcactttttcctctccttgtaattattctcaacttctgtagaattatatttggagaaacacataataaaactaggtcttaacaaatgaacaactactgggatatcaaaatgttctctcttaaacatcccacagtttaaattgaaagtcaagaaaaactaaaaaaatagctacaaaaaataataacaagaataacaaaatttaatatatcactatttgaaaaatatgaccaagagtgtcctcagcggaaaatgagagcaactacattactaaaccatcattgaaataacaattctaaacaatcaactttgctgactttagaaaaagcagagttaacttaaagaatgaaaaagatggaaaaattaatgaatttgaagacagaaaatattagacctgataaatcaaaaaggtgactccttaggaatatagattaaaaattaagtgattgtcaagtttcatcaagaaaaataaaggacaaataggcaaagctctaaaagaggtatcactagacaagggaggaaatttaacacataagagatcacttggaaaaacttcaactgctccggagaatagaggaaaaagaggggagaagaggaacttccaagttccattttgaaacatttggcaaaaacttctgagaacttgtgaataaaagggtctgtaatttgcctaagtctaagtagtctttaactacttttgctctttctcattaatctaaatctaaatcattttgcctcagttttagaataatttgtagaatgtcagaataacaatggagaattaaaggaagggaaaaatgaacaaacggtttattaaaagcatacaaaataaagggatcactgtgtttatgctatctgtatgatgatataacaaacatttctatccagataacatgcatttcaggaagaaaatactgcactcagttcttgatatagcaaatctattagttaaatttaataatagacctatgttctttttaaatgccgctaacagcataagtcatacttatgagttcaaaatacctactttaaaacctaattttaaaaaaatgataatttacttccctttgagcacatgtgattcgttcctgagggttagttctcagtggttgtatgtcagccgcaaagcagatcattcagagtctaacacagcatgtagccttgaaccttaagcagtttaactttttcatcagagtcacagtgacagaaagttgaacaatacacacttaatcagataataaatgacatagtgtggatgagactgccagcatcccagcaatagaataagtggtttaccacgtggcataggccctcccttgaaaagcacatactgaaagtctatggatcagtgatgaccttcaactattttagggttgaaactttgaaattgccaatatgtaaccctttattttttttaacctacaaaaacagctgtttaatataggtcaacctaatatgtaacacagggtaatcaactattcttcaaaatgaaattgaactgcaccatgaaagatttaattaaatgtaggcctttagtctaagggtttttcaacatcaaaatgttcttcaaaagacattttgatagcttctctctttaagatgtgcaaaaaaagacggtgagaaaaagaaagaaaaccaattttgtgtaaaaaccctgatttaaatacagttctggcttggacagactaggtgacattttaaagatgctttcatttccttgcttctgtgactaaagttctattctgtaaaggttaactttttggctgaagttagaaattaagcattgaattaagttcttcatattctctaccttcaatgctaatttttaccttaatcaaaaagaaaaagtggtggccctctgtcctaacatctactcccctggcctgcttgagtctcaactaaaatattgacatttgccatcacacattttgctttagctgttatggccatgctttgtcacattaataagatgaaattgtttggttaagcatactgctattctaattctgtgtgtgcacgtgtgtgcatgcatatacatgcacactaattttgttctatgcagttgccgatgcagatgccactgtcaaaaatttagaacaggaagctgaccggctaatagataaactcaaacccatcaaggaacttgaggataacctaaagaaaaacatctctgagataaaggaattgataaaccaagctcggaaacaagccaattctgtaagttctttttatcgtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaaccaaaaaaaaaggccaactaatggggttatggcaggaatgaaggaacaatatacagaataagagcaaagagaaacaaacattttacatatatattcttttgtctggtataaacaacaataaaaatggctttggttatactttttacatttattttttgttttggagtagataggaaatagctgatttgtctcaaaattttgctctttacttacccaattagaagtttactaggatagaaacagagctttctagaaggtagcatgctaatgagccagggcagagttgctaagtggcaacgtgaaactttagtcaaaggaaggaagtaagggaaggggaggagaggggaggggaggggaggggaggcgaggggaggggaggggaggggaggggaggggaggggaggggtggtagaaagaaagaaggaagggcagttttcttgtttgaacaagaaaggcttgaactcaaacctttttagatacctcagttttccatgtcaaaaattctgttttttgaacaactttggaactaggatgatcagaaaagccctttcttagttcatcagtttatatttttagtagtatttaagaatacgatgctccagtaacagcatattctttttcctccttattcacatctaacacttctaaacaactccaagacagtaagttcaaggtgaacattgaaaaggaattcacgactgactgaaaaaaaacctagaaaacaacaaaaagattagtgaagatgatgttacataagatcagagtagtaaatcagtgaaaagatctgagaaaacatatattcagctagaatatgaaagccaggcagtatcgttgacatgtgatcattatgtatgtaaagcacaagattaaaagaaaccagatgttacttcaaggtttgaagttttatgtaagatttagccaacatggaaaaagcctctactatgttcagtgttactttccgtaaggtacacaaagacgaataaaggagttctttcactcacaaagtttataaaatagtagggaaaataaaatatgtacacgtaccttgtcacacaatgcagaatgttatgccacattatagaagccgtgagaagtgacataaaagttctagaaagaacaatcacctctagtagggcctgaagatttcctgaagggaaggatttgagccaggcattgaggtgggatagtgctggggagttgggggtggagtcaggtaacagggagagtattctgagaagagggaatgacttaaaccaaggcagtgggagaaggaagttttagggtccatttaggaaaaagaagtccagtttgcccagagtaattgataaaggaaacacataaccagaaagatcaacagaggccaggtctcgtcaggccttcaataatcagttaagcaatttcatttaacaacactggtacttgggataagcctcactggttaggataagctgaaagctttgagcatggaacacagtataatcagagctgtgctttttaaatataaatccagaagcagtgtatggggtagatgaaagaaagaagaatgaaggacccaactatagctgtggcaagagaaaagaagaacgtgatgtaccactcctatattttgcaatgttaacttggaagaagcaataagagtaaatattattttgtgaatctcacatttagccacattttctgacttagtcatcaagtggagaaatctagacatttttattatttcttcattgtaaagatttctgagtgcttttcccctcctcacaaaacggtgaaattcagacatgtaagcatataaaacctgtcttaaagtacaaaataaaagaaaagtataggctgggcatggtggctcaagcctgtcatcccaacactttgggaggctgaggcaggcagattgcatgaactcaggagtttgagaccagcctgggccatgtcacaaaaccacatctctacaaaaaattgaaaaattacctgggcatggtacatgcctatagtcccagctacttggggagatgaggtgggaggatcacttgctctggaggatgaggctgcagtgagccatgtttgcaccatggcactccagcctgggtggcaaatagaaaccctgtccccccccaaaaaaaaagagaagaaaaaaagaaaggtacaaaagtaacgttaagaaaaagtaatcattgtccatgcatttcaaagaaattcccaatcagttttggaaatggaattacaacacaatgccttattttttgtaagacgttagaaatatgcaagtagccaatttttttccaaatgagttttgtactaaatgaatattacattttctgatttgtaaatatggatatctggatatgaccttaacacatacttgacatgaccaaaacattaaagacatttattttaaagtagctttctctgggtttgttgattctgaaattgagtggctgatactcctttaaatgaatgacctacttactggatgaaaaatgcagtgaaaatccaatagatataataatgggatactcaataatgtttgagttcatcatgattaactggtaaataatgttgcagtattgaaatgccttaaagatacttaatgcttagtgatttttctttagatgtcttactaaggatctgcattagaaataacaataattgatagagccaaacattctaaaaggatgtttgaatttcagaaatttctttcctcttacaagagtgacatatcctaaagatttcttctagagatacagtattttgatttacctgatttcttctagagatatagtattttgatttacctgatttcttctagagatacagtattttgatttacctgttttaagttgtttaaaagaaatacctataactgaaaatcaaaacagaaagtattcaaaaggaaaagactactgattatgtactggctgtcaacagtttgggctaagtgaatgtttcagtttctgagagtatattcaaaaccagaaaacagaaagcaggtaatccaagagtattttctatatgaatgtgtgagagctgggcaatagattactgtctagtccacttcatgctgctgtgacagagtattacagactgggtaatttataaagaaaataaatttattctcacagttctggagactgggaagtccaagatcaagatgctggcaggttagggacctgtttttatgcttccaagatggcactttgaatgctcaggagaggaggaacattgtgccctcacatggcagaagagcaagagagagagagctctcacccctgtaagcctttttaatagtggcatcaattcattcatgaggacagagccctcatgaccgaaacacttcccaaaaggcccccctcccaacactgttgcactgaggattaaatttcaagcaaatgaattttgttggacacattcaagccatagcagttactctgtaggattaattgccggcatattgggtataacaacatcattttgcttcaagaatcatatttgttagatatgtattctatacaatagattggttgtaacctctagtgacattagatactcagttttaaaatggcttctctcttagacttggagttctcagagcagttagattttagtgctgctgctctgtctgctacacttttttttttttttttttttttgagatggaatctcactctgtggccaggctggagtgcagtggagcaatctcagctcactgcagcctccgcctcccaggttcaagcaattctcctgcctcagcctcctgagtagctgggactacaggcacatgtcaccacgcccagctaattgtttttgtatttttagttgatacagggcttcaccatgttggccaggattgtctcaatctcttgacctcgtgatccgcctgccttggcctcccaaagttctgggattacaggcgtgagccactgcacccggctctgtctgttacactttggcaacccccttttcaacacactaatcatggaatcccgtttttttttttttaccaggcttacctaagcaatgactgaaattcattctgtgaccaaatgatcacatattacatttatattgagtcatctcttctctaaataataactgagggatattattcaattgtgttgtttgttttgttttgttttgttttgttttgttttgttttgttttgttttgacatggagtctcactttgtcacccaggctggagtacagtggcacgatctcagctcactgcaacctctgcctcttgggttcaagcaattctcctgactcagcctcctgagtagctgggactacaggcacatgccaccaccatggccggctaatttttgtatttttagtagagacagggtttcaccatgttggccaggatggtctggatctcctgacctcatgatccgcccatctcagcctcccaaagtgctgggattacagatgtgagccatcacacccagcctcaactgtgttttttaaacaaaactgatttattaggaattaaactagccataatacagccatagggccaagctataaagcatttattaaataaaaatgaagtaaactacatacagtcgctttgactactaattcagccccattcagaattggatatgattgtctgccagggataacgcactatgctattcagttctactcatgaattccagtcagatcttgatttcttgttcactttgatcctcttatgatgtcaatggtacgtatagcctgcctcagatattaaattttctcaatgccaaggtcttctctgataatgattttggttcactttcagcagcttgctaaaaaatcactatatctgacaccctttcctgaacattaaaaatatctgaagaccatatttttcccacctgccctctactgtgctgtctttctcttgcttctctctttttatctctaatcccttggatgacccttggtatagctgccattgtatcacagaacaccctttgccaagtcccattgctcatctgctttgccatattaacatccaagtaaaaattgtacatttcctacctccattgttttgcaattcattttcactcacctactctcaacactgtatgtagaagggaaattccatgatttgtgaagcaggaactaacttcccaactgaaaaccaccctatccagaagactgtctccctaggacacagaacaaacactctgaggaccatagttggccctgagtcctgcacccagcagttggcaggctggccccacctttttggggaaggcaagaataagaaagtggtttaagcagtaggcttcctggaatgtccagccccaggccaccacactcaggcctccagcagtcaccctcctctgggtggtggaggaaacagcccctgtttctctccagaacacagtgtcctcttcatggagatacaatttgattagcagatcaggtgaggcaacaacaataaacaaataaatgacttatgcggtctgtgggagacgtaacagatcttctgtatccccagaaggtctcaaatctatatgaatttacctattgcaaaaatccctctttagccttctcttttgaatccaaccaatttggcacccaacctttgcagtatacttgcatgacccttggagaagggccacagttctgcccatactcaaacacaaatgaggctcttggagacacctcctggtgtcatgatcatatggaggctgttttggtttctaggctatcttgttgggagtctgcacagccctttcatggaggtaatgatgatgctagttggttttcttccaaatgtgcaaattacatgagtagcacaaaatgctagaagaaatgaaaaaatggaaattcactgctagtgaaggccaagagggcatttgaacaaatggcaaagagagattttacatcttcccctctctctgcctccttctggagcgctatcaatgaacaaagttacagattctctctgagtccaagcaactattttgctatcctgaaagtaaccctttgatggtgattttccatctgaccctacagaaattaaatcaaataatcaactagtgttatttatgattgaaggaaggctctctaaatataagtaaaaattggtatgaacagtattactctattcatataggcattccttttttagcaatttatagtaatttttaaggtattattcaaaagaaaagggagctgttaaatacattaatagtgatagccattggaaattatttccatttcatttcctgacaacttcatgaaaaggtacaatttattctgaaatgtatgttctgagtagaatgattaatattcttcttattgttagaacatctagaacaaaatctatttgtcctctttcaactgtaagagtataggagggttggtaatttcctcttgaaaactaaaagaaaaatagtttcttagtttaagtgataccaaaaccgctgaaatttcaattgtaaaatttcattaaacaaccttaatgaaggtcattctcattagctccatgtaaaatcacctgcctaaaacgttcccatattgataatggagaaatgtatgacgttagaagtttgttagttgcatgcttcaaaaaatagtatgctaacaagacatggaactgtgaacagctcatagtcaaaattctagtggaaaactgctcttctgtgccctcattaatgagtataatggtgtctgcatatgggtgtttaatgatagtatttgatgatagaaaataacttcaaagaagaaacgatgatggctttgtggttgtatggaagctacttcaaactttctgagagatttactcttggttctttgtatcttgttttttttaaagatcaaagtatctgtgtcttcaggaggtgactgcattcgaacatacaaaccagaaatcaagaaaggaagttacaataatattgttgtcaacgtaaagacagctgttgctgataacctcctcttttatcttggaagtgccaaatttgtaagtctaatattcaacttttcattaggctgctgtatgtgtatagctagaggttaatctgaaaatgtatagaatccccaaatgtatatggtccccaaatggtctaacgtaggctttcagatttgaaaacctcaacgtcttaccttacaaaattctgaagagtcaaattaagttagaaggcaaatgaaaggaagaaaactacagtgtttagtcacatttactttcatttgtcagtataccatcatttctgttaaattatactttcagatccagtgatttaagaatgctaatgagaataaagctattttatttacttcttatttatttatcttatttactgttcaaactaaattacaataaactcttccgttaatgaaatgaaaatagcaaagtgtgtactattttttttaccaatggaaactcttctaacttgtgttgaatttatgacctgaactgaaataacacagattatatctacaaaagcccacccataaagttctaatttcttccatttgaactatttgactttgcatgcatggggattttccaaaatgaatatgacttcttaacaaatcattcatggcataagtcaatatttgccatttgggtaaggaattctgggtcaatttgggaaataaaatcatagctgccccctcaaaaatgtcagtgtccttggtgaaaataataatggattctgaatttaaatatttgtttttatctttaccacaagtatcagagtgagaaaggctttggtctcaaaattagacttaatttgaattggtaaaattaacaaacatgcctgagcattatggactttttttttttttgctttaaggatataaaaataaaatattattttaataatgtataataataaataatattatttgacaagtattatcatgaagctcctaatcatttcacatgtctgcaaatggcgcttattgaaaaacactctgctggtctcctctttaaaggtgctttatatctgatatctcttgtttttgtatttctctgaactagattgactttctggctatagaaatgcgtaaaggcaaagtcagcttcctctgggatgttggatctggagttggacgtgtagagtacccagatttgactattgatgactcatattggtaccgtatcgtagcatcaaggtaaccaacttaataaagattaagataattaaatgatagaattttgaagtagtttcccagtttataagaaaactcctatttccatttcaataaggtaactgtgtatgcatgtaaacacatgtgtatgaattttatacatgtctgggagtgggtatgtttgtcatacttcttaggaactgacaaaccttccaggtattgaccagaggaacaactccatttctgaccccttcatcttgtgtctggtaggaatttgggggtgtcgctgtttcaggcttcctattttgcctgaagaaagtactgccacttattcttatgcaatacaagccaaagcataagagcaccattattgcttgtctttgttgtacacagctcctcctttagtctacatagccaccatagaaaaatgcagtttcaaaacactgaaattcttatgtaacataccaggtccaccctacttaaaatgggaagtaactgagaactgattcagttattctatctttggagctttaatgcaattatcaacatctagtaccatatatattacttatagaactatccctgtcttcagcacttccctcccattttctcttcttgttttcccaattctcaactccctgttaaacccaaagcagctaacagttgaaaggtatggttaagggcctagggctagacatgaagctgatcagagacagagaagacttaaagaactggttaattgttgactctgggtgatacatagagtttcatgctgtttgtagatacttaattttttccataataaaaagtttaaaagaaagagccatgtgcaatggcatgtgctgtagtcccagctacttgggaggctgaggcaggaggatcacttcagcccaggaattcaaggctgtggtccatgatgatcatgcctgtgaataaccactgcagtccagcctgggcaacatagcaagacttcatctcttaaaaaaaaaagttataaaaaaaaatgagaagcaatatttttagttctttttaaggaagtttttcagcaaaagtgtgtgtgcatgtgtgagagagagtgacagagtgcttgcgtgtttggtggtgttgagggaattaagtacttaaccgggtttaaggacatttatactcataaagtgcagttcttctttcagaaaagatacattctgttaaagaaggtgaaccttatttgataaattcattcttttgttaccatgtatttcacttaacattgcatcctcaaagaaaaaagattaccaaagtgagacagcagtcagggaaatatgacatcgaagttttgttatgactgcttgtctcaaaagagagaccagattttcatatttaacagctcatggaaatcaatcacttaaaaaagaaaatgaaataaaatgataatagctttcaaaattctgttaattgaatttaaaaatgaacttctatgcaatttgtacactgaaatctgaagggtggatattgtactgtatacattagtatgctgtgccaaacaataaaagatataccattctaggaagactacttcaacaaactgggatccaagatattataaagaattttaggagaaatcatgcagcttatgatatgaaagggtggctcatttggggtccactagctgaattaaattagacaaaatgctgaataaagtaatataaacttgcataaattgtatgtgttggtaaatagtaaattattatgtaagccataggaaaaaggctttccacttaaccaatagcaattccatcagttaactgctgctgtgtcatttcatgtcaatgaacacacacagaatcaggacctggtgctcactggttctggttgaaactgatgtaagtgttgagccaagatcagactctgagtattgattcgagatctaatgaatttggaatgttagaaactaaacagccagttttctcttaaattcttaaaaacaagtctccgcattttatatcttttaaatctggaattaccagaaatgtgatgcatatttcattttctgtatgttcctccccttcacttcaacacgtacccttgaagaactgggagaaatggaactatttctgtgagagccctggatggacccaaagccagcattgtgcccagcacacaccattcgacgtctcctccagggtacacgattctagatgtggatgcaaatgcaatgctgtttgttggtggcctgactgggaaattaaaggtaatgtgttcatcctcctcctgtttatttcatctttgttgacatctcctgacataattacttcaggagaaggtatgataaagctctgtaaaacttgatcacgttttacttaacttgcatttatgaaaacatgaatttactttgagtaagaattttcttctttgacgattcaacctggaaacacaatatttttaagcctatgtgtatttatttaaacagctgttgttttgtctttatctgtggcatcagttttttgtatattcttgttttagttgcctcaagagcaaagtgttttttaagtatacctcatcttctgaatcgatttatgatttatagatatgaagtgctataaagttcatactcacatctaattaaaagatttatgaatactttgggaaatatcacaggagctataagctttcaaaacatgatctggtttttaaagttctcaagttgctcttattcttataggatgatgcacttaatattcataattgcttcatgacagtccttgcgcatttcaaattgcagaatgcctgccttttaaagaagcttgtgttgattaaatggaattaggtgttgggaaaccactatgggtgagatgcaggagcacaaccaaatataatggataatcctgggcttgtcagaatcatcctgagttgagattagtcagaaaatgtgaaaagccagggtgaccccaaatttatgaggactcaaccttcatatagaatgaggttattttatttactttgagtacgagatgtgactctaaagtatgagaatttattccaaaaccacacgctgaagttatcctcgtttcttagaacttcatataaatgtatatggtacatagtaatatatagtcatattatcaactttctctccttcacagatagataaatatagggatagcacacagtagtacaaaagccatgaattttgaaatcaaatccaggttggatttcctcctcttccacttgctaaaatataaccttagacaagtcacttaaccccttgggctttggttatctcaactagaaaagaatgataaaaatatctaccttgcttgcatattgtaggatacaataatacattttttaatattcttataactcttcctatatgctaagtaatgttctcagtaatttacatgaattaacttgtttaatttttacaacaaccccaaaaagtatgtcttagtccattagggctgctataagaaaaataccatgaaactgggtagtttataaataaacaaacatttatttctcacaattcttgaagctaagaagtctgagatcaaggtactggcagatttggtgtttagtgagagccagtttttcatagaaggaggcttcttgctgttctcacatagtagaaagagtgaacaagctcctttggacctattttataagggcactaatttcattcatgaaggccctgcccctcaccatctaaaactcacctctcaaatgccctgcctgctaataccatcactttggcgggtaggattttaacataagaattttgagagggacacagacattcacactatagcaaggcagatactaatattctcattctgtagttaaggaatctgaagaagagagatgttaaatgtcttgaccatggtcacacagtaattagcagagctgggatttgaacataggttaataggcacagtggtcttcactctcaacatcttgcttcactgccacaatgaatagtgagacacacactaccatagagtgtgtgtataaaatatatggcaaatagctgagatgtggtagtcacaccttaaattgtaccttaataattattatgcaaatgtaattggcacaaaaacagtattctatcagtctcagaaaaagaaagaaaacatgaacaaatgaaatctatagcaaaccttaggaaatcattttggccaagaatttcaagactactgccacaccagaatatgaaccaaaagctgaaaacaactaaatgaacttgctcatgagaattcaaatgagcaggaaaatctctcaaatatagcttttcaggatgcaagaagaagcaaaaagcaagcagaattcacaagtaggataatcaatctctagaaaattaagaggttcagagtgatgacagagcattgcaaggacgactccaatgtgcaagtcaggggctccgatcaacaatctttctatgcggctgtgcaatacatggtcacagcagtgggaaatgtacatgttgatgggtttaacctaaaaccatagcagtaggctataccatagagcctaggtgtgtagtaggctataccatctagatttgtgcaagtactgtacagtctatgcttttaactattcagtaactgattttactatttaaaattttaactattcagtaactgttttcttatgtgtgttctaaaaaccaaatgagtcaatgcatgtttttcccagataatctgagtaaatatgggttcactttggcacagagtttttaaagttgtaggcaccagaatataatacagtcatgtgtcactcaatgacaagaatacattctgagaaagttggaattaggcaatttcctcaatgtgcaaacatcataaagtgtacagtacttgcacaaatctagatggtacagcctactacacacctaggctttatggtatagcctactgctccaaggctagagcctgtacagcatgttcctccactgaatgctgtaggcagttgtaactcaatggtaagtatttgtgtacctaaacataaacaaggtacagtaaaaatacagtattataattttatggaagcaccatcatatatgtgatctgtcatttaccaaaacatttgtaatgtgtcaatgccaaaacagttgtttcaatttacaacaaacttctctaggagggaccaggtcattctctttcttcatgattgtgtatcaagcctaagacttttcctgtgaaaatgacaccaggattgaatttgatcagattatttgtcgattctctatttgactccaggccctgtgctgtgtatacaagcaaacgacaccaatgtggtctcatttcctacaaagttgcttactttttctttattcccttgaactcgaaatcttcttggctgtgaacagaaatttaaaaatttacagcagcactaccatagagtgatttatacaagtgcttttaaaaaatctcttctatgtcatcagcatgtcccctttcttctgatctcaggggaaaaagctttgtgtatgcatggcccaaatttgcccaaagaaaattatgtaggagcactagcatttattgaacaccttctgtatatcaggcactgagattggtgtcataaataaattatctaactttattctcacaaaaattccacattacagacaaaagaatagaattgtggagaaggtcagcagctcacctaaagttagaagctaggaagtgtttatttactgatgatgaaaactggtatagcaaaaagtaatcagcattcgtggattaaatagttgagcttttcccctgttgttgactcatcctgtagtagctctaaggatacggacagactatgatgaaaagatgaatatgtacatatgccaaaatatcagaaagaatggataatgataactttagtttctgctgataataactctcatggataaaccaagattatttgtgaaattccaaattctagcaaataacggtatttctttctgcagaaggctgatgctgtacgtgtgattacattcactggctgcatgggagaaacatactttgacaacaaacctataggtttgtggaatttccgagaaaaagaaggtgactgcaaaggatgcactgtcaggttagttgagatgagaactctcccagggtctgtcctgtgcataataaaagcttcgattttattgcataatattctattatcatgtggatgatgtggagcaggtttgaaaggattatactcagaggtggaattaccacaaaactaatgaatcttcaagtccctgcctgcatttgcacaggcatttttcaaggccctgggaggtatactagcagtacatttgcatagtcatatgtttttataaaatttgcaaaggtaagagattttggctacaatcagttaagtttccactccaatgttctttcatgtcgaggggtttttttgtgtctgtgagtacctcattgttataatttttttttcctaaagagagctttccccaaactgattaagtttcaggtcttgctgagcatgaattcactatatttatgtttataacaaaattagaaccccagcctaggttttatctcttacaggatttttttttaattgacacataggatcctacaagtgcttcaactggaaacctatgggatttaatgattctgcttcaagagagaaggagaacaaggggccgagatagtccaggaggaaagttcctaatacatgacctcaattataagatagagggtagaatgaataggaatttgaaaatatttaacatcctatcatactaagcatgtgtagagaataaacacttttatataaaaatgaatacaggatataaaatatttagctataagtagaggatttctcagcataaaaatcttagagcccacttatcacccaagcctaaagcaattttgttaaattaaaactataaaacatactttaaatacctgcaaagttaacatgtcataacagcaactcaaaaaccattaagtgctaaggagtttgtgttattttccatttaaaggatatacatacgtttctaggacccaaatcctagcaaagtacacttcacatttctttctctacatctctagagtttcatagaagaaagtagccccaaaatgttatccctctaaaagtcttaacttccaactctttgtttctttttgacatcatggacttgtcaacatgaaattgaggatagtttgaaagcgtgacccattcattgtttaaaatggttttgtcaataatcttaaacaaaatttaacatggaaggttgtctgtaaaattctttcaatacatgaaagacagtgaagcccacattaatattctgctactcacaaaccaacaccaacttttccctaagcgtttctttggtaaacttctaagtaggattttcaaaagcctattatcaacaacaaaacatctaaggcatttaaatatccattcagcagtgcatgtcatgtgaaactgtaacatcactaattatcaattctgcaaagattttgcacttcaacacataaagtattatgctaatttatgattataagagtattcctatgtatacgtagggtgttttgtaggttgcagagattcacgtttacaacttctcctgatgctagaatgaatacagcctagtcctagccatgaaaagacatcaccaggaagggaggaaaaaacaaatactaaaatagttcaaatatcaggcataataaaagtccctttaaaaaggcacatttggagtatactacaattacccacatcagattaagggcatcatgatctgcttcacagaggaggtgacatttgaaatggtcttgacctgaggtaagagtccaaaaagaggagatagcagaagaaatgtgaagaacattctaattcctgaaaccagtaagagcaaagggaggaagagtgggaagccggagtgtttttagaaaagaacaagtgtgaattcactcatacaagattggcaaatgggagaatgattcgggtaagatgcagtggccacataggttcatacacacttcttcccagcataatcatgtttttttttctaccctataacggtagctgaatccaaagtaaaccaacatagctgaagacaccaacctcaaagtactgtgccacaacacagcctgtacacagtgtgcattcacccatatgcctgccttcagcttgatttagccaagcactctatctcggaaatgttcgtggcccacgtcttttccgtcattgtgcatttttgccccatcgctaacacttggcagtgtcagccctttcttataccccttgtcatcaaactatattcacattttccttttaaggtgaagtgatatgtatactgaaataatcctatattttttaatgttttagtgtatctttttgagctgtgctaatactttgatcaggattgttattgttttgtgagttctctaattacacacttgtgtaagtttttagcaggtcagccccaaccctattttcccataagccctgttatttgtaagaataatttttatagaactcctggtgtttgtttgtttgtttgtttgtttatttgttgctttcaggaaaacacttatcacatttgaacataaagagcaatcattcctactaaagagcaggagtgatttcatggagaagatgtaaaagtgaggctaaaagaggtagactaagaaaatgtcataaagaccttagaatgtcagttttagaaatttgcatttattcaatagtcagtagaagagataaaattgttgttatgctttagaaagagtaatctgtcaaagatatttttaaaagtgtatcttatttttctcatgcttctaaaattcacattaagattaaagtaaggggaaaaatctgctgcaagtaaaatttagttagctgagcattgaaatggtgatattttaatagacttagccccaatattcacctagaacgtagctgctccaaaatagcataattaatctatactaactttaccagacatcaaggttcaaaagagaaacaaaaggcaaattaagaagcctagcatttattaattatgaaagaataggggcttttttagtaaatgcattcagaatgaataggataactctattctattctatgtcgaaatattatagagtgtacctggaaggactcatattatttctcatcccatagtcaccaattcaaagccagacttaccttgtttctcctagtgttttctaatgaattaaatgaactggggggatctacagctctgtgtttagccactcccagtccacaactctttcccgcaggtatctccacaatcgcagtaacatcagacagataggtaggtagatagacagatacataaaaatagcctcatgtttggaaaaaatattttaaatgtattcacaagacttatcttagatattcattaattatgcatccaatattgattaaacatatattctctgtgaggcaatttgctatactaaaatctttgtcatcctacaaacatcaactggattctaggatccaagtactgtattgtatgtactagatgttttgagtttgtgcctgacataggacctagcccataatctcttagatggtctcatgaaatttacattctagtgaaggagacagaagaaaccataaaaataaatacaggcctccttaatcgtctgaatctaatttgttccagaaaaatttgttggaaggcaaatattcagagtaggatcctatatataagaaatgtaataatgtattctcagcccatccagaaaccccgcccctttgcccaaataccactaagacacccttaagcatcaatataactatctactaccaagtgcttttacaaaacataaagcacttaaaaaaactaatgacttagttattgcacacctcatgaaaggtgagaggtggtttttacttattctagcacggtggcagtagagatggagataagtggaaggaatgaagatgtatttagggtatttcctgccctacaacagcctatagtctcattgctattcagtgatgcattgaataatgacagactgaatagatatgatctgattcatgtgaaatgtctctcttctcagtcctcaggtggaagatagtgaggggactattcaatttgatggagaaggttatgcattggtcagccgtcccattcgctggtaccccaacatctccactgtcatgttcaagttcagaacattttcttcgagtgctcttctgatgtatcttgccacacgagacctggtaaagatcatatgcatagcagagtttccgtgactaaaatgcgtttgcttcttttatcagttattggtaaaatcatcagttattggtaaaattatcagttattttctaaaaagcctgggatgattgtctggcagccaagaatgggtgatacagatagtgcttatatattttcaataataactttaatcacagatacaatttaattactatttattttcaatacaactccccacataatcctttaagcaatacatccggtaataatttttcccagcatggagccatacagcagcaaaatgcttccttaatcttctttcagagacctgagttgaaaaggtgattataagtattctttggcctcatttttttctggtcagtatttcttactgaattctttctgggaacataccttttggttcacttaatatgttttcaaatgaactcacattttacgactgtaataaaaggatatgtcttagaaattttgttgtgaccatgtgcatcataatatcacagccacaaaaattcagaaaatagtaacaccaattctattttcaaaatggatttctgcaacagagtgacatattcagcaatttagccacaagaccctaacataaaccacacaagaaaagtgaacactcatatacttctctgtgtatctaaccactggggtatgtttactctattaatagagagatttcatgagtgtggagctcactgatgggcacataaaagtcagttacgatctgggctcaggaatggcttccgttgtcagcaatcaaaaccataatgatgggaaatggaaatcattcactctgtcaagaattcaaaaacaaggtgagtttttacagtaataatgcaatataggccttaatcatgaaatccaaagtgcacatgtacctgatcaagaggaaggctccgtctataattttagctactcacgagttcagtgaaaaatttatacagtcatttttttggcttagattataggtgatttgggttagacatgactgattgaagagccaaatgcttctctatcattttcttttgaaactgagagcttaatttgaaagcataaaactgtcttacaacttgcaaaattatatcctgtaatatgtttgaaaaatgttgggtgcttttcttttctccctattttgtcaagatgtttcctttaaagtggcccacagtggaatctataggagtggtagggcatagttatcagttctttgctcatttaaattgccaaacatttgtatgcctgcaagtaaataattgatcaatagtaacatgacatgtttatgattcggggacattttaaaacactttcacaaacattgttttatctgatcacataagcaggtattttgttccagtgttagagaaagtaaaatatacactcaaacttttatgtggtcacagacatatatataaaagatctcacaaccaagacagaaatccaagtctattaattctgagtgtagtgctattgctttttaagtatataattgctctaattctgtgtagtatggcattaccaatatctgcaaatgagactttgttacttctgctaatataaatagactcaattaatgttgccaatgccagtgtgacatttcatgaaaatttacgtttaaatttaaatttgtaccgtctttcatttctgcatttaatacatatctgccaggcaccttctaagtaccatgtaagaactaaatgaagttctaagttcttgccttcaaggaacttgcatcgaactggggagatagacaagtatcaatggttagaggatagagagctaattgctgtgatagagatgtatgtagccagcgagcaatctcagaagagagacacttgagtcaaacagagaggtcagtttccactggagtgaccctgaggcacaagctggatgaggagttagctggatgaaaagcatgtatggacatttcagagtagtgaaagttgtgtgaaagcctggagtcatcagagagaataacacatccttttccagctgcatttccaacaggaaactctagagaaacctctcatatgggacaaaaactggctttgcaattctttattttggagtgctgctgcatacattgttcctgtgtaagagaggcacaatgcacatttgcatgtcagaagctctgtgtagttagttgttcagtaagaagaatgtttagctgtttaacccagcatttcccaaatttctttaatcagagaaatccttccattcctgtaatactagcattctgctgaacacactttggggaatgctttagtaactacaagtgaatccatagcctacacgaatgaatgttggcaggaaattatcagtaggggccaagagataacagaaccagtgcataaggggacatatgagctaagtgagtgagtttcagctttatcctgaaagccatagggataccgagaactctaagagttttaagaaagggtgtgatatcataagacttgtgctttagtaaagtttctttagcagcagtttggagatatgtaacaatttaggatgctacggagtctggtgagcctagtgtctccccaccaacttctcttctatagtagtagaataacagatttgaagaaagaaggagaagatggatatgcattataaaagaaaaaaagacaacctaaatgtccatcaacagatgactgagaaaagaaaatgtggtatatatacaccacagaatactatgcagccataaaaaaagaaggaaatcatgtcttttgcagcaacaggaatggacctggaggtcattatcctaagtgacataacccagaaacagaaaatccaataccatatgttctcacttacaaggcgagaagctaaacaatggatacacgaagacgtgaagatggaaacaatagacactggggactccaaaaggggggagggaggagaaggggtgaagatttaaaaatcgcctgttgggtacagtgttcactgtgtgggtgatgggtccactagaagcccaaacttcactcttatgcaatatatccatgaaacaaaccttcatatgcaccacctggatctaaaattgtgaaataataaaaataaaaataaagacattcggaacactaagctgaattggctaatgctataaactctaaagatagtaatatgcttggtagatgtacggtataacaaacagggataaaatgattcaacaacttaggagaacaatttttataaatggtcatcttggaaacgctaatttccataatcagtctgctatctcaacttttattctatccattaaaacaaataaacaaaagatctgtgctctgaatcaatattagtcaaaggtcaagttacagaatcatataaatgtgaaagtagttaaaaatatgttttaggtttactgtaactacagcattccatcaattcagaaagttcttcccccaataggtctaatttttccagattttactagagctactaactgttactgttactactctgtggtccagaaatcagaaagaattttcctttatcccagcctactcagtatcttctgtgacatttctggtttctagttcaatccctttgacacagttggctgataccttctcatttataagtcttctccttggctttcaaattgactctagactcacattgctttttgcctttctgaatactcctgtcaaatgcaccaagcagtcattctcacttttattttgggtattaatgacatgaatcattctccttacttctctattgtatctctatggtatcaccgttaaaaagaaattaagccctatgaggtttagttgttcagaattttgattcttaaattagactgggaacttctaccttctgcccatggttgttacccattctctattatctctggtgtctcaccacaaatttctcaagttaaacaggtgaaattttttattataataaaactatagctgttctgtttttccacatgtcttctcatatatccaatatattttctctaatacttttaaagtattttattactatagcaggtcagttaatatgtattaatttttccttataaaaagaaaagcatcgaagctgcaatggaaaaagcaaatgttataaacaaataattcacaaaagaaaaatgcaaacttcttacataaagttgaaaaatgcaatctcaatagatgacaagcatatggtcattgacttgcagtagcaatatccaaagatcacacttaaagcagtaaaatctaaatttaaaaggaaaagaagaaaggcttggcaaaataaccttactacctgctttgataagattagctcttacaggacacatttattaaataccaactatgcatcagatgctgtgctgcatcagtgaagatgcatacggttcctacccttgagtaacttacctgctgcacaagtagcaaattactgtatctgtttaggatacagtaaacaccaagggagacatatggagggagagaaataaggcactaactgagccctaagtccttttttagttgagggggtaggaggggtggaagcagttgcaggcgatccaggccaaaaagcatcatatgaaaagataaacatgtataaaaacatgaattatttgggcagctgttgtaatcagtttgaattattggagtttaaatttcaaaagagtgatagaagataacgctgggcatgttggcaagggccagatcacaggaagctgtttaaactgtgttgaggagtttgcatttcatcttgatgaacttgattttaagtagagatgtgacagggtaatttcaatttaagtatattactcgaggtgtcagtgtggaagacatattgtcagaagaccaaactgaagacaaagcgaacaattggattcaataatagtctaggcaggaggtaaattatgcttgaagtaagagatgcagtgggaattgacatcaaagaaatgcagaataaatccaccatgtgataccattacacagctattagaatgactaaaattaaaaagactgaccatactcagtactggcagaaggtggagacactggaactcatacactgctgctgaggatataaagtggcataacattggaagaggttggccatttcttaaaagactaaatatacatctaccatacaaaccaatcatttcactcctaattattcacccaggacacaagaaagcatattttttatagaaagacttgtaccaaaatgctcacattacttttatctgtgttactcaaaaactgaaaacaaatcacatatccatcgacaggtaaatagatatacataaattgtggtatactcatacaatggaatactagcaataaaatactcagcaataaaaaataaagtattaatatagatacaaaatggatgaatatccaaataggcagacaaaaaaggcaaatttaggcagacacaaaaaaatacatttgtataaaattacatagaaaatgtaaactaatctatagtcacagaaagcagacggatgctacttgtgaatggtatatgtacgaaaaggcaaaaaggagggattacaaatgagcataaagaaacttctggggtgatggatgtgttcattgagtgtggtggtggttctgcaggtgtatacaattacatgttacaaacatggtttaaattatagcatgttaattattcctcagtaaaactgttttaaaaataggacagatattagaggtatttaggagaagaaattagtgaagctgttgattgattagatgtggtgaggagaaagtcaggatgactctctagtttagtagattgggtgggggggtcataagaccaacaaaaaaaagtaagttaagtaatacagatttgggagttagatgataattattttgatttggaatgtttagcttaaagtacgcaaggaaaatatagatgatggtgtctcacctgttgaatgtggacttttaggcaaaaatcaggtccaagcatacatacatttaagtcatcaatacattgtaagtagatataaacttgagtttgcccagatggctaaaacctgagatgtgggcaaaggaagggatattataaaacatcaacattttagaagtgttcaaaaatagaccccagggtaggagattgagaatgaaaggtaaaagaagccagagagcttgacattatggaagccagaagaaatttcctatagggaaggaaatgctaacagcattaaatattgcacaaacatgaattcagataaagtttaaaagaactccactgagtttgggtataggcaggtccctgaggactttagcaagaccagagatgacagagtagtgggagaggaattgaaataaggctccagcaatgtggatgattgctccttttcagtgaccagattatttgttttatatgaattattctcaactagttggcaagagcactgtctcttgaaattcaagtacagtccttcaggagtgttccccatctttcttgagtcagttacagaaccacagtccctgacagaagtgtgccctatcccctaaatgcatcaagtaggatgcaaagttgagaacactcaattagattttcagtggatcaagaaagagaacaaaagaataatagccaaagtaaaaacacttagcttataacaactcagcattgattataaaatatttcttaagtccctactctgtgtctattatttaataaaatccttatttccctacctacttataaatcacatctgaactcatcaactgtgaaattttgtgtcaatagcctacttttctattttgtaaagaaaagaaatagggtaagaaataaaagcaagcattagcatttactagcatttcctggtagaacccacttcatcgctatcactcatgaaggatagagtaaagcactccctttaagtcagtaaaaatatgccatcctgtctctctgccagttaccttttgggccagtgaatttcaattcaattgtgttgctgctctttaatcatgttttcttagaatgatttctaaaaatgcatatattcattcatggataaggaggaaaaccacctccagtcactggcttgcctgtgatagagaggcagaatctcattttcagacaccattaaaatacccaccaagtctgtagaaagagactattttcatcttccagtcaacagccccatatgaaaatacctttgccgatctagataaaaaggaatgtatatgaaaaagtcttgaaaacagttttataaatctattttcttttagcccccagtccagtcaaggagatatatgtgtatgaaactaattatgtatataaaaataataaaataggtgtgtgaaagtaattcaattttaaaatcttaacttgctagctatatttaataggacaattattcttttaggtatttttcttgtttgtttttacaaaagtctggtttgaggtgtccattggtatgtgtattttagtccttttttaataaggcaattgtgtttgattttattgaagacacatctttttgaaatgatagggctataaacttcaagggaattttggaatttgatgtttctctctgttttccaaagaacactgattctgaaagatgatgagttgagtgaaaataatagtatttcgtggtcaaataaatttgggaaatactttttgctctatgtccttctctaggaacattgcattgcatattagcatgctgaaagatctgggcagctataaaattaagaagatacatgtttaactttgtataacccagtatttgtcatatttatttgagccaggaacatccaagaaactagcatcctaaagaataaacatttagaaattcccttataacccactggttcaaatgcccattttcaaacccttgcttattcagatcctacatcagacaaaggtttagaggccaaatctatcatcttacgggactgatgtcaatacgcatcaaggatgcatatgaagtagttaaaggctagatctaaggacatgtggtagaaaagcatgtaattcagaaaaagcctagcttgacccctaagaagggggcggtagtgagagggatcaatgagataaggagttcctgtctgctttctaaacaatgcagtttgaacagagaagtgcctcatctttccttttttccatctatttctgaattcttatcttcatcacattaaaaataccttgagagacccaaaagaaaagcaagaaggcatgaggactgtacctctgtcacaacacttagcatcctggtctaaaatgtaatttacagtgtacctggatctcaccacttccttgtacaacatccccttccacttccatgtacaatcatattttacaacagtgacactttgcagatgagtctaaatcccagtagttcctgtggatagtaaaacttacagaaagagccatagattaggcatatttctaattaattatctgattcctaattagatatctttgttatttagcatttttaaccttgctttattttctaactacttatctagattatagaaaactacatcaaatggatctttgatgttcagttatagttatctcttttatcttcattggtttgccttcactggtgttcaagctattattttcatgctctttgggggatagtttaataatgtattttattgatgttatttctgtaattattaaattgctaaatatagtgcaagtgcttgagaaagtcaatgttaattctcgaattaaaccaaatttgtcttgaagtattaatgatgatatagatgtggttgatattgctcaaataaaatgttaaactttctttctcctttacagccaatatatcaattgtagatatagatactaatcaggaggagaatatagcaacttcgtcttctggaaacaactttggtcttgacttgaaagcagatgacaaaatatattttggtggcctgccaacgctgagaaacttgaggtaatttagtttatatgtaaagctaaggattaagttttaattaaatgaccactatgctcactagagttctgaagtttaattacaataagaatgtcatataacccttggttgcagaaaggcctaatcaaaaacatcatgttgcatgttagaacaacaccaggatttagaaaccaaaggactaatttgacatctttgttgaagagatggattggagtcgctgtttcctttatatgcacctgctgaaaagaattatgaaagtaattaaaggtagaagccagagttgaatgtggatcttgtaattgctgttctccttctacattcactggagataatggcactctgacattgcttagtgttccgaaaattagtcagtgttccaggatgctatgagtataacctattttattgctaagcattagcatcataatggcgtgttggagctttcccatatgcctaatacaagaactatattagttgttctcatgcccatgccaacatttttttttaatttcacatatgctttttagctagcagtatggggagacacatttgcttcctaatttagttagttcaaaaaataaagtaactaaaaaatgtcagaaaatactcacgtgctgtgtagttaatttactgctcattataaaacataacatagtctataaggatggtacttggtgctcaataaatgttaattacactctaattagaatgggattaattgatttggttaaaccgtaagagtttattacagactaccatgtttttaattttttgttttgtttaattagtttggtattttttaaagggtataaaagttctgtccaggtgtttctactccaaaaagacagattatgtttggaaaaatcccagaatagctgaaaagtgtgatggtcagttattttcacatttctaaacgagcagtgaaagttcagtctcattctatgacagctagtgtgcaggctgaaatttcttctccccaaatctaaactcatagatgaagcaactgtctaattatctgatgagcttcatggtgcaaataaattggctctgcattcattgtaatgtatttgtgttagaaaaataaatttaaagtgtcaagtcagaaaaacattacaaatcaaatttaaatagtaccacagttattacctagaaattcatttgccagtcattcaccaaaagtttgttgagtatctactatgtgacaggctccataccaaatactaggaatccagtggttgttcaaatctaagatttgctttacaagatcattaaccatatattattgagtgaattaaatacagccaaacctaaggttattcaaatctagcttcatttattctagtgatgattttaattatcataaaataatttttaggaattatctataaaggtgtgcctgttaaattctataaaatctgttaaaatctgaatctgttaaatgaatctttatcactaaaatgtttttactttcatgatacagcattgcataattacagtatactatttccatggtgtggcacattatttcaaaacagccattagaggtatatttgtgattgataaaggaaccaaacattcatagttacctgttattttgcctgcagacaggttctcagtatgacaaagtgcaaaagatgtggtaaacataaattatttttacatgcattgttaagctcaagctgtttgagaggcaatatttataagccattcatgaacactacagaatagtgacattgtacattttcccatttattagattgataagaacaagtactttaaattcatatttcaaagtaaaaattttccaagctgatattgtgagctacggtcatattttgattctaatttcactgccgtcaagggtataagtctatttttagttctattggggcttttgcatttctttcctttgtagatccctgtgaaatgattttttaaagatttatgattaaagtttattgttttactaaatgaaaatgtaattataagtaaattgtttttatttttgttttttttttcctctttcccgttatctagtatgaaagcaaggtaaaatttaaatttatgcatgccttcttcgagtgcatgggttgggtaaatgtggcttcttagataaagcagccgtgcagaagcagagcaacaccagtacagctttgttcatagtatgtttcacgagcaagccgtgcattctgtgagagttctcctgctgccccttgctggccgacattctgctgcttacccaccatcagttgggctgcaatttgagttgtctcaccagcagtgatgagatttgctctgctcacttgttcaaccatctgcacacagtgcccctggtgaccagcagcacacactcaaaaggcagctggtcaatttctggtacacagtctagttctgggaaacacggtaaagtggtctcttgagttgaaccccgggccctggcctccctagtgccatgctgtctgctgaagaatcaaactgtgctctcacatgcttaccactgccttcttgctttttgcaggcctgcagatatgcaaacatttacacagcctttgcacctcttgtcaaagctgtttatctattgacatgtttatttaaaactagctatggtgccagatgaaggaatctctggaaatactatatttaaaataagtatttgcgttaatagtaaagaagtgtgagatagttctcctagcttctcaggagcattttaattcttactagcattagcataaaagctgtgagcaatgggcctccataaatggctgaacaaacctcagagatgtgcagggctggtatcctctggctagagctaaaagcctggtgttttggcatttcagagcccagctgtgccagatttctggaaagaagataataaagccgaactgatccaagaaatttttaaaaccgaggctagatttttaataagagaaatagaatatacagaaatgaaagtagggaaaaataaaccatgcgttttatcatgatacagttgtaagaccactagttgtgctacatttgctgagatggctaaaaagcgaaggctggctttcatggaaatatatgttaataaaattctgggatggcactgtgtaggtttgtaattttgcctttgagtggtgaccctcaagaaacagggacccgtggttaccattgagtccagtcaccttatgtgactatttatcccctgtaattgtcctaatattgaggttgctaaatcatattttggaatggttctttgtgtttccatgaaacaataaactatataacttgtaggagtgatttactttagtaacaagacctctgaaaaaaatggtgataagtcagtctttccataaaggaaaatatggaagcaagtgaacactgttaatgaaattcaccttctctgtgcattatgcaagaaaaatataagcagaattctcaccctacagttgggcatgttctttataacaaccagctgactgactgaacgaaaagaaaaccttgggaacaaggaaaaattatcaatgaaaataaagaagttccagaaaggagtgcgggggtggaaacagacagacacctgacatgaaataaatcacctgatatacactgccaaggtctaatttgtttttccacctgtttttcctcatgccatgtgtttttcattaagataaaaaaaggaacttggcatcatgggacaatgaggagagaattaatcatcaccctatcaactacaatatattgatgccgactggacagtttttaccgatgctgattaccaccacataaagaattatctttttcacttctatataccttcactattcaaaatagtagccacaagtcacagtagctatttaattgtaaattaaatcaaattaaataacaataaatattcagtttctcattgagacaagctacatttcaagtcctaatagccacatgtggctagtaactactgatttggacagtgcagaaaacagacaatatccatcatcacaggaagttctgtggaatagcactgttataattaaagaagtatcatcatcactgacattctgatagcctttgtttgttgagcacttactgtgtgcagtgctattccttaatttattaaacctttgcaatttgattatgtaggtactatgattattattatcatgcccatttcacatataagaacactgagtcttggagaacttagatcacttgcaacatctggactcaagggcaaggacttcatttcctaatctgctggcacacttgccccattttatgaagtagtatgcaaaagtaaacattcaagtgtagtttgagtataaaagtcatttttcaattttattgaaaaaataaaatgtatgggtttttgcatttggttgctttattttgttattgttctaatgtagaatacagactttggggtcaatctgtaaactaaattaatctgttaaaaaaaaacatttttttattttgagacagggatctcactctgtagcccaggctggagtgcagtggcacaaccataattcactgcagccttggcctcctgggctcaaaagatcctctctcctcagcatctccaagtaactgggactccaggcacacaccaacatgcccagctactttttttggaggggagggcaaagacagggtctcactctgttgcctcaggctggtcttgtcttgaactcgtggcctcaagcgatcctccctcttcggcctcccaaaatgcagggattacaggaatgagccactacactcggccagtaaacctaatttttaaacatctgttttttagactatataatccaaaagaatgtttcttggactttgttttacttaaaagccttaaagagatatgtaatattatcttattttttagctatctcccaagaaaaagcctcaaataaaaaaaaatctttttcaaaataaataaacgttttcagatttttttttctaacttttgagcaaggtttttaaaaactttttggtatatagtttgtttatgctgcctatgcaattatcttctctttggtgaaaaaaataaaacttatttcattacacatataaagcatcaataagaagtcagttaattcctgtacctcatgtttaaatgctgtgggtgagattattgctaaaggggagaaggactacaaaaagactccttctgcaggataacatgaacatccatttagaccaaccagtagacaatggaaaccagagtttgctgggtacacgtgtgcacagtttgatagacatgtgcctgcatgtgtctgctccacaaggcttccttcccatagtcagagactacactaccatcaccctaatgatattgcttttgcttttcatttgactattcaataggccagaagtaaatctgaagaaatattccggctgcctcaaagatattgaaatttcaagaactccgtacaatatactcagtagtcccgattatgttggtgttaccaaaggatgttccctggaggttggtctgtttttgatagttctctaaacacatttatatcagatttcacttacttagtgtggctgctcctacaaggatcagtcttttgttaatatattttacttttctactgatcctactcttaaacgataaagcaagattaaagcattctctaaattaccatgataaaaaatggtattatgaagtcctagaattgtgatccaattttccaaatgtatagctctttatagcacatatcattaatactaatctcttttctgtttttctctttttttccaacactacttttcccttttccttatttttgtcatccattttaaatttattttacttttatgtgttgtatatagctttattagcaaccttacattttttctggaaccattgaagtttacacaagtagcaagtagtaatttacaccgtagccattagtgcatagtctgttgtctacaaacttgaagtctagcccccttgtctttgaaataacatagactgggacctgtggcaatcaactctgcaaagacttgtgtttgacatgcctgcaaagtcctttgttagctgatatcctcagtaactcttctttgatgctaaagcatcctagcattcccctattttcgtttaactattttgcactgtttcttcagttgacactgacccatatgtgagaaagaccccggccatagctctactctcttaaaatatccataagcaagagtcaatagtcaacagcaaatattagcaagaattttatagaaactcaatagtgatcagcttgtttttaaaatgaaaacgttaaatatgtcattctcatacatttttaattatcctatcataatacaattattcattttgtctgctgcttctaatcaaaattatcttaaaccactccaatagaattagggaaatgaagggaaaatgtgggtaaagaaaaaagtaaatccaccacttgaatgatgaggtttaaagactggaacagaactttcaggatcttcattgttcatagctacaggctccaatttggaattggccatagacacccactctgagaagtttgggaataagaaaagagaaaacacattaagaactaaaactgtaaggacccatactggcttcttaaaggaagttttactgagaattttaatcttcaaagcctaactctcattcacattcaaaagatatatacatgaggatggaaactgtccggaaaatgaatagcctctgcacgtggaaattatgattccctaaaggcactttgcagtaaccaggaattattttgcaactaaaatatgaggcagaaatttgatgtggataaatattgaaaagtctgcacagtagttttatctgaactatctaaaactccatgatttgaaaattggaatagaaaacagattatacattttaccagctcttgtgtcatttaactggtcttgaaacactgtgggaggaaaatagcctacattaaaggattctttgcttttactcctacaaaatctaggactttaaaaatgaatattttaagcactttaaattcctaactacatgggcttgcttaaataaatactagcaaattcataaagtagaaagtcctcctgccattaaaagtgactatctacatttactgagagagtgatatcttccacatatgtaagaaaaaaaagtcattaggaatgaacatgtctatcaagattcattttaaatacagggaggaggagagaggaagatggcaaggttgtgaaagagtgaatgaatgaatgaatgaatgaattatagaaagctatatgcttctgcacagctttgagattgagatggggagctgattttctcccttttgcaccttatttacatttctacttgaaatgtaactgttttaattttatactgagcaaggacaatggtattactttaatattgagaaaaaactagactatgcgatgtttgttttatttatttttaaggtttggtcttatcactggggaaaaatgcagacacagataatggtcatacccatctgtaaaacataaacaattaagtgatagagtttattcaagagatattcgttacagtgttttcaaaggaaacttagggacaatctccctagacatgtacctgcttgtgtgtcagtttgacttaaatctttggtttaaacaacaacaacaaaaaaaggtacctaacagtgataatcttctatatttaaaatcaaaagctctagaataaaagtagaggctataattctgattttaacaaaaactgctcagaagatttgaagttatcatataactagaaataatatttcttcaactgctcttaaactttccatgttttcctgctttctaaacctatgatgtatttcataatcacattaattgcatcgaggagggtgagtgagatggagaacttatttaaattttcatttctaatggtttctactcttcttttcctttactcacagaatgtttacacagttagctttcctaagcctggttttgtggagctctcccctgtgccaattgatgtaggaacagaaatcaacctgtcattcagcaccaagaatgagtccggcatcattcttttgggaagtggagggacaccagcaccacctaggagaaaacgaaggcagactggacaggtaccctcacacctagctgataatgcattttccctaatgcttatataaagcagttaacttacttttgtatttttagtttcgtatcatttatttctgctctcatcttggctagcaaggactgaacattccatatttccatgctggcctcctatttcactcacatcatctccccaggacaattgtcttctctaggatgttcctgttgatcaattgtaggtgcaaagtcaccctcatatttgcacctatatttcctatgggtttaacatatgcatatgtaaagaggacagcttaaaatatattcacattatcttaatttctactgtctccaagtccgactccttaccaaatctgtagacagtcagcttcggtcccttaaatttaaatgtaaattcctctaagatcattttcccagttgcacaagctgaagtaatagtcttttgggcctgactcatcccatcctctctggacacaaagaagggcagaaaatggatctgggagaaagcaagtagaacacaaccaacacagacagggacaattttatcccaatagcattcaaggatgttaaagcctaaagaatgtcaaccagccgggtgtagtggcccatgtctgtaatcccagcactttggcaggtcaaagcaggaggatcgtttgagcccaggagtttgaaactaggctaggcagcatgataagaccctttctctacaaaaaatgtttaaaaattaaatgggcatggtcgtgcacaactgtgattccagctattcaggactgctattcagctgttcacgccaccacactctagcctggatgacagagtgagactctgtctcaaaactttttttaaaaaagagtatcaattttgcaaggacataaactttagtatctatatcccctgtccatttgattctgttaaaagcaatccctcaactgcccagatttaagcatcatacctcttattgccttggtattctttaatatcttcaatcacattttttaaaacgtaattttccatttaatctagtttttctcaatgaaagggttcataggaattattttgtctgccatgaccaaaagaacacaatgctttacaaatatatccttaagtatgcacatacccttgtaaaccagatcatgttatttgtgattacgtgttttaaaaatcaattttagtatgtaacatttagtgatcaatcatattatgtaacaaatcttatttatttttctaaaaaatacaaagcccacacaaaatattcacaaagagaacccaaagatgtataaccacgagtaacttggattatttcaggaatgcagaagtggtttaatgttagaaaatcaaaatatcagccaggcacagtggctcacgcctgtaatcccagcactttgggaggccaaggtgggtagatcacaaggtcaggatttcgagaccagcctggccaacatagtgaaatcctgtctaatttgtatactaaaaatacaaaaaattagccaggcatggtagcaggtgcctataatcccagttacttgggaggctgaggcaggagaattgcttgaacctgggaggccgaggttgcagtgagccgagattgtgccattgcactccagcctgcgcgacaatgtgagactccgactcgaaaaaaaaaaaaaaagaaaaagaaaaaaaagaaaatctaaaaataatataatcttgtcaatagatagtaaaaacatttggtaaaatttaacagtcattcatgatttttaaaaaatacttaagtaaactaagaggaaggaacttccttagccatctataaaaaaaaaactataacaagtattcctgatttaaaaaaaagacattataaacatttgctataaaatcaagcccaagaaacagatgactattttgactgcactgatcttagctagcatagtaagaaaagaacaagtaaatatagcacaagaacaagaataagaacaaatatataatttaagaatcattataacaaaatagacataaagcccatatggagaaaattataaaatttcattgaatgataccaaagtatttctcaatgattatagtcaataaattggtatagtcaacatgttaatgaagatattaaagactcaatattaaaaatatgtcatttctccccaaaatgatatgtagattcaattataataaaaatatcaccttatttttctgtgaatcatgacagcttattctaaaatttatatcaaagatgaaattcctagaatagaagaatagcgtagttggggctgttccaccagatatcagcacattagaaggtaaagttttgtattgtggagctatcatgttaattcatgtataactgtgcaaataggaaagaattgagaaccctgaaaatacacaagcatagatggaaacagcatttgacaataagtggcattgcatttcatttaaaaaagacaacagtgaactgttcagtgaatgatttcagggcaattggttattcatatggaaaagatgaaactaaatttctttttcatatcaaaccaaaaaataaattcacaataaattaaagtcttaaatatggaaggacaaaaatctttaaaattcttagaagaaaatataccaggattaaattttgaccttcgggaaaagaacacttgattgaacaaaacaagattatgagtggaactgcattaaaattaaactctttggtcatcaaacaacacaaaacacaagcctcagtctggaaatgtacagtatatataatctacagggaatacagtccttgtccccaaaaggggaaaagctcactgcagtttataatgggatatcgaaaccatactggttgttatagtattagaaagaacagtattggaaagatgtgaatcaaagagtgcccttgatcactgctggtagaaaaagtaaatttctaaagtcactttggaaaacaatttggcactatctcctgaagttgaacatgtgcatactctctacaagccagcaattccactcctgggtacagacccagatttttgcacatgggcataataagacatgtacaagaatgtttatagaagtattctttataatagcagagaaactagaaacaacccaagtgttcatcagctggagaacagagaggcaaactgtggcacttttgcataatgggatatcaaggaataagaaaaaggaataaattataactaaatataacaacataataaatagaaaataaataaaaatgaaaaatgtgctatatggtaccatttttgtagatttctcatacaagtagcactaaacaacatattgtttacagacacatgtgaatttcaaaaatattttttaaaagtaaggtaatgataaacataaaatccacatttgtggttacctctgagatggagaagcaaggagatggtattagaaagaaactcataagagatgcaatggtattgtttctgaaatttggtggtagatttacaggtattcatgttattatacagtgttaacgcagcttcatcgtttacatgtatatcactcatattgtgaagaatatatcaaatagtcgtaataaaaatatttttgaagagtagagggagaaaagtgttattttatttcatttcttactacacataataagcactaaataaatataaaatacaaatgccctcgtcaatttttttgtttatcttgaaaaataaacttttttctcatattgcaaatgataagctagttataataagaataccagatcaaatattctgaaatagatttccactaaaggatacttgattccttcatcattgccagatatttaaacactacctactggctccaaatttctcctcttcaagataaaagaaatgaatgtgaatcaccagctttcaggatagtgcttaaaataaaacagattcctattaaaacaattacaataagaaaacactatgtagtatagtataaagtaagttaaaatgacattttaatgttttaacattttaataactcatatctactttataaaatatcatagtatatgctatctgaaggaggaaccaatgttaaatagtataagtctgttagacataattagatttagattcagtgctggttaaattgacaagttttatatttcaaagctaacggttttgatacccatagagttatttgtgattcctttctgctaaatgggtttgatatggcaaaccatccatgagctaaggaatttttaattgagtagtttgtgttttccctttgacagatggtgagcacttatccagatcctcaaaatgttctgtggtggacacgtaactacatacatgatttagtaaattattggaacatgatgatgtttgatggaatctgtctctaccaccatagatgactcatggagaactgagccatcactgtgtggcaggtgcccccatactccacaagaaagggagagcacgtggcatcagctctagggacaaggactgcattcaggctccctggggttcatgatgggatatcaaaaccacactggttgctatagtaacagtagcaagaagaaagcaggcatgcttgtggatgaaaaattatcttccttctttctaaatgtgggaggcaggttacatgtttgtgatagcgatctattctaccagctcagagaacaaattgaagtctaaatactcagaatgccacaaggttgggagtcaggcctgattctcagaagctagctgtccacttgtgaatataagggagagggattttgttgacaccctttgtctcctgatgggttttataagttagaggaccaacgcaagcacagctgttactttcagcatcacaaatctgctttgcagagaactgctatattaatatatccactttccagatcatctcacaagcaaaaatggtaaatgattagaaagatatttccagctgttttcaaaaccgtttgagaaaataaagtcttaatttctcaggtaagatctcagagcagacgaacctgtggttctgccagggaatctctaaagctaagccataaatgagacttctgtttaatcttcaataaccacttgctgttgcaggcctattatgcaatactcctcaacaggggccgtctggaagtgcatctctccacaggggcacgaacaatgaggaaaattgtgatcagaccagagccgaatctgtttcatgatggaagagaacattccgttcatgtagagcgaactagagggtaacaatagcactaaaatatttattattgtaactcaggtgaacttcctttgctagcatcggtatctatcagtatctgcctgaacctctgtgtgtgtggacctactatgcattgcaaaaggataccgtagcttaattccctcttctttacttttcatacttcgggaacctcatttgcctcagcccttaggagttctacccttaacatttttattcgtgcagttatctccacctttggaaaaaccaaatgcattttctgaagctataaataagaaaaatccctccctctgcccctcttaaatattacctcctcaaataaggtatgcacacagcaaaactcacaaatcagctccactggagccagcaggctttggcggtttctatctcattcaggttccaaagcagttatggcagctgcttagctgtcacagatacagagtgtggcagcagctgcaggacctattgagcctattaagtgcatatcttgtccctgtcccccttcccaaggtttgcagggtccctgcagagtggctttctgagggaacagaatcaagggaggggaggaaaatgactgctgccctgagcctggccacctttttacaaatctaccagagtgcttgccccagccctgggccagggaattggctttactcatgcacaaactgatgactttctttagaatgctgcaatactttatacttactttattaggaaagtcatctgtatttttcatcaaaatattgtatgacaactcagagagataattagtttagaaggacaattagagaaaaaagaaacagaagcccagagacttcaggggttcagacctccaagccagcaatccatttatcagactgaagacatagaaaagaactggaaatccaatttgatgaggcctcaaaacacagaggatacttttaaatgcaacgagtatgaatatgtagcagtagttcagccaagccaatactatcctgcagtgaaagacctacatttactaattatcctcttggggaaaacatttagataagcaataaagatttcttaccttctaagtaaacaacaaagctttcctcagtttttattattattattattaggtagaggattaggctgtaggatgaattgatacaaagcgttcatgcagaatggctactgagacgtttagaaaccatgatcgagacaaatgagggatcatttatttggacaaactgagaacttttactaatctaacagccagatattgtagtcatggtctctgaggagaaatgcaaactgaatgctctcatttgaatcttagaatgctttagaatcctggtttcacatgtcttctagattagatgttaggccctttgacaaactttaatccttttcattgcggaaaggactttttaaaagatttaaactttagccgggcgtggtggctcacacctgtaatcccagcactttgggaggccaaggcaggtggatcatgaggtcaggagttcgagaccagcctggccaatatggtgaaaccccgtctctactaaaaatgcaaaaacattagccagacatggtggtaggcgcctgtaatcacagctactctggaggctgaggcaggagaaatgcttaaaccagggggacagaggtttcagtgagccgagatcgcaccactgcactccagcctgggcaacagagcaagactccaactcggaaaaaacaaaacaaaacaaaaacatttaaactttaaggaatttcaataagtaactgcagatttgagaaattagtttaccgaaatcactcaaaatgtgttattttgttgagaaagaattctggaattcccaaatgcattacactattgtaccactatgccactatgtccttttaacaggtgcttcttcaagaagggcattttattatgccaacttcacagctgttgaccatcaatccaacctttatttgattaagctcagtatatagtacatcactggaaaccagtcatttagttaattggccatataaacgaacagttttgccattcattgttaattacaggataatatatgacatattagtgtgtagtcactgaactctgtgccaaaacagtaatacatttgctaccataatggctcattcggcactctaaggttaaaatgcaatctactctataagcaagtgccacattaaactgattgaccagagatcgcaagtgaccatgagaacttcacccagaaaaaatttttaatgctttatatgcctattctatggcatgatttgtgtcacatactagacaaagatgatttgttttcattgttctgaatgtatgtgagatctgtaataacatcctttcatcacagatgagaaaatattaactaacctgcccaaaatcatgtactacaaataacaggaccaggtattaaatgagatgatatatttgacttaaatacctccatctatgcacagccaatagattattcttacatttttgtgtgaccataaaggtttatattactaaatgttgattatgatgtatgattattaatttggagatatttgcattatcccaacacttttcagattttcagactatgcatgtcagtcatcatttcttttcctaaaatcctggacaaaatgatagctttaataccgcctcacaaaataattggattttcaccaaactgggggccaagcttctcaagaagctccttctcccttgtcctctgcctctctttactcctcctccctcattctctctcccttccaccccttcatctggaaaaatctccctttagtcactttggtatctaatttcttggcactccagtgacctctgcctcctatatctgctttgtcctctgatccttctcctggcatccgccttggtggccagcagttcttactggacaaaaacatcaaaccctaagagcctgaagtagttacttaagcaaataggacaagcaactgaactgagtttttcttctgggaaagctttcttcacacaggtacagaaataggctaaaggtcaggaagtagggtgagatattttaggagtcatttggggtttccagaatgagataaagattttaacactgaaccctaaatattttctttcttaacatccaaagtatgttcaaacagaaaaaagattagattctatttattatgtaaattacaaacattaggacacatttctcttaatatcttcttccacgtatgcaatccaactgatatggttttaaaaaaaatcttaaacccacattccaaacaaataagaaatagggtataagtaatcaagtaattatgaaactctaagaatcagccactgaaactgtaaaaaaaaaaaataaagctgacctattacaatactaaagtaatacaaagtttaatgtacctttttgcacatagcaggcctcagtaaaaagctgttaaataaatactttttaaaaatggaaaacacaccagaatcataatggacatattggcaatgtccttctcaataaaaactaaagaaatgatctagatttgatgttcctaaaaggtaaaataggagcaggatttagctgtagttttctagcaatgccctttttaagtaatacagcctcagggcaatcccttaattaatattttccgctgtttgaagtaggtatttttatctccatcttataaatgaatgaaatggacctgagcatgattaaataacttgcccaaggtcacacagctagtaagcttccacactagtacttaattccagtatgttcctcctgaaagcccacactcattctccatcaccaccctgtgaattggtttaaaaaaaataagggtcactatgatggtccttgtggcagaaccacactacagagagaggctacaccagaaagaggaaggcctctagctttttaaaattctaatcaagaacagagatttactctccttggacaatctttaacagaggcttatatccttcattaaaaccttagaagccctgtgatatcatgttgctaagaagaggctgctttcagctaaaggggaaaaagagtgtaggggaggggcttctcagtgagtcacacatacccggaagtgagtggttttctgaaattctcgtctcaggaaaccaccgacactcttagcaaggaagctgaacctcctgggttttgccaacacatttttccatagtttggtaaagaaagaaacctcaaaagtatgtcatttccccctattttctctttgaaactaaattttaccggtcccttcttcacccccttaacagtgacgtttttgagccacagcgaaatccattttttgtccctttctcttacttttgaattatcttacttgtaaagtgccaattcagagcatctttaccctggcttattgttttttccagttctacatgtggttttacttctttataaagtcaagtaagagggtactttaggactgaggtttccatccaagtactccggttttctctccagatatgaagtaagttttcagtaatccattcatgatccccaggctagtgactaatgcttatgactaatagcaccatgatgactgttaagaccgaaactcaaaacttgcttccggaacaaaagagaaaatgcctttggtcattttcatcagaactctttgtctccttctgattcttggcccagggatccaaggattgttgtaaataagtagcatgaggttctcaattagcagtgtgtgagttctctctcataagcaaattaggaaaattaatgaaacagccactaaggaaaatcattgcaaggaacaattagcagggtgtccttgcctgcctcttctattcaaaagccatcagctacattctttataaaaggtgctttaagtgtttgctgttgattcctgcaatctaagctctcaggagcatggtttgttccctagcaagaagataatagccagcacaacccaaggaagaccccatgctttgctaaacctgccaacccttatacggttagacattactgcacactgcagaagcctcagttctcacaggctcatgtgttgggctgcacagcgctgttgtcagctctacaagaggctaatgttgcagtgcgccatgacctggtttcagtaaactttcaggaagagtgaacgagggagtcatggaacgagatcctgagaacagcgtttgcttagtgtagaattcctaagcatccaattttggctcccttaaaagctatggttgagaggggtgaagggtggcaggaaagaatttgatttccaactgtattgaatcagatgtgacttatacttgtttatttttaatattttatcagcatctttacagttcaagtggatgaaaacagaagatacatgcaaaacctgacagttgaacagcctatcgaagttaaaaagcttttcgttgggggtgctccacctgaatttcaaccttccccactcagaaatattcctccttttgaaggctgcatatggaatcttgttattaactctgtgtaagtggatctcctcattactactactaattttttatttttatttcttgctattaggggtcccaatgcatctacattgtctacagctatgcaggggaggagggaaacaatgaggatcttcaacttagactgagaaaagcacactaatggacttaaaaaggcatgcggggattgggcttaattgtaaggaagcaaaaaaacgaaaataaaaaaatcttatttattacattctattagccccatggactttgcaaggcctgtgtccttcaaaaatgctgacattggtcgctgtgcccatcagaaactccgtgaagatgaagatggagcagctccagctgaaatagttatccagcctgagccagttcccaccccagcctttcctacgcccaccccagttctgacacatgtaagtgtttatattatccccattgctttctaatttttacccagtattctgagtcatttcagaaggaagattattcaggatatctagtacactctgatattagaattgaaagaaatataacctatctaaacctattcttacatcttcattgaatgacttacctatatttccatcttcaattttgtttacaaaacagtacattttcagttgaaatgttggaaaacacagaaatatccagaatcatgaataaaagacacttataataccatgacagaggcaaccatgttggtttccaggcccttttatctgcatagtagatgtcctaccttgtatacaatttggtgtcctgtttttagaaactagtaatacaccactaaaactgtttctaggccaggcgcggtggctcacgcctgtaatcctagcactttgggaggccaaggcaggcagattgcctgagctcaggagttcgagaccagcctgggcaaccacggtgaaaccccgtctcttctaaaatacaaaaaaatagcctggcatggcggtgtgcacctgtagtcccagctactcagtaggctgaggcaggagaatcgcttgaacccaggaggcggaggttgcagtgagccgagatcacgccactgtactccagcctgggcaacagagcgagactccatctccaaaaaataaaaataaataaataaataaaaactgtatctaaacatcatataaatgtgtatgtctaatatgattttatgttaagtatatatacacacagagacacacaactattttatagtattggaggtcatatagccttgattagagcatgggctcaagtcagactgctggtattcaaatcccagcactgtaaccgaccatctgtgtgaatttgggaaagctacctgtccaatctatttctcagtttcccatccaagtactaaccgggcccaaccctgcttagcttttgagatcagaaaagatcggatgctttcagggtgatttggccatagactatttctgtttcctcatctgtcaaatgaggatattaacagcacagacatcaaagactttgtatcagagttttaaaagataatgtttgttcaatgactcacatatactgaacgtttaataaatggcataagtactatgtagtaatgataataatgagtactttcaccagcccagggctaaacaattttcattcaatattatatgtaattctcataacggctctgtaaaatatagtctttctacttttagtcgagttaataagaattagctatcttaagcaaccaacccactcacaccactagtaaaaggcagagtaagaattttattctagcgagtcagactccaaagtctgactccttatctctggaacactctgcctttccaatttattctacttttaatagaccatggtaggctattgagagtgtttccagtttttcactattagaaactatactctgatgagctcctctatgcatcaagctttttcattatttccagttattcttaaaatagataagtagttaggaaattataaggccaaaagatgaatatgtctaaggttttcaatacacatacctgaattgtttcttccacaggctatgccaatttacattcttatcaccaatacaacaaagatggtcacagtcactacactctttacagctcatgtgttgtggttatattccataccagtaatgggtgggcaatgttgtcttgagtgcagatcttgaaaactcttgaatatctcattctcttccttagtgtccacgatggaattggttgagcaatgtgctccttgcactagaaatagttattcaatgagaggccagataaccatcattcaagaaaactggttatttactccaagcatcctttcatcctttgtaaaatagagatatttcatctatcttgcctacaacatagagttatgaaaaatcaaatgggataatgtatgcggaagttatctgaaaactggaaaaagcatacccacatagacactctgaggaatccctgcatttagtgaataactactatgtgtccagtactctgccaggcatttcatatctgttatttcattttattcccaccctattgttttatttacatttatttatattgccagaagtattatatttcacaaaggaaaatacctaagatcacacagctagcaagtggaaagctgtcagtcatggggggttagttccaggagttgatttcatcctaaagcattcctgagatctgccacatggatttcagaatgtttcctcagctctttcataattcagccacaggttagatctttgcttagcaaaggtaaggttaatgatcctcctcttcaccctcatatacctgaaaatcatgtgtttctcagactcataaacatgttttcagttgaagaattagaaaacatcatgagttgaataaacttttttgaccttggatcctaatgtccacttataaaaatgtttctaggagaaaacagcctaatttctaaatgactaacttaaaattataaactaaaattggcaagagccctaaagatcatctggtccaatcaccatcttaatgcatgggttccttttacatgatacttacagcctttgcttgaacatttcattgacaagattttccagtgttatgacaaggcaggctcgagttgttagaaagccatcggttacattaagttaaaactgagtccctaaaacttctatgtaatgattgtatttctataggcaaacacattacatttatgtgtcctctgtctaacatcccttcaataatttgaaaatagctaagtcttctccttccctaggctaaccatttccctagcttaggtattctttgtattatctcatttctaattactatcccctccatgatcagtattcttaaatttgaaatattcccttcataatatggcacctactgctcaaaaggaagtcaccagctcaggggacagtgtgacccctccctcccttaattgttaccatatttctattaatgcacctaagaatgttttaatgtttttaatagatatatcatgctactaattccaaatcgggtaccatattcaatcaagcagaacctcatggaccttcttctctaccactagaacatcctccaggcaggtctctcagcctgtgctggtttggatttttagggataaccctgccagcctccatggatcaccttacttttctaagtacttacacaaactgcattttatagggcctctcaagcacatttttctgtggtatttagagatcacactttttccttttttctcaaaataaagatacttgcccatctgggaatggagatttttactcatttaaggttcttttttttttttataaccttctgttctaatttcgatttccatttcctctcagcagtgtatgttttaacttttccgaaaacagagcattccacttagtagatgagacagaagcaaaaagttgagtagcatgccaaattggttggtttagaaagaatcacagaacattagagctagaagacaccctaaagattccaactcttaacttgcacatgaggaaagaaagccctcaaacttacagcatggcccagggggttacacacatgagcgatagttggcactaaaacccagatatctaaattccaactgctatttcaccttctttttgtttgtttgtttgtttgtctgttttttgagatggagtttcactcttgctacccaggctggagtgtaatgtcacaatctcgtctcactgcaacctccacctcctgggttcaagcaattctcctgcttcagcctcccgagtagctgggattacgggcatgcaccaccactcttggctaattttgtatttttagtagagacgggatttctccatgttggtcaggctggtctcgaactgccaacttcaggtggtctgcccacctcagcctcccaaagtgctgggattacaggcatgagacactgcgcccggcctatttccccttcttttgcacattataattagttatgactgtgtggtcagaattagattttttagaactttccatctctattaattgtattatattttagaaatcagatcatgaagccacacatatcttctgttttaatttgtttcctttcttatgttctttttgtgtgtgtagggggaaaagggtgtcttctttttaaaggttactaaaagttaaaagttttacagtttattttgtaacaaatatttattaagcacctactaagtgcaaagatgaatacgatattatcattgctagtcagagaaaaagagggagagttgctttttctgccatagccctcccacttttattccatgaattctggcaggttacttgtcccttctaaatgtaaaataattaatggacaaataaggataataatatcttccttctaggattactattatgagggaataagttatacattttatgcaaagcacctagcaccatgcttggctcaaagtaacattccatctctctatttattcttttgttagtttaactttaacttctgtgtttctttaacttaattattctagttagtttaacttttcacatttttagggtgggtggcaggtgctggaaaaaaagggatgtggtgagtattcaatttttaagcaattccaaacccttttattggtttgatatgtaatgatgatatatacattgtaatgatgtggttattaaataagtcctctataattttcacttctcaccattttccatttttgtatcagaatttagattctttattttttttttcttgctctgtcacccaggctggtgtgcagtggcgcaatcatggcttactgcagccttaacctcccaggctcaggcgatcctcatgcctcagcctcctgagtagctgggactgcaggtgcattccaccatgcccggctaatttttgtatttttaatagagatgggatttcaccatgttggccaggctggtctcgaactcttgggaagtgatccacctgcctcagcctgccaaagtgttgagattacaggcataagccaccacgcctggcccagaatttagctttttaagagttgttatttaagaactaagacttaaaagttaactcctgaagtgagaactgcctatttatgagctccatatttgtgctagcacagttgacagaaaagatctattctcagtgcccttctttttcttctttacacccatcacacccaatcctgccagcaacttacagcatgaggacaacattcactatactacagggcaatgtaagggtgtcttgagaaagccctgccttgtgaaatggattatgtcaatcttatgattaattcatgttgaacacgctagattaaagagcatttcatgcatattatctcatttgatattatggtagcttgtcttctctttatacttctctcttattctttagcccatcgagagctagagaaaacatttctacatgttctatttgtggatatttttcatggaggatggcaggaggtagaggtagataagaggctgaacttcaagtattacagaaatttgttgacatgtggaaacgtgacaagttctctgcaagtatgtgcactgtttagaccaagtctttttaacaaggatagcctgtgtggatttgtagataatgagctggctgcattcttttacttgaattttattgaagagttcagccgtaaacctcacagtttaaaatgtgaaaactaagaaaaacaatacaagtagccatggagaattcctgtactgatgagctctctttgggatttggggaaaagaagtgagcacagaaggaaagaatagaggaaaggaaagcgatttccctagcagctttagtgctacacctttaagacctaagtacagtcaaggccaaaggataaactgattggatactgatatgtatttaaagagaaaacatacattttccacttatcaaggaatccttgtttagacattaatgtataaatattactgtaaatgcccaagacccaccaaaagagcttaagtgcagtgttaacaataattcagtttctcaataaacatcttgagtagggcttttatattttagaagaagattaaagtcagtgctataaaaagtatcttccacttattcatccataaagaaaatcatgacaaataagcaccagatgtgattttagcccacatttattagagaaattaattattgactcatgaaagaagaaaattatgcaatttctatgatgattcattgtttggtgctttcaagaacaaagatgccagttttgataaatgtaatataaatctctgctcaggacccaggaaattcaagagatgcttatcaacgaatcatacgcactcctgaatctaagaactcatttccaaatgtcagccaccaatctgcagttagttagaaaagaccattgctttattctgacctgaagttaaatgagtgacagtgtgggggtgaaaacgttttggccccgttaccaatttggtgcactatctacttccctaaacaaggctttgggagcatggcttcctccataattattcccaaccacatcactgctctaatcaacaggtgcaccaccacgcgagactccccacccaagtcctgtctgcctacaacttgtaacctgccaagcaaaggcaaatgaaaaacaagcgtatctgtcctcctttcatatcccattttccccattatctatttctagtactttaaaaagtccccacaaggtggcagaattgtaacacgttgagattgatgagcctctactgagactgtgaatttttttttttattattattgttgttttaacacatttgagagattagtgcgtccaaaacaacacaggtaaagcatcacatccatagagatgaggacgccttcaagtatacactagcttagaaaaggatgattcatcttgcaatgaccattctttaaaagttccttaaaattacctcattagatcttttctcttacccttttttcttagcttagatttcagtggcaagcagagttgaaaacatcatccttagtgacaagatcattttatttctgagcaaagcacagggcagtttctattccatctcacttgttccccctttaaaatgctagaaggaaaaaagaagcttgagcagctggatgagcagctccacccactgtgggacatgaggcagaaggaagagaagaggaagcaacaccgggcaaagcaataaactggtgctgccctgaacacatcatgttttttttctttttgagacaggttcttgctctactgtccaggttggagtgcagtgatgcaatcatagctcactctaaccttgaactcctaggctcaagtgattctcctgccttggcctcccgagtagctggggctttcagcatgcaacaacatgcccagctaattttttatttttttaatttttttgttgttgttgttcttttggagagacagaggggggcaggggtcctcactttgttgcccaggctggtctcaaactactagcctcaagcgatcttcctgcctcggctttccaaatgctgggattaaaaacatgagccaccacgcccatcccttacacccatcagacttggtttcagtttacccaaggaaaagtgatgcaaggaagacaccctttaaccaagcaagggggaggtcgagatttgtacaaaacactaccaaattagagggtggggaatttttgtcccatttaaatcctaaggtacatatttttaaaaaccctcttacaccagcacttctcagtccttttccaactgccagtttaataaaggaaggtgatagaagttttattaaaacagtatccatcctgttgcaaatcaatgattgatagtaaacatcaccttggatgtccttaaaaacaaaggactatacaccataatggctttaaactttgaggttacatgttagagtgatcagtttggtacaactcttttccataacattggctcatctgagaataccgttttattaagcactgcttctgcctgcttcttgagggctgcccgttgcagaaacggaggatctaatccaggaggtgttcttcttcctaaatttcaagtggatgtaacctgtaatgattcttaaaagaactttgacaaagtccctgtccttttctggtcaaaggtttttttctaaaatggcttgaccagtgccttgtccatctagaaaatctcatagtatacaacgaaacaacaacaaaataaaaacaaaccaaaaaactgctgcttagctcaggaccagttttggatacacctgtccagtctaccagcaatccaaaagttccccataacatacagctgctaccgggagtgtacaactgccaccttgaaaattttttaaattttaatagagaagttatattgacatttacatatagtaattagacgagtgactgtaaccgcaataatatggacataacccactggtggttctcttttaagctacatgtaattgtttcctaattcctcagcatccatccacctttcttaatccctcaattttcagagctgagggtgtaaagatgtttcagtgaaattctgcccccagtggactcacagcagataggattatcttagtgatttctgaggaagactgcaagctgcgtgtgtttatcgagacggtcctctgtccgggaaatatcgtgagaggctgataaaagatcccaattctattaatagaagtattcatgactgagatcttaagctacagaggcctttccattcgggctctttttgcaggcagcgtaataagaaaggtgccacatgctgcctctaaaagaggccattcagctgtgcgaatgaatagcattttcctgtcctacccacggggttttgcatagctgtgtgaatttcggccacagtctgctctttataactgaccatctcctgggaagcaagaagggaaatacttccatgaagaccaattttacggcatttcaaaacactttaagccttttacctgctgtggcagagtgcttcgtttgactaagatcaagagaaaagagaacaaggcttttcctcatcaagtaaaaatttcctgtgtgctgatgagtcatctctgaggtacactctttgggaagaacactgtgcatcaaaagcctgccttgggctgcttgagaacctctgctgagtcagcactcactggggcagcggcccagccagagctattaagtgcagatcttaaaaacagatgtgttggtgagagtgtgcaggttattttctcatgtactgcatgttctaagagatgtcataagcagcctgtatatcgacctatcttgtgaaaatagagaacagggaaaggaattgtggctttggtaatttaaggagccttgattatttatggagctgtgtgttatggtagccaaatgtgatctactcagccaggactgctgtatgctttgcaaggcccagtgcaaaatggaaaatgcagggcccctcactgaaaaattattaagaatttcaagatggtgacagcagagcattaaaccatgtgactgcacagccccgcacctagctctccccctcagcaccctaggaagctgatctttgaacagtggcagttgaaatggtgtatggtgggttacatttttaaaatgtgctgggttgcctagcaactggcaagggcctgaatgggctgacgtgcaggtttagatacaccatcttgaaagtctacattcatggaaaccttctagtggactgataattttcaagaaaaagtaatatagtgggagatggaaatggggagggcaagaaaaaacacattttgctactcttataacccaagtggctagcttgtcattttccctgttcgatcttctaagaatagagctcttcatatgtgaaggaaaaatgaaagggaaattccagttttctcagaaatatacataaatttttagaggataatgaaactatgagttaatcaataaatatgtctgagcacattcctttagccattccagggtgtgatatgagaaaactgattcacacgcactgagcactcaataataagtacttactatgcagtagactacagagatgaataatgtagtttttattcttaaagaattacgctaatatgtaagaaacaattagacagcatcattacctttttaaagaacagtccataatctcctgtttttctctcctgggtattttacagggtccttgtgctgcagaatcagaaccagctcttttgatagggagcaagcagttcgggctttcaagaaacagtcacattgcaattgcatttgatgacaccaaagttaaaaaccggtatgtatcatcctgagacactgggaaagaaccgataaatgaagaactgagtatttgtgtttaatcaagttgaatctactacacttattaattaatgaagttagcttttcttttattcactgagtacaatagagaatagaattttatttgtctgagcctgaggagcccaatttaggaaatcagtagcctgataaagtcctcatctctgagaaggttttactctcctttatgaaaatgcagccacgatctgataccgctctattttagcatgagaatgctgttatttttctgtttgactttgcatgcttttgtttcacagtctcacaattgagttggaagtaagaaccgaagctgaatccggcttgcttttttacatggctcgcatcaatcatgctgattttgcaacagttcagctgagaaatggattgccctacttcagctatgacttggggagtggggacacccacaccatgatccccaccaaaatcaatgatggccagtggcacaaggtaatagtcccctggatattggcagtaccctaagggaattactgagtggcagccatcagcattctcctggtgccagtatattttgccagggcagacactgactctggcagaagctaaaaataaaataagtgccatatacaactaccacaatcttggaaaatgtgctcagacctgtgtaggtttgcatttgaccactggcatgcctcatcatggttccatcactgctatatggctgtggttttcaaacatctacccataaactgaggccaggtggctgaagacatttccactgctctaagtgagaaacgtagaacagagtgtgttcaccatcaagctcgatgtattcaattttaaggaataatatttattctgagattatattatagcatttttatggtggctaaaaggcctttctattatgaaatagtatttgccaaaagcaaaagttggcaacactaaaatgggtcccaagactccccacctaaccacacagtggtctgtgaaaaccaggaatccaggaatctctggttgatcgtgtttaaagggctctaaggtatcatttctactgacagttatttggaacaactttaaaaacgttggccttacacccagaaactggtactattatgggcacagaaggctcatttgccagcttactgtcctctttggcatgactgcaaatagataatatactgcctgattaaaacaaaatctcaacatttgtctctgcacctgcgatagcctattaaagcaaagcttccctaggtagaccaataaaatttttaattttcagagtacgatattattagatgttagatttggttaatgttaacatactttgacttgtcatattctagaaagccaaagaaccttaaaaaacgcgaagccaaccaatttgttatcatggaaataagaaaaggaatcttcatttttgctgggagcttatgactagcaaatacagatccaaatgaaggagctctcattaagagttcttccatctctagctaatagaataataaatatgacatttgagaaaaagacatattgttgaaccacaatgaggctgggattaagaaagggaacttaaatactataattagtcaaattaataacggattttatttttgatggtttttaaaaattacttcccaaaccagaatagatatgtgtaaaatgaagtgtgaaattactctaatcctgacccagactcatttttaaaccatcatggtactttagcatttcacaggctttcatgctcctttacctaaattcagactcaaggtttttatactccagccagtctttacaccccttatttcattctgtctcagaagataattcactccaccgccctaaatttcagcctcagtcacttctctatcttactcccccactttgtactcatcaggttctgcagaaagtagtgcagcttatttgtgccactctttctttaattctgcacaagaagggcctgttaggcaaagggatgtagcgtatctgaaattgtgttgggagcccaggctctttgctcaatcaaactaatgcacttttaaaactgtgcatgaattttgctacccacttaatttatgaaagtgctattagtctgcagggttccttacaacattcctccctctccacacatatccacatttggcaatctaccgaggagacttcgacctaaaactgacccaggaaaatttggtattcttttggtgatagtagtcatggaaaagacagaatttgagatattctgtaaaatgggtttaactttcccatatataatgggcttagcgcatactaagcactgtgtacattgtttcaatttttcttggtaacatcgttagagtccttatgtcttatactctgcatatgtgaaatttgttcaggattggcattaatgactcctttcttttttgtagattaagataatgagaagtaagcaagaaggaattctttatgtagatggggcttccaacagaaccatcagtcccaaaaaagccgacatcctggatgtcgtgggaatgctgtatgttggtgggttacccatcaactacactacccgaagaattggtccagtaaatatctgatttcttctttattacttaaatatatggctgattcatttattgatatattttgacttattaggtcacatgggcccatgaaaactgataggtgaataggaagtcatcttttctgataagggacagaagggtttgttgtttatttgtttgtttgtttgttttgagacagagtctcgctctgtcgcccaggctggagtgcagtggtgcgatcttggctcactgcaagctctccctcccgggttcacgccattctcctgcctcagcctccctagtagctgggactacaggtgcctaccaccacgcctggctaattttttgtacttttaatagagacggggtgtacttttaatagagacggggggtttcactgtgttagccaggatggtctcaatctcctgacctcatgatccgcctgcctcggcctcccaaagtgctgggattacaggcctgagccacctcgcccagctgacagaaggttttttagatagattagattatgagagacaatgccacggaacactgagtggggaacctggagccaaactgtcttggtttgaatacctatttaactattgactagctgtgtgttttggagcaagttaatcttttttaacaaagatttctcttttgcaaaacagggtaatgataatactaaacaaaaaggattgcataaagattaaatgaggtaatttatttaaagtgattgggttgggcatggtggctcacacctgtaatcccagcactttgggaggccaaggcaggcagatcacttgagaccaggagttcaagatgagcctggccatcatagcaaaaccctgtctctacaaaaatacaaaaagttagccaggtgtggtggtgtgtgtctgtagtcccagctactttggaggctgaggcaagagaatcacttgaacccgagggtcagaggttgcagtgagctgtaatagcaccactgcattccagcctgggcaacagagcgagaccctgtctcaaaaaaataaataaataaataaataaaaataaaaataaagtgattggaagagtagcaggcatataaaaagcactgaaagatgaaaatgatggtatgtattcatggtgtttcaggcatagagatttagcaaatattgagaggtgcagtagttacagtacagttatccaattttggattcagaatttaaagccctcacagttttgtaaatcaatattcacaaaataattttttattagaccgtgtatcctagtttgctttggaaagtgttactctgagagaagcacgggggattgattggtgcttttagagaacacactagatacaaatgtgatacatttctatactcaaattagaacacatgataatgtagatttgttcattcatcaaagacaatcacccattatagttgtaattctcagtatttggcttctcttgtggatgatcagtattacttttctttcataggtattggatatgctttttaggtctatcaaaaactaaagtctctgaagtgacactggtacaagcaattcacttgaatttctaaaaacagataaaatataatggaccagagtgtgattgagttacttctaaattccttgaacccccaatgtttcatgcaaactttcaagttttatgcatatttgcattttcttaggggagggtctgctgctttcattagatattcaaaaggaagaagcactgaaccaaacctaattaccttttcaaatagaaattgaacataggctatgacaaaatgggtatatagtaaggttaataaactattaatagaaacataaaatcaggaacgtaagagaccaattaaaacttatgataccaacatggggcccatagctctgtcaaaccaatggagacatagtgtgcagtatttagactatgagaacagtcatattccaggatagacacatccaagttgagaagcacaacacaggattttctgcatccatgccaggaggcctggtggtaacagagaacccaggcagctttgggggatatcccatcctaagacaactggataactacacacatagagcaccctgcaaatgactgtattctacataaaggcaaagttctgctaaaacctgacatttgtttcttctgatctgaatgtttaggtgacctatagcattgatggctgcgtcaggaatctccacatggcagaggcccctgccgatctggaacaacccacctccagcttccatgttgggacatgttttgcaaatgctcagaggggaacatattttgacggaaccggttttgccaaagcaggtaaggctctttcatttccttcctgttgattattaactagatacaaatactaacttcttgctagtaccaaataataaaagttcctagagtcctaaactagtatcctttatttaagccaaaaagaaacttatggaagtaatttcaaaaatgcctcttaaaaattcatgtatctgatcctgataagaattaatagaagaaataaagtaaaaggtctatttagagaatttattccatctccttcactggaggttaagaacagcaaaataaataattttgcaagaacactcatatgtttatactatgttgtttttctaccttccagtttctggagatgagatatgatttttttcttcaattccctgcaaggctgtatttcataatctcctccccatcaacacacacccatacacacaatgcacacccatgtctgtttcttgttgatagtgacaatgactggcatctttcctggctttctccactccgtttctaatgaacatttccagtatggttttatatcactggtcatgaaggtacagttaggaaaaagaaataggaaataacctctacataataattttttaatcctttaatttttaatttttgtgggtacacagtgggtgtatatatttatgggtgacctgagatattttgatgtaggcatgcaatgcataataatcatatcagggtaaatggggtatccatcacctcaaacatgtatcctttatgtttcaaacaatctgattatactcttttagttatttttaaatgtacaattatttttttttttttactgtagttacccttgtgctagcaaatactaaatcttattcaaactatttttgtatcattaaccatccctactcctccctgccactaaccttcccaacctctggtaactatccttctactttctatctatctccatgagttgaattgctttaatttttagctcccacagataagtgagaacatgtgatgtttgcctttgtgtgcctggcttatttcacttaacataatgacctcaagaaccacccatgttgttgcagatgataggatctcattcttttttatggcttattcatatccagtatgtatatgtaccacactttctttatccgttcatctgctgatggacacttaggtggcttccaaatctattgtaactagtgctgcaataaacgtgggagtgcagatatctcttcaatattcttttgggtatatatctaagagtggaattgatggatcatatggtagctctatttttggtgttttgaggaacctccaaactgttctgcatagcagttgcactagtttacgttcccaccaacagtgtacaagggttctcttttctccacatcctcgtcagcatttgttattgcctgtcttttggataaaagccattttaacttgggtgagatgatagctcattgtagttttgatttgcatttctctgatgatcagtgatgttgagccccttttgatatacctgtttttcatctgaatatcttcttttgagaaatgtctatccaaatcttgtacccatttttaaataggattattagatttttttcctatagaattgtttgaattccttttatattctggttattaatcccttctcagatgggtagtttgcaaatattttatcccattctgtgggttgtcacttcactttgttgattgtttactttgctgtgcagaagctttttaacttgatgtgatcccatttgtctatttttactttggttgcctgtgcttgtgggtattactcaggaagtctttgcccatttcaatgtcctggagaatttccccaatgttttattgtaatagtttcatagttggatctcttagattcaagtctctaatccactttgatttgatttttgtatatggcgagagatagggatctagtttcattcttccgcatatgaatatccagttttccctgcaccatttattgaagagactgtcctttccctaatgtatgttcttagaacctttatggaaaatgagttcactgtagatgtatggatttatttctggcttctctatcctgttccactggtctatgtgcctatttttatgccagtactatgccgtttggcttactatagttctgtggtataatttgaagtccggtaatgtaattcttccaattttgttccttttgcataggatagctgtggctattctgggtttcatatgaattttaggaattttttctatttctgtgaagaatctcattggtattttaatagggattatattaaatctgcagattgctctgggtagtatggacattttaacaatattgattcttccaatccattaacatggaatatcttatttttgtgccctcttgaatttcttgcatcattgttttatagtttttattgtactttcctctaagatctggaacacgacaaggatgcccactctcaccactgttattcaacatagtattggaagtcctagctagagcagtcagacaagagaaaaaagtaaacggcatccaaggaagaagtcaaattatccttgtttgcaaatgatatgattttgtatttggaaaagcctaaagaccccaccaaaaaaccattagaactgataaattcagtaaagctgcaggatacaaagtcaacatacaaaaatcagtaacatttctatatgccaacagcaaacaatcagaaaaagaaatcaagaaagtaattccatttacagtagctacaaataaaataaaatactaaggaattaaccaaataagtgaaaggtctctacaatgaaaactgcataataatttttaaaatctgcaattaatgtactttaagatagaatattcagtcccgtggtatcatagaaatacgtgtatgttcattagaaataaactaataagcacataatatgtggagattatgatgggaaacagaaataagtaacatagttctttctatcaagaatatattatcaactggtaagaaattgaaagaaggcaagtaaaaatgattaaagacaaaaaaagcacagttctgtagatacttagaaaaaaagattaattttgtttgggggatatcaggaaacgtttcatggaggaatcagcatttgagcaaggcttcaggtgattttaacactcccatacaaagtagtgggtgatagaagagtaggaccctccaccaaaatataggtaggaaaccccacctacagggaagcagaaaacagaaaaacacaggatatgttaaatattgaaacgttacaggttatgctgaaccccgaattccatgtgctatgaaagtctaaaagcttcccccaagatttctgcaaattcacagatggctggcattctcttagtcaaattttatgacaagtttcagcttcagcttttgcacttaatggattgacttgccatcctgcctgggctcttataattctggatcaaacaaaaccagaaaattactcacttcctctgtttctaatgtcccttgccatcccctgaacacacagtgtaatacaatttacataagacttgggtggtcagaagagatcacttcactggaaaacatacaattcatcttaacctttgacatctttgttcttaaaagttttccagcgacccaatcactggggcttttttttggcctcttcattccttctgtcctcagccgaacttcctcatgtcattcctctcttctccttacttctccctttctgttttattttgcagagcaattcagcttcttctaccctttactttattttttcgtttatttccagaaggggtgtcactatgttgcccaggcgcaactggctagcttttattcataaaatctgctataaacccacctttgccaatccaaacccatcaaggttctcagtagaacaaaagtctttcatgtaacagctaccatccttcattgcagacagccgtggctacacatagcatttatttcttgcctaataaatagaagacttggagaaaattcccctgagtatttctctgatactcagttcagttggtgtggtctagacagatcttaacatatcactttgttcctaagtgatgtatctatcttaaatacttgctcaaagattaaaaaaaaaatcaaagagtcaaatatggaaaatcatagaggaaagaattaactggatgaacaagataagtctatttatgtcccagaagcttcccatcaacattgtacttacagtttctctctttattaataaaatgtgtggcaacttttgaaacctttcagatgattgtggcaccatttagtgtgccccactaaaactttactgaaaaataactgaaatgtttttctttacccaacagagagacttctaagataataatacctgacagtgagattctttaagtcaatctcagtgtgtatccatttattcaaataatacatagtaaaccctcatgttgtgccagatactttggtaagcacagggataaaatggtgaaaaatatagacaatgcccctgatctcatagcacatacattctaaaagggaaggtagcccagaaaataagcaataactaactatggagtgtgttacatgatgcagtggtggaagataggccaggcaggatctgaaacttatagccctcattagaattagctagcatttgaattgaaatataataaaaagtcatgcattgtacacgtttgaattaacaatccccatcctctaatccaaaatattttaaaatcttcattttacagttggtggattcaaagtgggattggaccttcttgtagaatttgaattccgcacaactacaacgactggagttcttctggggatcagtagtcaaaaaatggatggaatgggtattgaaatgattgatgaaaaggtgagtgtcagcaatgcaaacatttctgatttcttcatgatattgttgatgtgtagatatcatccatgtgtgggaaactcgaatattttgaagcccggctgtattctttgttgggagaaagctaaattgtatgttttcatccttctggattacttcaatttgtgtatgttttcagcatgttgtaggccagtataaattttaaatgcattaattgtacagcaagccaatcgtgttgactaataatgaaccaaatagtttgagatctcgagttcttactgtgttgctataaacacactcttattctcctcttaaggaacacacagtctatgagactatggactccagtgggagaaaaggcagagaggtggatcatctaaaattagtctgcctcttttaacaggctaggcatctcttagaagccaaggtagccaactgacgcatcagtttctcaatttgtttaaaaaagcatccagctaccatttcaaaaaacagcaaatttataaaagtagtgtgtcagtttgataataattgataatcaaattctaaacacctctttcagccctgcattaagacaactttgcactataggcagcaggtaaacagagaagggaaaacaagaaatttcacaagttttctatttggttattaaataggaatcgtacttcaactcagttcacgtttccacccttagtgttgcctcccaagaagaaaaatcacacagtgacctaaaatagttttttcttgctttcttcctctttctgctcaattttcaaactgtcctccaacaaaggtaatataggaaaaaagatccaccagcttagaggtaaaaaggagtgaacaaataagtaacactcaatagttttaccaaattttcaaacatacttttactacatctttttcaagtaacatgctcttaagggcagttaccatcgatatgtcactatcatgtgcgtttctcaccaagctccttttacatgcaaaagcctgttatgcaaactccacccaatatagtaaacatttcattaataattacatcaatagagtttacaaacttttcacctatttacttgcatttttaatctttcttcttaagacttcatttcttttcttttaccttgtcgaatgtcttgccaaactgactaatgtttttagtgtttcaatatgtttcgtttcttcaccagcttcaaaagaattctgtcatctcaaatttcaggggcttttccacattactaaaaacagatttttctcatttagaccagaacttctagtctaagttcttcattgttaggaatttaactggccttctggctcaggtctttggcacctgtgacatgaaacgggctccaaaatgtaatttatgtaactctcaatcttgtatataaaatgaaatccatgaaggaaaaaaatataattaaaacatcaaaagtttaaaatttaaaaaatcctttactttgaatttgtaaaccaaattaatgagtcactttaaacaatatcttttaagaaaattttataaggttcagtcagaactctcacattctaaaaagacgtgaggtagaatttttccctgtgtacactaggtccttttcttgtcacctggcctcaaatttttctgaaagcagaattattaccagctttacgtatcttgcctattaactcccaacaatgccccaaagcaaagagcataatttgtggctcctggtgattagatttatactttaatttgtcaagttttaaaatttttttcaatatgcccagttacatccatttcaaatgattctggctgatgtctttcctagagacctgatcatttgtatgtgtgaaccatcatgatacttctttaatgaaaccatctgtgactgttctatttcctactttccagttgatgtttcatgtggacaatggtgcgggcagattcactgctgtctatgatgctggggttccagggcatttgtgtgatggacaatggcataaagtcactgccaacaagatcaaacaccgcattgagctcacagtcgatgggaaccaggtggaagcccaaagcccaaacccagcatctacatcagctgacacaaatgaccctgtgtttgttggaggcttcccaggtgagtgttggctaccccagcaacaatttctttgctctcttatgttactggttttgaaaacatttatatttacgtgtgtctaagaatgtgtgcttatgtgtacttgcttcctagctttagaatctgcttagaatctgcaccttacctaaaatttccagtgtgtaaaatgaacatattacttatataaaccacatgggactgaacttttcatgagagcccccaaagtttccttcgtggagagattgaagctggaggaaatgaatttggcttataaaagatatgaggcatttaacagcaattggagccaaacttggtgttctttctgatttttttaaaattaatataccagaggaatcaatcataaaatgttatggaacttatttcctcaagttctggaaatcattgggttaaacatagctaatttcccccttatgttattatagagtttatatttatattacaaagaaacgcaagcaataaatcctcattcagaatccttctctagcacattaaatatagcatgtgaactgtagagatttacctaaagtgcccataaacaagagtggccaacttgatgagaagtaagccaagtgcctcttaataagtactgtaataacatagcctcctggaatggtctttcatcattttgtcaagaggaacttttatccctgtttatataaagctcctttgctaaatgaaacaagcaaaatgtatattcagcaattgttgacagagcaatgttgatagaaatgcaatgggggcccaacgacagctcctctttccaaagtggcttctgtgttttaaaaagatcttttgcttcaatcaggataaattccaagatattatgaaggaggtaatgtacttctccattcagtctatgataatgggatcctaattaacacctagtaggcctactgaaacaagcacctctataataagaggaagattctacatgaatatccaacctacttaacctttagggatttatttttacaatgtaagaaagtgataaagtcaccttcaaaaagttctaagtaagtcagtacttaaaagtatttgatcaattgctttgtttcatgaagtaacattttacaattttaagtcacaactataaatttgttcatcccaaaccaagttatttcatgtcttaagatgtataattctagatgttttcatatgttataactattaaaaagttgaggctggacatggtggctcatgcctgtaatcccaacactttggaattacactttgggcatagatggggagatctcttgagcccaggagttggagagcagcctgggcaacacggcgaagggaggatcgcttgagcccaggaggttgaggctgcagtaagccttgattgcgccattgcactccagcctgggcaacagagcaagaacctgtctcaaaaaattttaagttgatctttctttctctacaattctattagtaaggctaaaaacaaaaccactaactttgcataaaacagcattccaatttaatctcaagctaacagttgactttgaaacatgctcttaatatttggtgcaggacatttcaaagctgagccctcttgcattgcctttttcagatgacctcaagcagtttggcctaacaaccagtattccgttccgaggttgcatcagatccctgaagctcaccaaaggcacaggcaagccactggaggttaattttgccaaggccctggaactgaggggcgttcaacctgtatcatgcccagccaactaataaaaataagtgtaaccccaggaagagtctgtcaaaacaagtatatcaagtaaaacaaacaaatatattttacctatatatgttaattaaactaatttgtgcatgtacatagaattctttctgtattcagatggtgctaattcagactccagactgaattttaattcaagttctttctcaagtctataaataatattaaactgattatttcattctaaataattgcctgttttgtgtgattttaaggataaaaggtaactggccataaattgttgagtttgcaacatgccctccagtcatctcaaggaaagagttcagatgtaatttatggaggcaattttttttaacttattcctatcaatacttcttctttcttttatcatcctttaccatgtatgacagctttggccttctgtccaagccactgacagcaagtgaatttggcatgtgtgattgggaggaaatcagttcccttactctatttatgaaagaattattagcaaatcattgtcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatactacagtactaagaaagatttggggctctctaagcctacagtgaatatcacaatttacacctaggtggagaggaataatgctgaaatgcatttgtacttatcaggaaacaataaaccagaaacttaaaaggcatacttcattgagtcttttggagctgtaatttgacctaacaaattcattttctataaacgttctgtgttttgttctcctttaacccatgatttcagtcatcttcaaagagctctgtgagaagactggccttgattttattcaccagcttaaaaaggaaacgtttcatttgccatctttagtagacaatggttgcagtctaataattcagaacatgtaaaagaacaggaaactcctttctcctatggaaattttagcaacaaagaataatcctctctgacaatgttgttatccactaggggaaggaaggtgctgtttccaattgaggtgatggctgacatactcactatttcaccaccgtcctgttgcttaatacaatttgtacacacaactttattctacagaagcaattctcaagcttagctcagtgtttttaaaaaactgcctatgctttagaaaagtgcctagggagtttttaaaaatctagtacctggtccagtgattctgattttgtctaggacatagccagagcataatgattttttttttttttgagacagggtctcatgttgtcacccaggcaggagtgcaatggcaccatcttggctcactgcagcctcaacctccccagttcaagtgatcctcctgcctcactccccaagtagctgggactacaggtgggcaccaccacacccagctaatttttatatttttagtagagatgggtttcaccatgttgcccaggctggtctcgaactcctgagctcaagaaatctgcctgcctcagcctcccaaagtgctaggattactggcatgaaccactgtgcccagtcaagcatgaggattcttaaaaacattcccaggcaattctaatgtgttgtcaaggatgaacctaagaaaaataagcaatagggaaaggattccctatttaataaatggtgctgggaaaactggcaagccataagtagaaagctgaaactggatcccttccttacaccttatacaaaaattaattcaagatggattaaagacttaaacgttagacctaaaaccatacaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccagcagagcgaacaggcaacctacagaatgggagaaaattttcgcaacctactcatctgacaaagggctaatatccagaatctacaatgaactcaaacaaatttacaagaaaaaaacaaccccatcaaaaagtgggcaaaggatatgaacagacacttctcagaaggagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggccattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccaaatgtccaacaatgatagactggattaagcaaatgtggcacatatacaccatggaatagtatgcataaaaaatgaagagttcatgtcctttgtagggacatggatgaaactggaaatcatcattctcagtaaactatcacaaggacaaaaaaccaaacaacgcatgttctcactcatagatgggaattgaacaatgagaacacatggacacaggaaggggaacatcacactctggggactgttttggggtggggggaggggggagggatagcattaggagatagatatacctaatgttaaatgatgagttaatgggtgcagcacaccagcatggcacatgtatacatatgtaactaaccggcacattgtgcacatgtacccttaaacttaaagtataataataataaaaaaaagaaaaaaaaaggatgagaagcactattctaaaaagaaacattatcctccatgccaacaaagagttttatagtcatttgagaattctactattagctttgtcttggcaatttccacacccattaaaaataataatattataggccaggtgcagtagttcacacctgtaatcccagcactttggtcgctcaggcaggaggatcagtggaacccaggagtttgagaccagcctgggcaacatagggagaccctgtctctaccaaaaatttaaaaattagccaggcatagtggcatgcacctatagtcctagctactccaggaggttgatgcaggaagattgcttgagcctgggaggtcaaagctccagtgagctgatgattataccactgcactccagcctgggcaacagagcaagaccctgtctcaaatgaaagaaatatctttttatatcaaatattgaatctagtgaatttaatatataaaacattgaatctagtgaatatcttttaaccaaactttaagaaataaaactttttgaaaaccaatgtgttttaaaagtggaaacatacatctgcactaaacgctgacatgactttttgggcttaatctggacactgagtgggataaacaggaataaagatgttgggttccttagattaaaagctaaagcctttctttcttgagtcctgcacagaaagatatgtaacaaaacggaaagcaaaggcagttaaattggcactcctatcagaataaagtcctgcctcagtcaatttgtaggtagatgccttagaatgatagaatgatagaactggaagtgaattgagatcagcgaatacagtgattctcaagtctagctagatgtttaaagtgctttgggtgcttaaaaaatctacatttgggctgggcacagcagctcacgcctgtaatcccaacactctgggaggccaaggcaggaggatcacttaagcccaggagtttgagaccagcctgagccacacagtgagaccttagctctaaaaaaaaaaaaaaaaaaaaaaaaaaaaaaaaaaaaaaaaaaaaattagcctggtgtgttggtggtgcatgcctgtgtggtcccgactatttgggaagctgaggtgggaggttcacttgagcagggtaggttaaggctgcagtgagccagtgatcgtgacactatgctacagcctgggcaacaaagcaatatcctgtctcaaaaaagaaaaaaaaaattgacatctgggtgtcaccccagcccaattaaactataatctctgggtagggcccaggcattggcattttttaaaaatccccacttgattcaaatgtgaaaccaagactgaaaacccctgggctcctgtcacctccacattttatggggaggaactagaaggaactcaaggatattttgataactgtgctcaaagtcccaccttagtaaagtttcccaatgtagtccagacagttgcatctggatccaagcagaattcactgaattaggtttggacaaaacttgtcccatgcaaaattcatactccagagtgacccatgaatttggataaccaaaaattgtccacattttaaggtcagaaataaggacattttggttgggcacggtggctcacgcctgtaatcccagcactttgggaggctgaagcaggtggaccacctgaggtcaggagttcaagaccagcctggccaacatggtgaaaccccatctctactaacaatacaaaaattaaccaggtgtggtggcaggcacctgtaatctcagctactcgggaggctgaggcaggagaatcgcttgaacccaagaggcggaggttgcagtgagccaagatcgtgccactgcactccagcctgggcgacagagtgacaatctgtctcaaaaataaataaataaataataaataaggacgttttatgaaagggaaaagtttcttctctagtattttttaattaatttctgacctcaaaaatcaaattagttcttatcccaaaacaagataaaatatttcctctacccaaccttgtcccctcaatgatttcctcacctcctgccacccacagcaattatgaagaaagcagaagacttttcacttattttccaaacacccactcctaccaggttgtcagccttcttctttaaaaaggtgctttgcactttagaagaaaaacatttgtgaggggacttttattgaagttaccatggtgaacaccactgactaaagaacagagcagatttcagccccaaagcaccagaacactggcagacacttaaggcttcaattagcgctttaaaaaaagtcatcactattttctcccactttgatttaacctattgtccccaactacagaactcttctaggtttcctacttaatgacagaggaaaagaggactttgacaaattgaaaatctcttgatgttatatgaattatttgctgaattattttgtgtataatataatctatgattaacatgaaaacaaaacacaatatcgtaatccatttttgcaaaccctgagtagtcttttttactaccacttgcaaagggtatgacttaactgctaatgccagtttttaatctcatttttaaagtcttttaatctcagttaaattaagagagatataaaaacatatgcacttttttcctttgctcaactgagattaatacatacctcacacccaaagtgaacctggagggaagcaatgccccaggctggaccctaagttccaacatgatttaggaatcttgtcatgcagggtggtggctcagactcattcttttggcctttgtgccagttacctaactgagcatgatgtttgtgccattattgatatgagggtgttatgggctgaactgtgtccccacaaaactcatgtgtcagagttcgaaaccgcagtacttcaaaaagtgactctatttggagacaggacctttaaagaggtaattaaggtgaaatgaggtcacatggatgggctctgattcaatatgactgatgtaagaatttgagaagagattaggacacagataggcatagagagaaaaccacgtgaaggtgaagagagatgacggccatccacaagccaaagagagaagcctccagaagaaactgacctttccaacaccttgatctcaaacttctagcctccggaattgtgaaaaaataaatctccattgtttatgccacccagtctgtgttgcttcataacgatggctccagaaaactaatatggagtgtttcttcactaaaaaaatacaaataataatattttaaaattttaaagtatcagcacatttcaggttctctaaagagtgacatatagatcatagaaatccattattttgaacagtgaccattatcacttatataatgattagaaaaattttgagaataaaaaaataaaggcacattcataacatgcttaagaaagttgttttatatattcttggggatattagaaatagctacattcagttacaaatcagagaattaataccatcactttttgaatgttttggtagaatgggctctcttgagagctagttttgtatcttcaggtttgaagaacggctcattcacccttggacaaattaaggccctgttttatttagaaaagttatctccctgaagcactacacttctgcaggaatgcacctagagatagaaaaggtggtagcagtagaagaagtgagaaatggttagacactgatttattttgaaggttgagttaggctatttttgcatcactataagtaaatatatgaggctgggtaatttataaaggaaagaggtttaattggctcacagttctgcaggctgtacaagaagcatggtgccaacatctgctcggcttctgctgagggcttcgggaagcttacaatcacgatgtaaggcgacaggaagccaacccatcacatggcgagaatggggagcaagagagagagaagacggaggtctcagactcttaaacaaccagatctccatgaactaactgagcaagagctcacgtatcaccaacggggtggtactaaagcatgcgtgatggatctgcccccatgatccaatcacctcccatgaggccccaccttcaacattgcaaatcacatttcaacatgagatttgaaggggacaaacgtccaaagcatatcaaaggtggactagtgcttcctgtaggatcgcctatggagtgcgacaaaataaggtactgataacttgtgatcatctggaaggatagagtaggtattactgggggatgtgagtggagtaggctttttatggaaaacataacacagaatttagttttagacatgtttaatttaaactccccagtaggtatctaagtgcatcatgccacaggcagttgaacataagggtcttcaagaaaaagatccaaactacagatataaacatgggaattatgagaatattgatgttatttataaccacaagactgagcgagatcactaagggagtgagtgtagagggaggactatggatacactaccacattaagagtattaagagtatgggtataagaaacattattcagaacttagaaataggcaaaataaatgtctggatattctttcagtgcagtacttaccaggcttctctttctatcaactggtctgttttacaactccatacgggcaaaggttaacttgtaggtttttgtctagcagggatgcaaacaagttctttctggcggagagataaccccaaaggtaacagttttgtatcgagaaatcttatcctaatattcttttatgaaatgtgtgagagtgtgtgtgtgtgcatgtgtgtgtatgtgtgtgtgtgtagcttctcaaattcttatacaagttttaacattttatgggttccctcatggattaagttaaataaaatctttgacatgagttcacactatctttgcctgagagtcataaattttttaactttgaaaactgggaaaaagggaaaaggagtaaccagctgaatttgcccaggttaattcaaaactaaaaaccagttcacacaatgtttttatttatgattgaattttctaaacatgccaaccttatgtttccactgctacatttcttatgaagtaatgctaaggagggaaaaagcttaagcttaagagaagaattttggctttttatttcacttttatgggcaattaccctctcctgttagcctcagcttctagacacacacacacacacacacacacacacacacacacacacacatccagtcatctgtttagtaatgttggagccaagaacagattacctgtagccaaatacaccactgatttttatatttctttacagaagtgtagactgactttgacactcaaactcttgaataataataaaggattgaaaaaacagaatttttaaatcattttgttacttttgaattacataggacaaaacaagagttttaagtaaaaaaaattatgtcagcatattatttaagatcattttatgtaattaatttatataatacctaaagtctattatcttacaggtaacttaaataaaattattgacttcaacatcataaaagaaatatctgaacagactttcaccgaatttggagaacgtgttttggattagctgaattaaaatgcaaactatacaacactatgggattcattggggcaccctaatgggcacctcagggagatgggcaatcatccctgaaactgaagtatccacattagaaactgttaactgcttatggaggaaaatacaccacacatattaacacatggtgaacagaaaagaaacacaatatcaagtacgagtttcaaatcaaaattcaccaagcagatgctacaaattttaggtgctgatgagtcattgtgctatattttgcactggcaactctgtagaatatgttccagggttagaactaccaaggactcatttaaataaacaaatgatggttcatacatctttcaagaggtgtagaataggccagttaacttctttgtacataaacagatggagatggaggacagaagggtagaaggatgggaggaagaggcagaaagaaagagatatttaggcttttcccattttaaaggtgatagtccctttcatttaaatatgtaaataaaagaaaatgtatttataaattacttttgtttggtcttataccaaatgaatattaatattttcattgacattttaacaatgtgttgtggaatcaaaaatggaccaaaactaacttcatgatctgatgtttgtaattcttatatttttattccttaaaatatcaattggattatttagatactcttcattttttgattcttaatgataattaaaataaatgtttacactactatgtatagacacttctcaaaaataacacattgttgctatgaagtgtttagtcccagtaaataaaatataaactgaatacaatttaaaattttattttcttttataagttggtttttaatgtattagtggtaatcatgatgcctcatataatgagatgaatgtaaattatggatctggtgagggagctgaatgtaaattatggatctggtgaggcagatgtgcagaaattacttcataacagtcaaaacaatcaaggtgttcatcatcactgtgttgggtagttaacaaaatgagtaactgaatcatataatttatctggttttcattaattggcatgcatactcacttgatgtgcttccagtgggctctaaacagtgcagctattaagtggaaactcttaataattttattttgtataatgctcttttagatggaaatagacatatttgccatttttgccttacaaagacaagaattctcttgaacacaatcataaaccctggatgtacaatatcactagtgagaaagtacagtttagcaataattttcaaatggtatgttgagacatgtcagtgggtcataagatcaaattacagatttgtaaaagagcaacttttataacatagtaggatggaagaaaatgaatagaatagaacacaataacaacaccaaagtgcactgtacagaggaagtattgtttcgtgaaacttgttttctatatgaatatgtttctgtgagtatacacactgggtcataatgtaaaatgtatttctttctatggttataattttttaaagttgaagtagaggatatcacaaaatatgggaaaataaaatgggggaaaaagaaagggatcaataag

SEQ ID NO: 1275 - DNA, 44423 bp, Homo sapiens
aataacagcacctacccctcaggggtgttatcagaattaaatgagttaatgtgtacaaacagctaaggacagggccaggcattttgtaaaacaataagcgttagctgtaatccacagtggggagcccctacatgcttctgagctggggtgtgtgcccagatcagtgccagcttttgagaaaacgcctctgggactggactggaaaggaggaaatccattagcacctgtaacccagtcacattccgggggcggagaacttcccaccaacagctctgagactgaaacttcacagcccagctctcccactaatagtaacgattttaatgactccctttaaccctgttctcagaggcatgcttgctgttcccatactacagataagggcactgaggctcacagatttgtccatggcacaaaggggtggaagaataggggatatgaatgctgtacttctcatagggataaaccattacactcttctaaattccaccggggaagtgagggtgcgaaagcctgtctcgatggccctttctggccgtattatcctacagttctgtgcctgtccagcttaccgggagtctctggcgggactagggaaattatcactacatccaggcccctaatttcacgctccttaccccaccctcagtcctggagcctaaacccacactctatcctaccactgatttctccctcctacctcctcaacttgccttcctgcccccaatccgatccagaggccccaacccattgcgtccaccgttcgcctgtcccttggagcttccagaccccctcactcatcctaaccctgatcctcataccctcgccgcaggttaagcccccatcgaaatcgaccccttcagggcctctacctggatgtccagcccagtctccaactcggggcccacttccccagctctgagcccctttacaatcaattccaaagctccactcccaccccacctccaagacccctccccaagccaccattcttctactactacctccggctcccattcctcccagtcctctcccccaggcaatctcccctcacccagccccttctttcgcccctgcctcttccccctcgtcacccggtcccgaacccccgtcccgactctccagcgcccccggcccgcgcctgggctctcaccatcgccgcgcgctgcatctccctcggctacgcgggtttcccccactcgctcctctccagcctccccttccgggttctcgtcccgaagcccgctgggaattgaagtccgggcagccacggactacatcccccagaaggcagcacggtcaagcttggaggtggggtaggaagcaaattaggcgggcggaggaaaagaacgactcgaactcccgggagacaaagccggggaggacttggcagcgcaagcgcagggtgcttccccgctgggcgcgctgggagatggagtctagccaggagggctccatttttgcccgaggcccttgggaagggaattgagaatattgcaatagggtgttggtgaggggtggagagttggggaagagcaaatttattgattcatttgtgccgatcaacacaatagctaacagctccttgtgcttttccaaactccttcccatccatccccttctttttttttttttttttgagacggagtcttgctctgtcacccaggctggagtgcagtggcgcaatttcggctcactgcaacctccgcctcctgggttcaagcgattctcctgcctgagcctcctgagtagctgggattacaggagcccgccaccacgcccggctagtttttgtatttttagtaaaaacggagtttcaccatgttggtcaggctggtcttgaactcctgacctcatgatccacccgcctcggcctcccaaagtgctgggattacaggcgtgagccaccgcgcccggcccgtcccctcctttcttacctcctgatttacaaatgagaaaattaagccttaggaggaaggaaagtcccatacattaggagttagtccacatcatagaatagcagctccacatcgctcgagcccaggagttcgaggcagtgagctagtgttacaccaccgccctccatgcagttcagcctgggcgacagaatgagaccctgctgcctcttaaaataaaagaaggccgggcgcggtggctcacgcctgtagtcacagcactttgggaggccgaggcgggctgatcacaaggtcaggagatcaagaccatcctggctaacacactgaaaccccatctctactaaaaatacaaaaaattagccgggctgggtggcgggtgcctgtagtcccagctactcgggaggctaaggcaagagaatggcgtgaacccaggaggcggagcttgcagtgagccgagatcgcgccactgcactccagcctgggggacagagcgagattccgtctcaaaaaaaaaaaaaagaagaagaagaagaagaagctccaggagggcagagatctttgtgtaccttgttcaagcacctagaacagcgtaaacatgtgttcagtaaatatttattgcatcggaactatatgccagacaccctacagacaaccctggtaggaattacaatcccaaatttataaggcagaaagagattaagcctcttgtcgctggcaacacagccaagaaaacgatttgaactgaaatgtattggatttcagggtttctactcttgactaggtcgttagatcatctccccttaagacgtattttccaggctgggtgcggtggctcatgcttataatctcagccgggagactggctttagtccaggagtttaagaccaaactaggcagcaaagtgagaccctcgtctctaccaaaaaaaaaaaaaaaaaaagcccaaatcttttattctttttctttcttttttttcctttttttttttttttttttttttgagacagagtcttgctctgtcgcccaggctggagtgcagtggcgataccagctcattcaacctccacctcccaggttcaaatgattctcctgcctcagcctctggagtagttgggactacaggcgcgccccaccatgcccggctaatttttgtatttttagccgagacggggtttcaccattgttggccaggctggtctggaactcctgacctcaagtgatccgcccgcctcgtcctcccaagaaggcccaattcaaatggccctcctctttgaatcctttcccaacgtattgttctctgcattaaccgagttcccgtctcaccggattctcatggtctcggaggttctcacggtcttctcgattgtactgggaagacagtggctaagttcccaccatctagcctggtgcttggcacacaggaggccctcatgaatcacgaactgaagggaaaaggtggaaatgggacatcatagggccagaagggacacaggcgagctcgctctctctctcttcctgagagttggcagttgaggaaacccagcctacttgggatgcaacggccctggaccacgcgggtcgtgcaggggcgtgaccgcttaaaaaggcgggtggctgagcgggcgctgattggtcacctagcggctcacgccgaccaaggccttgtcagaaggctcgaggccgagctcacgctgtgcaagacgacagggcccttcccgaggcgcgcgtgcgcacggccacttgcaccctgccctttcaaccccgtcgtctcgtgcccagcacatcttggctggaactggtaggggcgtggcctggcctcaggaacgcactcttgctctgctcctcacgcctcgcgcaggatcctcgcgccgggaggattcgcacccaaccccaagcccggttgggaacgtggtgtccgagaccgtctgggatccccgcgcgcacggccggcttcccgggacccgcgcgagacgctgtctgatcgggctccctagagtggggcccggagaaaccagaacggcgggggcagcctcacgccattttgcacgccctgaggcgggtgctggaggccaaggggaatggggcgcggggcagggggcctcccccagcactagctgggcttaggggaacccgggatccccacaggagcttccctcggtggggggctcaggggaatagaacatgctctgggtgcagggccacgggcgacggagtttgggtttgaagccgggggtccaggttcgagtttgaggaacggaagactctgtttgtgttgggaatccgggctctcgagttctgatctgggatctcgggatttgtgtctaggggtgactagttctggaatctgaagagcttgagttttgtgactggaagctttctccttggaatccagagatcccaatttggggatctggaagtcttagttctgagttatgatgtaacattttgagagtctggagcctgatttggggcaactgaagcctcagtatagatttagggcctaaatcccaatgtagagtatgaagctttaggatctggagtcgcagtttgagtctttagaagcacgttttagggcctggagtgcccacattgagtatgggagctccagttttagggtctggggtttcagagtaggacccacattcgagatctcagttttagggttggggccacaatttgagggacagtttggacgtctaagaggtcaatctggagaagtgagatttgtttcataggggcctggatttcttatcttaggatataggttcatagtgttacagcttgcagtctgtaatcttagtattaggatcatatttgaagatcagaagttgacagtttgagggtctggggtatctcagtattagaatttagggtttgtaggtttgggagggctcctttttttttgtttttgagacaaggtctcactttgtcatccaggctggagtgcagtagtgcgattttagctcactgcagccttgacctcctgggctcaaaccatccccccacctcaggctcccaagtagctgggactacaagcatgtgccactatgcccaggtaattttttttttttttttgtagaggtggagttttgtcatattgccaggctggtctcaaactcctgagatcaagcaatcctcctgccttggcctcccaaagtgctaggattacaggcgtgagccactgtacctggctttgggagggctccaaagtgaggatttaggtcctcattttgggactctaaagtattagttttagtgcctttttagaggtttaggggtttgtttttgtttttgttttttgagacacagtctcactctgttgtccaggctggagtgcagtggcttaatcctggctcagtgcaacctccgcctcccaggttcaagtgattctcctgcctcagcctcccaagtagctgggattacagtcgtgcaccaccacgcccggctaatttttgtatttttagtagagatggggtttcaccatgttggccaggctggtctcaaactcctgacctcgagtgatttgcctgcctcggcctcccagaatgctgggattacaggtgtgagctaccacttctggccaaggtttagctgtttaatttgggtctttgggcccataatttgttggggctagggactcttattttgggatctctgggtgctcaaaggagcatcatagggaagatgaagggtgcccatcagggttcctgcccatccttcctgcaatcccagaggtcactaatcattctttttccctctttgcagatgtttggttccagcagatacttgggttcctctgaacagcccagagctaattcactgggtcccagtgacaggtaagggcttgccccatctcccttatagccccagccactctcattgaataataataacaaaaacatttgctgagcatttaccgtttgctagactctttgccaaacattttgtttgtatgataactgttaatccatacaacaatctcatgaggaagttgtgtacaaagatgcctaccattttccagatgagagtactctgaggtgatcggcaaagatcattgcttatttatttatttatttatttttgagacagggtttcactcctgttgcccaggctggagtgcagtgttgcgatcccagctcactgcaacctccgcctcctgaactcaagtgattctcctgcctcagcctccccagtagctgggactacaggctcatgcctccatgcctggctaatttttgtattttttgtaaagatagggttttgccattttccccaggctagtcttcaactcctggcttcaagtgatctgcctgtctcagcctcccaaagtgctgggattacaggtgtaagccaccatgcccagcccatttctttttttatttttagggcaaagataacttctaaggtccttgcagcctgtgacattctgagtttgtttgttttcagagttagggtatcactctgttgcccacgttagagtgcagtggtggcatcatagctcactatagcctcggactcctgggtttgagcctgggcttgatcctcctgcttcagccttccgaacagctaagattacaggcacatgccaccacacccagccagtttttctatttgttgtagtgacagggtcttgctatgttgcacaggcctgtcttgaacttctggcctcaagtgatcctcctgtcttatcttcccaaagtgctggaattactaagccaccacgcccaactgacattctgagtgtctttctttctttcctttttttttaagacagagtctaactctgatgcccaggctgtagagtgcagtggcgcgatcttggttcactgcaacctctgcctcccaggctcaagcgattctcctgcctcagcctcccaagtagctgggattacaggtgcccaccactatgctcagctaatttttttgtgtgtatttttagtagagacagggtctcactgtgttggccaggctggtcttggactcctgacctcgcgatccgcccgctggagtgcagtggcgtcatctgggctcactgcaagctcaacctcccggattcacgctattctcctgcctcagcctcctgagtagctgggactacaggcgcccaccaccatgcctggctaattttttatattttttttagtagagatggggtttcaccatgttagccaggatggtctcgatctcctgacctcgtgatccgcccacctcagcctcccaaagtgctgggattacaggcgtgagccactgcgcccagcctttttttttttttttgagatggagtttcactcttgctgcccaggctggactgcaatggcatgaactcggctctctgcaacctccgcctcccgggttcaagcgattctcctgcctcagcctcccgagtagctgagactacaggcgcatgccaccacgcccagcaaatttttgtatttttagtagacatagggtttcaccatgttgttcaggctggtctcgaactcctgatctcaggtgattcacccgcctcggcctcccaaagtgctaggattacaggtgtgagtcagcaagcctggcttctttcctttttttttttttttgaaacaaggtcttgctctgtcacctaggctggaatgtggaatgcagtggtgcaatcccagctgactgcagcctcgaccttctgggctcaaacaatcttcccatctcagccccctgagtagctgggaccataggcgtgcaccaccacgcctggctaatttttgtatttttcgtagaaatgggtttttgccatgttgccgaggctggtctcaaactcctgggatccagtgatccacccagcctcccaaagtgctggggttacaggcatgagccaccacgcctggctctttctttttagacagggtcttgctctgttccccaggctggagtgcagtgacacgatcacagtttactgcagctttgacctcccagactgaagcagtcctcccacatcagcctcccaagtatgcaggaccacaggcacacgccactatgcccaactaattaaaaaaaaaaaaaattggccaggtgtggtggctcacacctataatctcagcactttgggaggccaaggtgggttgatcacttgaggtcaggagtttgagtccagcctggccaacatggtgaaactccatctctactaaaaatacaaaaattagctgggcatgatataatcccagctacttgggaggctgagacaggagaatcgcttgaacccaggaggcagaggttgcagtgagccgagatcgcgccattgcactccagcctgggcaacgagtgaaactctgtctcaaaaaaaaaaaaaaaattgtggacagggtctcaccatgctgcctacactggtctgaaactcctaggctcaagtgatcttcctgcctcagcctccaaaagtgctgggattacaggcgtgagccaccatgtctttacttcctttcttttattcacgcattcattcatccatcaagcacttaccaagtgtaatgaatcttatagagggaattttcacagcagattggaggttggatcagatttctccctccctccaaagtctggataaagaaaaaataaggccaaagttcatattaacccctaccatctcccccagtgactttccatccaactatctcttcattaactccaaaattaagcatctacggggttatgtcctgataaacccatcataaactgaaaatattgtatgtcaaaaatgcatggttgatggctcaggcctgtaatcccaacacttggcgaagccaaggtgggctgatcacttgaagtcaggagtttgagaccagcctggccaacagggcaaaaccccatctctactaaagatacaaaatttagccaggcatggtggtgtgtgccggtaatcccaagctactcaggtggctgaagcaggagaatcacttgaacctgggaggcggaggttgcagtgagccaagatcgcgccgctgcgctccagcaacagagcaagactcagtctaaaaaaagaaaaaaaagcatagctgattgggagctgtggcccagtgttgctgcccagcacagtaagagaagtatggcttctactgaatttgtatggctttcacaccattgtaaagtcgaaaaatgttaagtccgactgttgtaagacgaggactgtgtgctttgtttaggttctctacctagatactatgctcagaagaagcaccatgaagaaaatgaagaatgcctatcctgctgcccattcctcctggaattttagagttgccacaattcatactttcatccccctttctagatgtgggggtccttgtattgataaagactgttagttgcgaagaacagaaacctagcaaaaactggcttaagcataaaaagggatttattggatcatttaaacaaaaaattcagggatgtcggccttggctggttccaggatggaggttaaatgatgttgccgggaatctgcgtctcttggctctggtattgtctgtgttggcttctgtctcaagcaggttctccctttgctttatttatatattttatcttattgtttgtttgtttgagatggagtcttgctctgtcacccagactggagtgcagtggcatgatagctcagcgcaacctccgcctcctgggttcaagggattctcctgcctcagcctcccgagtagctgagattacagacatgtgctaccaggcctggctaattttctcatagttttagtgaaaacggggtttcaccatgttggtcaggctggtctcgaactcctgacctcaaatgatctgcctgcctcaacctcccaaagtgctgggattacaggcgtgagtcattgtgctcagctgcaggttgtccctttggaagggcaagatggttcccagcagttccaggtctatatcttgccaactccatatacccagaagagaaaacatctttctaagattgattgactctgattggccaaacctaggattaccactccaaccctgaaccaatcactgtgactattcttggcaggaccttggttttgtgctccctagtggaaggggaagataaggtcaacccctccgaaccacatggactgagaatggaggagaaatggttgctcaaaggaaaactgaggtactgttaacagaaaaggggggattggatgttggccaagcaaaaacatagcccattgttcaacacctcttacccctaaaatcattctgacaaatgactgtacacacatgctttctttcttcctttttttttttgagacagagctttgctcttgttgcccaagctggagtgcagtggcgcaatctcggctcactgtaacctctgcctctagggtttaagtgattctcctgcctcaacctcccgagtagttgggattacaggcacgtgccaccacggccagctaattttttgtatttttagtagaaacagggtttcaccatgttagtcaggctggtcttgaactcctgacctcaggtgatctgcctgccttggcctcccaaggtgctgggatacaggcgtgagccactgcacccagccccacacgctttcttgaactaacatttcatgaacactccctatgtaccaggcactatacgaaacaccttccagataagatcaaggttttcctagccacctccattttgtaaaggaggaagaaacaggcacagagaagtgaaagcagttgcccaaagtcacacagcaagcggaggaactaggatttgaatcccagtctttctgcttcaaaaactggagcttatatatcaacctttatgccacctcctgggactgtcccctgctttgtcccactttggggcagctcttactcttacatccctacacactattaaaacaaatgaaggccgggcacggaggctcacgcctgtaatcccaaaactttgggaggccaaggcggatagatcacgaggtcaggagattgagaccatcctggccaacatggtgaaaccccgtctctactaaaaatacaaaaaattagccaggtgtggtggcacatgcctgtaatctcagctactcaggaggctgaggcaggagaatcgcttgaacccaggagacggaggttgcagtgagccgagatcgtgccactgtactccagcctgggcaacaaggcgagactccatctcaataataataataataataataataataataataataataataataacaatgataataaagtaactagggtatgttcaggttgattagctcagggaaaaggaaacttgagaattaggttcatatgccactttagaagtctgagcagctatcccaagacctttcagtattcattaattcaataattctttattgagcacccactaagtgttaggcattattccaggacttaagggatataaccagcgcagcattatggcttctgtgggccctatacaattttaccttcttgatccccttcttccatagaaaaatattaacgctgggtgcggtggctcacgcctgtaatcccagcactttaggaggccaaggcgggcagatcacgaggtcaggagttcgagaccagtctggccaacatggtgaaaccccgtctctactaaaaatacaaaaattgggaggcatggtggcgggcacctgcaatcccagctacttgggttgctgatgcagaagaatcgcttgaatctgggaggcggagatttcagtgagctgagatcgcaccactgtactccagcctggacaagagcgagactctgtctcgggggaaaaaaaaaagaaaaatattaacaattgtggtttatgatagtattgatatgaagacaagtatactacagatggggtgatatttattttttgttctaatttaaaaggaattagaatattttcatgagcccctaaaagtatcatgggttccaagcactgtgctttctgcattttatggataaatcagcctgggatatagcaataaataagacaaaaattcttgccctgtggcgtgtgcctgtaatcccagctacttgggaggctgaggtaggagaatcactctagcccaggaggtggaggttgcggtgagccaagagcctgccactgcactccagcctgggcaacagagcaaaactctgcctcagaaaccaaccaaccaaccaaccaattcttgccctcatggagttcatatttataattaataaattaatgaaagaaataagatttcacagcctgtacaatatagagagaccgcgtctccaaaaaaaaatttattttaaagtttattttattttatttattatttatttatttattttttgagacggagcttttgctcttgttgcccaggctggagtgcaatggcacgatctcggttgctcactgcaacctccacctcctgggttcaagtgattctcctgcctcagcctcccaagtagctgagattacaggcacctgccaccacacctggctaatttttgtatttttagtagagacaagatttcaccatgttgatcaggctggtcttgaactcctgacctcaggtgatccacctgccttggcctcccaaagtgctgggattacaggcgtgagccaccacgcccagcttaaaagttttttgtagatgcagggtctcactatgttgcccaggctggactcaaactcctgggctcaagggaccatcctgccttggcctctgaagtgctgggattacaggtgtgagccactgcacccagccttgtctctacaaaaaaattttaaaaatagcctggcatggtggtgcatgcctaaagtcccagctactcgggagactgaagcagaaggattgctggagcccaggagtttgaggttacagtgagctatgattgtgctattacatatgagcttgggtgacagagcaactcgttgtctctttaaaaacaaacaagcaggccaggcgcggtggctcacgcctgtaatcctagcactttgggaggccaaggcggacagatcatgaggtcaggagattgagaccatcctggctaacacgatgaaaccccgtctccactaaaaatacaaaaaattagccaggcgtggtgtcaggcacctgtagtcccagctacttgggagactgaggcaggagaacgtgagggtgaggctgaggaggcgtaatcccgggaggcggagtttgcagaagctgagatcgcgccactgcactccagcctgggtgacagagcaagactctgtctcaaaacaaacaaacaaaacaaaacaacaacaacaacaaccagggcaacagaacattccaaacagagaaggcagaaataaaattggcagttgagagaaacagaaagaaaacctatgtgactggagctgacctgttccctgaaaacccagagggcacagctgggattagtggatgcaaatatacagactgtgagggaagaaattggctaaaacccgaaccatccagcaaagaaaagaggcagctctgggaggtggtacatggcttctggagggccctgagagcggagcccaggttgtacttcttcaggactactgcccagacactggggatgccaagacattgggattcccatccactcagttgctccctttctaacctctgtgtttacccagaaggttcaccctgtgctttgtaaaacccagaataaacacccagggactatggtttatatgaaaccctctgagacggtcaaataacaccttgaactttataagtagacctggacactttttcttccttgcttcctgagttgtttcttgtcgggtctgccaagggcccctctagaacacatgggaaataatgtgatatatatatatttatttatttatcagggctagacaggagtttaagctcagcctactcaatttatctcgaaggatagaaccccaacacccccttggctcaaagttatcgtttctaccaggaggtaacttggggactcatcagtgattttttttctttttttgagacagagttttgttctgttgcccaggttggagtgcagtggtgcgatcttggctcactgcaacctgtgcctcctaggctcaagcaattctcctgcctcagcctcccgagtagctgggattacaggcacgtgccaccacacctggctgatttttgtatttttagtaggaacagggtttcgccatgttggccaggctggccttgaactcctgggcccaagtcatctgcccacttcagcttcccaaagtgctgggattacaggtgtgagccaccatgcccagccaactttttattttttcataaaggcgaggtctcacttttttgctcaggctggtcttgaactcctgggctcaagtgatcctcccaccctgacctcccaaagtgctgggattacagatgtgagccaccacactcagtcaaaagcaaagcatggcctcttcatgtattggtgacaccacacttgccacttagcatttagatcaatttccttttacaagcttcttatttttactttttttttttttttgagacagtctggctctgtcacccacaatctcagctcactgcagcttccgcctctcaggttcaagcaattctcgtgcctcagcctcctgagtagctgggattataggcatcatgtccagctaatttttgtatttttagtagagatgggtttttgccatgttggccaggctggtcttgaactcctgacctcaagtgatcagcccacctcagcctcccaaagtgctgggatgacaggtgtgagccaccatgcccggcctccttttacaagtttccataacaccaagcaacacttttttctttatcacggctagcttcatagacatatgacctgggcagtcacatagggccctgtgcttaggatggtccaatgcttggtttgatgctctgctctcagcatcttttttttgttttgttttgttttgtttttgagacggagtttgttttgttttgttttgttttgtttttctcctgcctcagcctccccagtagctgggattacaggcgcctaccaccacgcctggctaatttttgtatttttattatttatttatttatttattttgagacggagtcttactttgtctcccaggctggagtgcagtgatgcaatcttggctcactgcaacttccacctcccgggttcaagggattctcctgcctcagcctcccaaagtgctgggatgacaggcatcagccactgcacccaccccacattaggaccttaaacttgatccttaacaatgggatgtcatggagaggtttgaagcaagagagtgacgtggtcagatttgtgtttcagaaaggtcaccctgactctagcagacagtagggatggaagaggccaaatggcagggttgagtgaactatcaggatgttaacacatggactagggcagggctgtggggttgaagagaaggtcatggaagaggagtgggtaagatttggtgactgactgattaagggctaagggaaagtaacaagtacgggtgatgcctgggattctgtcctcggtgtccagggtggggtgcgggcagccctaaaatgagtaacacagacaggaggtttgcgggttggatgtggaattcgttttggatgtcctaaccaaaaccagctcctgtccccaaacaggaatcagaggaaccaaaacaagctcctgtccccaaacaagaagcagaggaaaaaccacactagcaagctgcaagagttggcactgctgctgcccatagccctgaagacggggaccaagaagctcacaaaggtacagggactagaggagaggggccagatttgggacgcaggtctttaaatagcagcaaatgggtcaccctctcctgggaaacctggacagatcctttcagtggcagcattcaaatgggaatggtgctactctgaacgggaatttccgggagtctgtgatcccataactaggtgcctggaggatccttttttgcaaaggagagaggagaaaccgggctggggaaatagagatagcacaaagatcattgttccaggaatcaaatagccatgggtttgagccctctagcttcacagctacagaactctgggcagtttctcaggctacccagactttctttttttctttgttcttttttgtttttgagagtcctgagtagctgggactacaggcacaggccaccacacccggctaatagtttttttgtatttttagtagagacagggtttcaccatattggtcaggccggtctcaaattcctgacctcaggcgatccatccgccttggcctccgaaagtgctgggattacaggcgttagccactgtggccagccaaatttattctcttatggttctggagttcagaagtccaatatcagtctcagtggctttttcacttgtttggttgttttggggtttttaggttttgttttgttttgttttgtttttgagacaggatctcactgtctcacccaggctacagtgtagtggctcgacctcagctcactgcagcctctgcttcccaggctcaagcaatcctcccacctcagcctcccgagtagctgagactacaggctcatgccacacctggctaattttttgtagttttggtagagacgaggttttaccatgttgcccaggctagtctcaaactcctgacctcaagtgatcctcccaccttggcctcccaaagttcggggattacaggcataagccactgcacccagccagtctcactggtttaaagtcaagttgtcagcagggttggttcctcttagaagctctagagagtttgtttcctttctttttgccaacttctgggggctgcctgcattccttgacccatcatggtccctcaaagccagcatggaagcatcttcaaatgtctttcctgtcctaccgcttctgttgtcacattgccttccctgcctttgacattcctacctctgtaagattatatgtgattacactgggcccacccagataaacaggaataatcaggccatctcaagatccttaacacagcgggctcagtagtttgggaggccgaggtgggtggatcacctgaggtcaggagtttgagaccagcctggccaacatggtgaaaccccgtctctactaaaaatacaaccaattagccaggagtggtggcgcgtgcctataatcccagctactcaggaggctgaggcgggagatttgcttgaacctgggaggcagaggttgcagtgatccgagatcgcgccattgcaccccagcctaggcaacagagcaagactctgtctcaaaagaaaaaaaaaaaaaaagatccttaactcaatcatatctgcaaagtcctttctttctgccatacaaggcaacatattcataggttctggggactaggacatggacatctttggaactttggggggatgcattatacagtccacgatggtgctaaaaatatttgaggaatgtgagtttttggcatgcataggtgctggaatagcccttggggagccagagatgactatgacacagtccctcccctcgaggaatggcagtcttgtcaggggactggcaacgtttcataaatgaccggatggccacatctcttggaattctccccaggcctcagcctacttatttaccatgtgtcctctgctgtcttcagaacccctcttctcccacctcttcatccttccctcagctgcatcatggggtcctgctccacagacaacccgcatcccggggccgtgggacatgctcagtccagtgctccgcgccatagcaggagctgtgagaattgcctctcctgtgttagagacttggggtgcagctttgattcagagtgtccttcctcaccactctggctggtgaattgccccctgccccgtctgatcatgtaggttctccctctgaccatgaacacccccagcgtatcactgcaattacttccttgtttccgacctccttcaggtggagttctgccagagccataaaggagacatctctgtccgccttgcccacagggcctagcaagagcagagagcagacagcagacagcagtaacaaccgttcccaacttactgagcgttccaggtgtcagaccttgagtgctaagtgtcttagatacatttttctcatttaactctcccacaaggcttgtgagagatgtatggctatgctcattctttggtctgaggaaactgaagtgcagagaatggtcacatcgcccacaggcacagagttgagatagaaagagagacagagagaaagagagagggagggattcagatgtggccaggcacagtggctcacacctgtaataccagcactttgggaggctgaagcaggcagattgcttgagattaggagttcgagaccagcctgggcaatgtgacgaaagtccatctctacaaaaaatacaaaaattagccagccatggtccccgctacccaggaggctgaagcaggaggatagcttgagcctgggaagtggaggttgcaatgagtcgagatcataccactgcactccagcctgagcaacagagtaagaccctgtcttttttttttttttgagacggagtcccgctctgtaccccaggctggagtgcagtggcaccatctcggctcactgcaagctctgcctcctgggttcacgccattctcctgcctcagcctcctgagtggctgggactacaggtgcccgccaccacgcccggccaattagtttttgtatttttagtaaagacagggtttcaccgtgttagccaggatgacctcgatctcctgacttcgtgatccacccgcctcgggctctgaaagtgctgggattacaggcgtgagccaccgcgcctggccatgagaccccatcttaaaagaaatagagtcagatgtatctcactccaaaggctcttgccttcaaccattctgtcactcaaggttcaatagatgtttgttgaatgactgaatgagctccctttgttgggacagttacaggacctgttgatcttaccttcagaaggtctttgagagtccagactctggtgtagcccccaagctaaccttcctgaagtttcaattactgaggcatctgtcttgaaatctgggatgatgcccaattgctttctacatacaacctttatactagtaataataagtaacatttatatattacttcatggtttataaggactttttcttagcgagtgccaaccatatgctccaagcctggtattagagataataagcttaaaaagactgaggctggctgggtgcagtggctcacacatgtaatcccagcactttgggaggccgaggtgggtggatcacttgaggtcggtagttcgagaccaacctggccaacatggtgaaaccttgtctctactaaaaatacaaaaattagccaagcgtggtggcacattcctgtagcccctgctactcaggaggttgaggtgggagaatcgcttgaacctgggagtcagaggctgcagtgagctgagatcgtaccactgcacttcagactgggcaacagaccgagactccctctcaaaaaaaaaaaaaagactgaggccaggtgtggtggctcatgcctgtaatcccagcactttgggaggccaaggcgggtggatcacttgagcccaggagtttgagaccagcctgaacaacatggcgaaacctcatctcgataaaaaatacaaaaaattagctgggcatggtggcatgcgcctgtagtcccagctacttgtggggctgagacaggaggattgctcgagcctaggaggtggaggttgaagtgagctgagatggtaccactaaactccagcctggccaacagagcaagagaccctgtctcaaaaaaaaaaaaaaaaaaaaggccgagcgcagtggctcacgcctgtaatcccagcattttgggaggctgaggtgggcggatcatgaagtcaggagattgagaccattctggctaacatggtgaaaccccgtctctactaaaaaatacaaaaaaattagcgaggcgtggtggagggcgcctgtagtcccagctactcgctgaggcaggagaatggcatgaacccgggaggcggagcttgcagtgagccaagattgcgccactgcactccatcctgggcgacagaacaagattctgtctcaaaaaaaaaaaaaaaaaaaagcgcaaaaaaaaaaaacaaaaaaagactattggccgggcgtggtggctcacacctggaatcccagaactttgggagaccaaggcgggcagatcacaaggtcaggagttcgtgaccagcctagccagcatggtgaaaccccgtctctactaaaaatacaaaacattagctgggcctggtggcacgcacctctagtcccagctactcaggaggctgaggcaggagaattgcttgaacctggcaggcagaagttgcagtgagctgagatcgtgccattgcactccagcctgggcaacatagcaagactctgtctcaaaaaaaaaaaaaaagaaaaagaaaaagaaagaaagacagggttgagcacaacagccagggctcaagacaacgtggggctgctggggaccagagacacagaggctccaggaaggaccccattccccacccaccccaacaattcttcagtcggcagagaccttcttgttctgctatctagccctcactgcagaccagtgagacaggggctacagctacaggctggagtgcagtggcatgatctcagctcactgcaacctttgcttcaggctgtgtctctggtccccagcagccccacattgtcttgagccctggctgttgtgctcaaccctgtctttctttctttctttttctttttctttttttttttttttttgagacagagtctcgctatgttgcccaggctggagtgcaacggcgtgatcttggctcactgcaacctccgcctcacgggttcaagcaattctcctgcctcagcctctcaagtagctggcattacaggcatgtgccaccacacccagctaattttttgtatttttagtagagacggggtttcaccatgctggccaggctggtctcgaactcctgacctcatgatccgcccacctcggcttctcaaagtgctgtgattacaggcgtgagcctggccaaccctgtctttcttttgaggcagaaggagattctggtgcatgtcctgcagtacattcagtacctccagagaaacatcgatgccgccaaggccttgttcaaatgccacatcaccactggggaaggtggacttgcgggtaagtagttcagccagtgtttcctggtgcctgtgatgttccaagtgttgttccagccatcagggatactgagtgacccttctgtcaaggcctggtataggggacaaagagagatatgcaagatgcctcagagaagaggggccttggagctgggccttcaggactgtaggagatgcagggaagcccagccaggcagaagaaacaggccgggcacagtggctgatgcctgtactcccggcactttgggaggccgaggcgggcggatcgcttgaggtcaggagttcgagaccagcctggccaacatggcaaaaccccgtctctactaaaaatacaaaaattagctggtgtggtggctggcgcctgtaatcccagctacttgggaggttgaggcaggagaatcacttgaacctgggaggcggaggttgctgtgagccgagatcacgccactgcaccctagcctgggcaacagagcaagactgtgtctcaaataataataataataataataataataataataataatatatacataaaataaaataaatctgatcatgaccttcccctggcataaaatccctcagtaattttcatcttcttcacttccctccatagccaggtgctggaaaccatttgggatctcatccctgccttcctagtccctgccaaacctccccagcctcatctcctaccattctgccagcgtattttatttatttatttgtgctttttgttttgttttgttttttgttttttgtgtgttttttgagacggagtatcactctgtcacccaggctggagtgcagtggcgtgatctctgctcactgcgacctctgcctcccgggcctctgccagtatattttacactacagtaacagcgacagcacccagcacatctagccttaggggactgctatgttccaggtgctgtggtatgtttctttctttctttttttttttttgaggcagagtttagctcttgttgcgcaggctggagtgcagtggcgtgatcttggctcaccgcaacctctgccttccaagttcaagtgattctcctgcctcagcctcccgagtaggtaggattacaggcactcaccaccacacccagctaatttttttgtatttttagtagagacggtgtttcaccatattggccaggctggtctcaaactcctgacctcaggtgatccacccaccttggcctcccaaagtgctgggattacagctgtgagcccctgctcctagccgtttttttttttttttttttttgagacaaggtctcactctgtcacccaggctggaatgcagtggcatgatcatggctcactgtaacctcaaaatcccaggactcaaaactccaggggtcaagcaatcctcctgccgcagacttctaagcagcttgtactacaggcacgtgccaccaatatccagataattttcttttttttgagatggagtttctctctgtcgcccagactagagtgcagtggcgtgatctcagctcactgcaagctctgcctcccaggttcaagccattctcctgcctcagcctcccaagtagctgggactacaggcgcccgccaccacacccagctaatttttatatttttagtagagacaggattttgccgtggtcgccaagctggtatcacctcaagtgatccacccatctcagcctcctaaagtgctgggatgacagatgtgagccatcgtgcctggctctggctaatatttttgtttgtttttttgtagagacagagtctcactgtgttgcccaagctggtcttaaacccctgggcttaagcaattctcccgccttggcctcccaaagtgctgggattataggagtgggccaccaagcctgacttgtttctatgtattaactcacatttaatcgtcaggacaaataccgaagggaaaagctaatgtggtcctgttttgcaggtgatggaactgaagcccagagaggttaaggtcacagagatgagcctgagtcagggcctggctcagagcccacacacatcatctccatgccacgcagacctccaatcacacccaatgacttgcctgtccccagacaccccgcgcgtgtcttctcatgcctgcaagctcttactcagatagtttcttcttctttttttttttttttttttctgaggcggagtctcgctcttttcgcccaggctggagtgaagtggcgaaatttcggatcactgcaagctccaccccctgggttcaagcgattctcctgcctcagcctcccaagtaactgggattacaggcacccgccaccacacccagctaatttttgtccctgacatgtagtgttgaggactggtcatgaagtgagagactggagtcagggagatgaggaaagacactgttcggagtgatctagacgggacaattaggcccaagctagcgctgtagatgagaatgtggatagaagtgagtaaacctagaagatgttaatgaggaagaatcgagaggccagagggaaaggccccagtgaccttgagggggtcggctaggagaccctcactgtgttgaggaaggcgggaggaggtactggtgtgggcggggagagggtgaagcatcctcaaggtgcccagtctggggaagtgttgattccattctcccactgagccaaggcccaaaacagccctgaagaaacctgagttcttgccctctactttcacagtcctgactgagcggccttggataagccctcagtttccacactgtaaagtcagcctgggggcccaccctgacccgggactgaggagcattgtctggaaggcaggaactgcagttggatgcagatggggtgggggatctgagctgtttccctctccatccctgcagggctgggtcagaaaccagcctggggcccagccaggcggaggagacactctaccccctccagctccccaagctctcagaagtcctgtctccagggggcgtgccagaagcctcggaagaagaagctgacccaggcatcaggtacaagctgtcactggaggcagaactagaagcccaggtcacccaggagcagggctccttctccagggatgtccttactctgggggccttctcagcaccctgtgccggggttcaactcccagctcctccttgtattagcactgaggcctcacacccggaaacttggggttcactggtctatggcagaacctgggcatcagtattttttttttgagagagactctcactctgtccaccaggctggagtacagtgacacagctcactgccacctctgcctcccaggttgaaacgattctcctgcctcagcctcatgagtagctgggattacaggcatgtgccaccatgctcagctaatttttgtatttttagtagagacagggtttcgccatgttggccaggctggtcttgaactcctgacctcaagtaatctgcctgcctcggcctcccaaagcgctgggattacaagcatgagccactgcgcctggccagtgttttttaaaggtcgcaagatgattctgacaggtggacaggggttgaacaaagaggcctgtgattgaggatctgggcattcccataccaggccaggcatagctttgacactgacaaggatgtttcccacctgaaccctattctggtgacaggcaggtgactcccaggcccctctgacacctgaacctctgctcccccagaaagccagactcggaccccgaagcctcgccgctctctggccctgaacaagcctgagaagctggtggccccatccccagaccagaaaggaagtggcacaggggggaccactacccctccaaggtgccctgactcctgcggtcacccgaggcctgcatcatcctcacctccaggtgacagaaaaggaggacagtcccagctgacgctgttggatctggccgaggacaccatccactgtgacatctcaagtgggtctctttcctcactctgaacttagtctttcagtaagatgccactctgggggcacctgctgtgtcccagacacagtacccgtagtgggggctgcagcagtgaataggaaacaccgcctcttacttctcaagcttgtggccttgctctggtggtcttcatctcaggctgtgtcgtggctgtaatggggggatgagatcagcgtcattgtcttgtgtgggcttcccatcacagaaccagggaggagggcagggcctccgcctcaggcctcacttggctctcccatgccccagtcactgcactggtttggaaaacgtgtggtgatgctttcaagcagagagctaggccagagggagggaggtcggagctcgaggctttgaggcctcaagtcatctcgttcctctatttgttcattcagccttttctttttttttttttttttgagatggagtcttgctctgtcgcccaggctggagtgcagtggtacaatctcggctcactgcaacctctgcctcctggattcaagcgactctcctgcctcagtctcacgagtagctgggattacaggcgcgcaccaccacgcccagctaatttttgtatttttagtacaaacagggttttgccatattgaccaggctggtcttgaactcctgatctcaggtgatcgcccaccttggcctcccaaagtgctgggattacaggtgtgaggcactgtgccgggcccattagagttttttgtttgttttgagacaaagtcttgctctgtcgcccatgctggagtgcagtggtgcactctcggctactgcaacctctacctcccaggttcaaacaattctctgcctcagcctcctgagtagctgggacaggcgcccgcacccatgcccggctaatttttgtatttttagtagagacggggtttcaccgtgttggccaggctggtcttgaactcctgacctcgtgatccaccgcctcagcctcccaaagtgcaggggttacaggtatgagccacggtgcccagcccccattacagcttctgatagggatgtgggattcaaaaaacccaggggtgatttggggcacccctcagcctcacaccaacgtgacaccctgcatcctgaggtttgggctaggattggggagtgagagggtgtgtggcagaagctggcacccctttgtcccctgcttctgggcttcctggaatttggtccagtccccaggcatggtcatcctgatctgccccttaggctgctggtgccagggcagtgtccaggatgacgcacctttccctgcgctcctggctcaggaagatgtggcgaggatccattttctcaacaagacccagccccatcccaggtaagggcgtccccagggcactgagtgagtggtgctgaggggtttggtctggcgtgggtgaggggtagtgggaagacaggccaagtcacgtcctctgcgggtgccccttgagcaccaatggaggcccagctttgtgtctgccattgtgagctcgcaggaaagcctgacttcccatttcccagacatggtcacagcttcctcaccagtctctttgcctcacctgttgcccctccatcccatcctcatgtgaccacatggcttttccaacacagagacgttgaccacggagtttgtggcttaaagcccttcctcaggcctgcagcatagagtccaatatttttgtttgtttgtttgtttgagacagggtctcactctgtcgcccaggccagagagcagtggcacaatcataggtcactgccgcctcaaccttcagggctcaagcagtcctcctgcctcagcttcctgagtagctgggaccacaggtgcacaccaccacacccagctaatttttttatgtttattttttgtagaaatgaggtccccctatgttgcctaggctggtcttgaactcgtaggctcaagcaatcctcccacctcagcctcccagagtgctgggattataggtatgggccactgcacccggcccggatatttcacctggcctttgagaccttcagtggcccccaactcacctcgtcagccctctctcctgcccttcacccatgactcttatacttcacactgccacacatttgccattccccagaagccctgcgccagcccctctgagcttctcacattccagtacttcttcctggatagcctgcttccctgtgcccctggaaaactgcccatccctcaggctgagcccactgctctccactggctcatcatcctccagcgccctcggtcacagcactgcttacgggctgggctatcctcatgagactgtaagctccctgaggatgggagcctcgactgactgagctttacacccccagcactcccccaggggccagtgcagagtgccaaaggggccccatagcagtttctagcccagagtctgtgagtctgactctgaaactccacctcttgcaggcagaagctggtgttctatgattccagcgaggatgtggacaaagggtccctagacgctgacccttggctccctgcctggaccccagagaacagcccccaaggtgactgcaactctgtctctcctccttgtaggctggtgtgggccttcccatactttcagtctgaggatgtctatggaagagaggaggcgggaaagggaatggagatcccctaagcacagggaaggcaaacacacagtgcacctgccagctctccgccaccgctgccacggaggcttgacaatcaatcaccactctttccttgagcccagacatggcctcagaatcattctgggtctttttggtttgtttgttttcttttttgagatagggtttcactctgtcgtccaagctggagtacagtggcgcagtctcagctcacttcaacctctgtctgctgggttcaagtgattctcctgcctcagcctcccgagtagctgggattacaggtgcccaccaccatgcccagctaatttctgtatttttagtagagatggggtttcaccatgttggccaggctggtctcaaactcctgacctacggtgatctgcccgcctcagcctcccaaagtgttgggattacaggcatgaaccacccctccgaactctttttgtgtttttgttttgttttttcttttgagacaagttctcgccctgaggctggagtgcagtggcgcaatcacagctcactgaggcctccaattcctggactcaagggatcgtcctgcctcagcttctcaaagtgctgggattacaggcacgtgcccctgctcccgacctcagaatccattttttttttttgagacggagtttcactcttgtctcccaggctagagtgcagtggcactatctcagttcactgcaacttctgcctcccaggatcaggtgattctgtgtcagcctctgagtagctgggattacaggtgtgcaccaccacgcctagcaaatttttatatttttagtagagacagggtttcaccgtgttggccaggctggtctcgaactcctgacctcaggtgatccacctgcctcggcctcccaaagcgctgggattataggcgtgagcccccgcatctgacctcagaatctttcttgttgcagagctgcaggtagttataatcagcctatgggactttgcacattatgatattgatttttctttttttttggccatccctgacataatgccaaacatcattttgcttcatttcttcttcttttttttttaaattttgagacagggtctcactctgtcacccaggctggagtgcagtggcacgatctcggctcactgcaacctctgctcctgggttcaagcgattctccttcctcagcctcctgagtaactgagattacaggcacgtgccactacccccagctaagttttgtattttttagtagagacggggtttcaccatgttagccaggctggtcttgaactcctgatctcaaatgatccgcccaccttggcctcccaaagtgctgggttacaggcgtgagccatcgcagccggctgcctcttcatttctgtgatcaagaattcaaaatgagaaactgagattcgctttccgtagcatcaggcactatctcctcaatgccagctgctgtgctagggcagagggtgatctctggccacacccctgagtctgctgttccctttccagggagcccactgttcctggggcctccccagattgatgtctggagtggaacaggccacccaagtgagatcctcgggctcagccctagccttttcagctccccagggaaactgctgccagacgagatcttggaggatgacatggagtacctgacccaaggtgaggcccaggcctggccctgatgcttagttcattcgggaaacatacggtgcccaggcctgcgctgggccatcctgggtgcccggggtgaatcctgccctggccctgcctcaaggagcccacggcctagtgggggagcagccacaggctggtgtggtgcatgggtggctttagaagcccatagcaggacttgagctcactctgtgtgttggaggtgacccaggggagtgggctgtgagcgggatttggacctagggtgggagatcctgaaggagaacgccagagacggggactccggctagcagggacggtgtggctgaagctgggcggtgtgggagaagcatttccactctggctgcccctctggtctccctccctagcggctttctttgaagaagtgtgcttagatctggagtcttcaccttcagcctacacgcaggaggctccacaggaaaaggtagacatcctctgcccctctgtccacagacacatccatccgtctttccacacacgtcactcatggcttcattcactcatccactccctcaccctttcagccaccatctacccatctgtccttccactcatgcgtctcctcatccttaaaaccgccccccgaccctctctgcgctcactggtggccaccagatgccggctctgtgctgggcacgtggaacgaattggacaaaatggataaaaaaggataaaagctgccaggtgcccatagaaaagaaaactcacatcattttattcatttattttattttattttattttattttatttagactgagtttccctgttgtcgcccaggctggggtgcagtggtgcgatctcggctcactgtaacctccgcctcccgggttcaaacaattctcctgcctcagcccccctagtagctgggattacaggtgcctgtcaccacacccggctaattgtgtatttttagtagagatgggggttcaccatgttggccaggctggtctccaactcctgacctcgagtgatccgcccaccttggcctcctagagtgctgggattacaggtgtgagccaccgtgcccagcttcccacatcattttacaactactctacgaagcagggtctcctgtggccccattttacagataaggaaattgaaatcaaaagactaagctgggcgcggtggctcacacctgtaatctcagcagtttgagaggctgacgtaggcggatcacctgagatcaggagttcaagaccagcctggccaacatggggaaaccccatttctactaaaaatacaagaagtgtccgggcgtggtggctcacgcctgtaatcccactattttgggaggccgaggagggcagatcacctgaggtcaggagttggagaccaaccagtctggccatcatggcgaaatactatctctactaaaaatacaaaattagccgggtgtggtggtacgtgcctgtaatcccagctactcaggaggctgaggcagaagaatcgcttaaacctgggaggcgggggttgcagtaagccaagatggcaccgttggactgcagcctgggcaacaagagcgaaacccagtctcaaaaaaggaaaagaaaaagaaaaagaaattatcagggtgtggccgggcgtggtggctcatgcctatacttctagcactttgggaggctgaggcgggcagatcacctgaggtcaggagtttaaacctagcttgaccaatatgatgaaaccccctctctactaaaaatacaaaattagctgggcgtggtggtgggcacttgtaaccccagttactcaggagtctgaggcaggagaatcacttgaacccaagaggtggagaatggagctgagatggtgccattgcactccagcctgagggacaagagtaagactccgtctcaaaaaaaaaaaaaagaaagaaaagaaaaaaaagaaaagaaaggaagaaagaaagaaagacagggtcttgctttgttgcccaggctggagtgcagtgtcaccatcatagatcagtgccttgaactcctgggctcaaatgaccctcccacaccaccatgcccagctggttttttaaattatttttaaatttaacttaattcaatttctttttttttttttgagacagagtctcactctgtcacccaggctggagtgcagtggtacgatctcggctcactgcaacctccgcctcctggatttaagcgattcttgtgcctcagcctccagagtagctgggactacaggcgcccaccaacatacctggctaattttttagtatttttagacagagtttcgccatgttggccaggctggttttgaactcctgacctcaggtgatcctcctgcctcagcctccgaaagtgctgagattacaggcatgagccactgcgcctggcctattttttttttttttttttttttttttttgtagaacaaggtctctctatgttgcccaggctggtctgtaactcctggcctcaagcagtcctcctgcctcagcctcccagagtgttggggttacaggcgtaagccaccacaccctgccaatctgagctgctgctaatgctcatgttatgtcctagaaaagcagtactggggggatgaaggggcaccacttgtctcccctcccatctttctccctcatcatgccccaggacacagcctccaaggcccccaaagaccctcctgagtcccacagcctgcaccggtcctcagtctcgctggaccactgctacctctcgctgagcgggaacagcaaggcgccatccagctccagctccagctccagctccagctccagctcggaggacagcgactcggagcccctgtggaagcagcgagaggtgagagacacggccgcatgccagggccagcagggcctccttcctctctcaccaccctctccctcccccaggatatgcaggccaaccctgtgggcacgccgggctccagcgaagaggacgaagacaccacatggacccccacccggctggcctcacccctgctggcagctgagaaaaaggccacgaagggccaagtagccagggcccctgtgaagcccaaggagaagaagaaaggcccctgcccaccccagatgaagaagaagtgtgtcaacggcttcatcatgttctgcaggatgaaccggaagcagtacatccggtgggtagggggtcgtctttggccctggggaaggccctggcttcgttctctgcccgcagcctggccatgccgctcctcacaactgtctgacactttttccccctccgagaccccacaaacccttcgtggaccacagttcttccccagaactgaacccggccccattgtattggacagggtccatccattgtcagcgctgaaacccaattcaggctttagacttcagaaaaaaaggagttttttttgttttgttttgttttttgagacagagtctcactctattgcccaggctgtagtgcagtggcacaatcacagctcactgcaatgtctgcctcccgggctcaaatcactgcaacctctgcctctcagattctcctgcctcagcctcctgagtagctgggataacaggcgcgccatcagctaatttttgtatttttagtagagacagggtttcaccatgttggccaggctggtctcgaatgcctcacctcaagtgatctgcctgcctcggcctctcaaattgctgggattacaggtgtgagccatcaggcccagcaagaaaagaaaatgaattggcttatataacctagaaaacaagggcgggtatagactgccttgagacatagctggttttagggctcacacaggctgtctggaatctttgtccttttcacccagttcctctgtcttccgggctggcttcattctctggcaggtggggtcaccccaggaggcacaggctcgggtcctgtcccccacccaagcgaccccgggaggaggagaggtctctaaggttttaagcaaagtccttgggactgactttggtagatccggtgccaaccctgaaccagtcactgccaggcctggagccaggggatggggaggccccccccaagccacagtggaaaacagctagttcctttacaggaagatccagatgtgggggccaggagcggtgcccacaggtcccctgcactctcctgggacaccaggtgcccccttgtgaacagccgctgagtccagctccctctgcctcctcagctccagagggtggtcttggaggccttgtagacccacaaggctaggaagggtctgagttctcagtcagggtgtcctgcagacctctccttacctcctcctccttcctgtcccagatcctgccctggaaccgcttccacagctgccaccaaggagctggcccagctgtggcgggtgatgacccagcaggagcggaggccatactggtgagaggctccggccccgaggtgtgggtggggggtggaagagcctccctaccccggaaccctgctctgtctctggagccttgggtgtcatggcatgggagactgggccgaggaatttgcgtgttgccccttcttatgaaacccttgggggtgacacaggtgtaggggtaccccaccacagctaagctggggaacagctgagcccagacatggacccctgcctcaattcttttgctgtctctgccacacgactttctcggggcgtggtctgattttcctgtcgcttggccacctcgactcccccgaatcctgtcccctccaccttcaaggagctgccacctgccctggctcctgactttgaacacatcccagagcccttggccgagtcccatcttactgactgggacttggtggacccaaggctcgcccaatagaggctaaaacggtggcccaggcccctgcggggacacaggattgggagtggtacagggatgcccgggaggcgagtgaggaagccaggccatcctgccaccgtctccccagcaccaaggctcgcaggttcagccgccagcacaaccgcatcgtgaagcaggacggctccagcagcgaggctgaggactgggagacgccaaagcccttctaccagctgctggccgagaaggccttgccgctgcccccgcacctccagtgagagggcggcccctcgcctcgctcccctcacccctcatggcaaccgcggctcttgctggaagccaggacccatcgatgaacttgtccctcctgggcctccagcccctgagaatgcaggtcccatgggactggggaggggggcactgattagccccaaccgctgggcacatttgcctggagcaccagagtcacccacagctgccttgattctcccccaggcttaggaaggaaacccaaaatgaaatgcggggtgtcggaaggtgaagtttacccacccctctccccttcccttccccaccccagagccactcggttgcaaccctgttcatgctcacctcaccctactcctccctctcctgttctatttttagactatttattgttttaaataaaataaagcaagtggaacctttgttaccagcaagagagacaagggcaggccctcctgcgtccccctgctgccccactggggtgctccgtccaccctcatctggaggcctgtggcttgcaagaggcctcagtgccaccccctccccagccactctgtgcatctgaatgcaaacccctcttcccctcgggaggcagcaatgggaaggccaggtctcgaggtgggctctgtgttcagcgctgctttggacagacactggaaggcaccccagacccctggtggtggtgtaatccgataactttattttaattgaaaatggaggcataacatgtcctagaaaaataaagatttaggatacaaaggagacacagcggcagggctgcccccagggatgagggaatctttggtctgggccggataatgaggacaagggcttgagtcgaggggagctggtgaaggaagacccccgtctccccacagctgccccaccccccgcccctggcaggaaatgccacactggggagggtctccagtctcaggggcgcggggctgcctgtcctccaccttcggattccaggcagttgtgacaacaccagctatcggcagagctattaatagtgtttcagggagtgacagggagagggctctgggggctggaagtccggccctggggcagggtgttccgcttacagctagtaccaagtggagggggcagggcccctgagtcaggaccctgagtcccccacgtatatggcagggcacagcatggggagggctgtaacagagaggcctcccatccaaagggggatggagacctggacaggaggtggccggggatacaacccccagcaccaccagggcttggagaggccacccaggcagaaggatgtggtgactggggtcttcagcaaccgcatttctggggctcccccctcccattcctgtccctgcgtcttcagcaccaatgtcgggagaggccacggggccacactgggtcacagttccaagggctcctccacaggcaccgactggagctgggtcagaaccttggcctcagcttccaacccctcgtcaacctcaccccctgcggtggcccccaggagcagcccctcagggtcggggtctggcagcctcagcacggtgtggggggcctgtgtccccagccccttttccgcttccagcagcccctctgttcctgcgcttagttccagccctgctgaccagacaggcacggccgcgggtgacaacatcagcccctctggtgggggcgccgggaagttgggcaggaggccaggggagtcaggggagaagggcaggctggtgctggaggtggtggcagcggcggggggtggctgctgtgcagaaagggtgcctagggcgtgagcctctgggagagcagggctgggggccaccgggaggcctccctcaggcacggagatggccgtctctggcttcagtggcagggccaggccgggggctggcggcaggacctgggagacgagcatgctggtggggaaggtggcggtgaggatgatcttgccctgctgcagggccacacccgtcacgatggggctgccagacacagggttggccaggaggaagtttcctgtggggagagagggaccgagcgcaggtgagagccaggagagcaggccaagccagagagaagtggagactgtgcagctggagggcgggcggagggagccttgtggtgggccttggggcactgggacttgccagggatgagatgccctccaggagcccagggacagcccctccctctccgagatgactgcacccctccccggctctcacctaggcctgagggagggagatgggggtacctggggcagtggccgaaggcagctgcagggcagtcacgcccaccccggagttgatgaggtgcacattggcagggcctgctgcagctgccaccttcacagggctgcctggcccggctgccaacagctgcaggggccccacagcctggggcagggtcaccacctgtgaggtgggtactacctggggcaggttcaatagtggggaggtggggctcaggcccgtgggataccccgggggtggggagagcggtaccacttgtggggcagccacagcaggcactggccccgggggcagaggaaaggtggcagccgtcggggggccaggcaccacttgggccaggggccccaggacctcctctccaagggctggtcccggagcagccacctgggcccctttggtctcaggggcctccgactgagcctcctccagccgcacctcccctgtctgagggtccaggaccagagaggtcttggtctcgctggccccctgagggctgggctgcggtggaggggcacccccgcccccagtgagcagcagcgggcccaggctggaggcctcgcccagggccaggccgttgatgatgacggggcccccgttgaggagcactgctggggagccgctggctgccaggaagctcccgttcaccaggatggaggaggaagccgggcaaggcgcgggagggccggtccctgccaggaatatggagccctgggcagcggcctcggcggacactggggccgcccctctctccaggtcctcaggacttcggctggactcgtcctcagtcgtgggattcccatcagactcgctggccggagaaatggctgtcagctggggtcccttagcctgtggggcctcccgcatagccagccagctgctcccccacctttccctggcccaagtttcggtggatcattccaggggttatgacgcctctctgagaccactccaaactccagggccttttgcaagccctgcgtggacaccactgcagagaagcgctggggagggaagaggcccttgctctcccccacctcggcctcgggtccccagaggctgagctcccaggttgccctaaaagttccttggttgggcggaaagcgggcgagtggcctggagagagggagcagcagccgccagcccagttcccggtgccctccccgcggggcgtcagagaagggagaggccggcgctcagggtgggaggagaagggtttgggttacagggaaaccggagctgggaaaggttcacgtttcacaacaaaggcagaagacggaccacgccgtccgggcccggagggagtgtgggggcgggtgggtaagagtaacggtcagtgaagaaagggggctgggaggcagcccctacgcggagtggagtggccacaggccctgtcctttttcctcagtccctctagtgccccccgcagtgtgattccccaacaccgatgggatttgggaaggagctcggaatggagccgctggaagaggagacgcgtgcggggagagggcccgggcgggtgcctgtcccgtccacacttagtccccgcgccccgcgggcgcctgagattgtgagctggtcccgggagatgtccgaggacctcggcgcgccggccccagcagtgggcacgggggaagagggctggtggacgggatgtccccgggagagctggacttgcgccgcccgaggcccctcacctcttgcagggcgcgccgcctccggccccggtccggtcgcgctgtcgccggttcttgaaccagttgctgacctgcgtgagcgacaggccggtgagtgtggccaggcggcgcttctcgtccggcgtggggtagcggttgccgcggtagcaggccttgagcgctgcgcgggagcgctccttgaagcagtagactgtctcctcgccgtcccagatggtcttgggcagcgggaacttcttgcgcagtcgatacttgtccactgcgccaagcgcgcggccgcgggcccgctcggcctcatggtagcgcgcgcgcaggtagaggtcctgcaggaaggcgtggtgggcggcggggaaggggcggctctcgagtagccggtagagctcggcgtactcgccccgctggaaggccaccagggcccgcgcgcgcaacaccgggtcgctgccacgtaggcgctcggccgggggcagtgcgcccaggaagcggctcaagcggccggcgtggcccgcctggagcagcgcctcgcagacgcacgccacctgctcgggcgagaagcggaggcccgtgggcggttcggaagcggcctcggggggcgacccggggacgcccggggatcccgggccctcagctcccgcagccgctgcgcccgccccggccccggccgccgccgccgcctcaccctcggccgcctgcaaagtctgcaagagctggcgcgcttcctcctcctcctcttcggtcgccgccgccgccgccaccgcctcccccccagccgccggccccgcgctcggctccgcaggcaaggtagccatgttttgcaactttgggaagttcctccctccctctcttcctccctcgggctttccccagcctcctcccccacctgtccccccttttcgcccccactccccgctcttctcgatcttctttctggccgaccctgcgccccacgccgggaaggcgagatccagctctccactcgggtctctgtccccttgtgtgtgtccgtccccctcccgtctgtctgtgattctccctttgttttccctccgcctctggccgcgctttctgcctccccccagcgtgtgcttctggctcagggcctcagtttccccatcgggacaacgcagaaggtaacgggccgtccaggaggactaagggcgcgaagcctccgccccgagactgagcttctgcacgcctccgtctccagggtcctctgcaggcccccacattccccatctcggcctgcgctccgcccctcggaattcccggctccgcagggggggcgggtctggccgggaggaggggcggggaacgggctagaaagtttgcagcaacttttctcgagcttgcgtcccaggagcggatgcgcgtggcgtgcgcaggcgcagtggaaggaggatggccgcgcgcgctgccagcccagccccctcttctcgacgctcggtggcacagctgggccacagctgggcgggggcggtgcctccgggtggcccgctcgccctcctattggccggacgccaaagccccgccccgtggcttttcctcccccaaccctgattcggccgcttcgcatcccgctagctcctcccagaccttcggccgcctccacacgcctccggattggcccgctgcggagcctccggcccacaacgcaaaccgcggacactgtggagtccagagctttgggcagatggagggccttttattcgcgagggtcgggggtgggggtcctaggtggggacagacaataaataccgaggaatgtcggggtctcagtgcatccaaaacgtggattggggttgttgggggtcctgtagcctgtcagcgagtcggaggacgaggtcaataaatatccaaaccgccgaagcgggcggagccggctggggctccgagagcagcgcaagtgaggaggggggcgcgggatccccgaaaaagcgggtttggcaaaagcaaatttcccgagtaagcaggcagagatcgcgccagacgctccccagagcagggcgtcatgcacaagaaagctttgcactttgcgaaccaacgataggtgggggtgcgtggaggatggaacacggacggcccggcttgctgccttcccaggcctgcagtttgcccatccacgtcagggcctcagcctggccgaaagaaagaaatggtctgtgatccccccagcagcagcagcagcagcagcagcagcagcagcagcagcagcagcagcagcagcagcagcattcccggctacaaggacccttcgagccccgttcgccggccgcggacccggcccctccctccccggccgctagggggcgggcccggatcacaggactggagctgggcggagacccacgctcggagcggttgtgaactggcaggcggtgggcgcggcttctgtgccgtgccccgggcactcagtcttccaacggggccccggagtcgaagacagttctagggttcagggagcgcgggcggctcctgggcggcgccagactgcggtgagttggccggcgtgggccaccaacccaatgcagcccagggcggcggcacgagacagaacaacggcgaacaggagcagggaaagcgcctccgataggccaggcctagggacctgcggggagagggcgaggtcaacacccggcatgggcctctgattggctcctgggactcgccccgcctacgcccataggtgggcccgcactcttccctgcgccccgcccccgccccaacagcctacagctgttgttagtccactcgcacgcctcgaatcccgtccgaactcgtcattggctgcttcctagcggcctgtgttgattggctgcccgaagatccgccctcctgccgtgggcccagccccgcaaatgcgcagctaagcgggtggcaaggggcgggtggagcgcggggcgcgacggcggaggggggcgtgggcagccggacgtaccctggcagggagcagcaggtggcggcggtgcatggggcctggccccaccagcgggcactggcccacagccacggccggggggccatctagctggagagagaagggacaggtgacccgatcggagcccagcccagccctcagcggtggggcgagagacagcgaggggaatcgaggttggggaggttatctagggagatcccggagggaatctggtgaggcctgaacggagggagatctggggctgaataaagggcttctgccctctaaagtcgcaaagacgtagggtgagccctatatctggacggggagaccaggagccagggaggggatctgcagaatgggcagcaggtctgaggcaggggaaagagaggggtcttacatgggaaggtggatccgtggcccggggactggggacccccgtgacagctggaaggagaagaaagaggcatagggcgcgtggaggggcgaaggagggcggtggcgcggcgtgccccagcgtgggtcccttccctcctccaggtgtctatacacgccccgcggagcagacggcccacctcctcccggtcctccggggaaggggacacatgagggactcacctgtggctccctctgcctgcagcaactccatccgctcctgcaactgccggacgtgtgcctctaggtcccggttccgagcctctgcctcgcgtagttgactgtggggaggtaaggacggtgagtccgtccgggccggacgagaggggatgccaagggttgccaccggcccgcatcccggccccggccccggccccgatcccgacctggcgaagttctggttgtccgtgcggatggcctccatctcccggctcaggctctgccgggtgagcacctcctcctccagggcttcctggagctcccgcagcgtcacctcggcctcagcctctgccgcagggacagccgctggaactgccacttcagcctgtgtatggggaccaggcttaaggctgcctgtggctcctggaagactcaggacttgggcactggttccaggctaggaatccttgtttatcccctactcctccgtcccctcaacatttctggaatccccatagctcctgcaatgatccaagccccctcccttccctacctccctcagccccatccctgagtctggtcctctaaatctacacagggaccagagggctggtgctcaaacactaacacaacctatgtccctctgctgctcaaaatccctccagctccctaatgccctcacgacaaaaggccttgctgggttttgtttcctgctggcctctccagccttctcaggaatgattcagccaaactacctttcaggaacaaatcaggattcccacctgcccaaggcctttgccctggaggctctcgcctgaccacttggcacctttccttccatggcttgtttctccttcaccagcgctcagctcaaagatcgacttctcagatccccagcaacacacacacccttacttaatgccccactgtaactacagagaccgtcccatgtctgaagtaacctcgtctctccgtggtttctgtctgcttctgttcaggaagtccctagagggctctacagtgcacgccacccgggaagccctcaccttttctctcccaattgtccctgacggaccccctcccctccaccaacttactgtttcatcctgtggggacaccgagggctccaggctgggcgcttgcacgtgtggctcaagcagctgctcggcctccagttccatgggtgtggggcctgggacctcactgtccctggggagaggaggagggagtggggagggagacagaatgctgattctctggtggagaaccagaacttctggcctgtgggtaggggcagctgcttccaagacctcctgatttgaggaaggggagcagcagagcgaagagaacagagtcccaggtaggccaatagcccctcctctgcttaggaaaagccctgcccctctcctggccttgggcccctgggagctgctctttctaaaccttctgcagggacttggggtccagacccccatgttctagggtcagctcatctcctcccttgacatgtgaccgctgcagacccctcttctcagggcctcaggacagggaggccgacctgatggggagactgcttggctctggccacctccacagatgtggtcctaagactgggcatgggaccccaagatggcaacttgaggtcagcacaccccactcagctgtgggaaggggacagctcctccctggggtatgaagtggctgtcccctccaacccagcagtccctcctgtgggaacacggctcaggacctagctatcctggacatgcgcctgggttctaatagaggatgggttcaatcctgacccaccgttcaggccccgcagcggttcagaatcaagctggagttcattaatgataaggtatagtatgtgtaatgttgtccagtaataaaagctgactagaaaaccaactgttctcttagacaaagtagcatgaggaaggggaaaaaaacaaaccaaaaaaacacctgttctccactatttaaacatgtgtcagtacacgtgtgagccagggaccactgccatctggtgagctcacgagatatcaacttccttttccttatctgtattttctaatttacttgtgataagcaatgcattatttgtgtaattaatacttttgttgagaccaggtctcactttgttgcctaggctggaatctatcatggctcactgaagcctcaaactccaggctcaagtgattctcctacttcagactcctgagtagctaggactgcaggcacagaccaccatgcctggcacgattttttcaattttttgtagagacagggtctcattatgttgctcaggctggtcttgaactcctgggctgaagcaatccgtccacttcagcctcccaaagtgctgggattccaagcgtgagccaccatgcccagcctgtaaattagtacttttttttttttttttttgagatgaagtttcactcttgttgcccaggctggaatgcaatggcacgatctcagctcaccacaacctccccctcctgggttctgattctcctgcctcagcctcctgagtagctgggattacaggtatatgccaccacgcctggct

SEQ ID NO: 1276 - DNA, 116927 bp, Homo sapiens
aaatgactactggatgaataacgaaatgaagggagaaataaagatgttctttgaaaacaatgagaacaaagatacaacgcaccagcatccctgggacacatttaaaacagtgtgtagagggaaatttatgcactaaatgcccacaagagaaagcaggaaacatctaaaatcaacaccctaacatcacaattaaaagaactagagaagcaagagcaaacaaattcaaaagctagcagaaggcaagaaataactaagatcagagcagaactgaaggagatagagacataaaaaacccttcaaaaaaaatcaatgaatccaggagctagttttttgaaatgatcaacaaaattgatagaccgccagcaagactaataaagaaaaaaagagagaataatcaaatagacacaataaaaaatgataaaggggatatcgccaccaatcccacagaaatacaaactaccatcagagaatactttaaacacctctacggaaataaactagaaaatttagaagaaatggataaattcctggacacgtacaccttccctagactaaaccaggaaaaagttgaatctctgaatacactaataacaggctctgaaattgaggcaataattaatagcctatcaaccaaaaaaaggccaggaccagacagattcacagccaaattctaccagaggtacaaagaggagctgctaccatttcttctgaagctatgccaatcaatagaaaaagagggaatcctccctaactcattttatgaggccagcatcatcctgataccaaagcctggcagagacacaacaaaaaaagagaattttatatcaatatccctgatgaacatcgatgcaaaaatcctcaataaaatactggcaaactgaatccagcagcacatcaaaaagcttatccaccatgatcaagttggcttcatccctgggatgcaaggctggttcaacatacacaaatcgataaacgtaatgcatcatataaacagaaccaatgacaaaaaacacatgattatctcaatagatgcagaaaaggcctttgacaaaattcaacagcccttcatgctaaaaactctcaataaactaggtattgatggaatgtatctcaaaataataagagctatttatgacaaacccacagccaatatcataatgaatgggcaaaaactggaagcattccctttgaaaaccagcacaagacaaggatgccctctctcaccactcctattcaacatggtgttggaagttctgggcagagcaatcaggcaagggaaagaaataaagggtattcaattaggaaaagaggaagtcaaattgtccctgtctgcagatgacatgattgtatatttagaaaaccccatcatctcagcccaaaatctccttaagttgataaacaacttcagcaaagtctcaggttagaaaatcaatgtgcaaaattcacaagcattcctataccccaataacagataaacagccaaatcatgagtgaactcccattcacaattgctacaaagagagcaaaatacctaggaatccgacttacaagggatgtgaaggacctcttcaaggagaactacaaaccactgctcagtgaaataaaagaggacacaaacaaatggaagaacattccatgttcatggataggaagactcaatatcgtgaaaatggccatactgcccaaggtaatgtacagattcaatgccatccccatcaagctaccaatgactttcttcacagaattggaaaaaactactttaaagttcatatggaaccaaaaaagagcccgcatagccaagacaatcctaagcaaaaagaacaaagctggaggcatcacgctgtctgaattcaagctatattacaaggctacagtaaccaaaacagcatggcactggtacgaaaacagatatatagaccaatgcaacagaacagaggcctcagaaataacaccacacatctacaaccatttgatctttgacagacctgacaaaaacaagaaataacaagaaatggggaaaggaatccctatttaataaatggtgctgggaaaactggctagccatatgtagaaagctgaaattggatcccttccttacaccttatacaaaaattaattcaagatggattaaagacttagacgttaagatctaaaacgatgaaaacctgccaggcgcagtggctcacgcctgtaatcccagcacgttgggaggctgaggagggcggatcatgaggtcaggagatcgagaccatcctggctaagatggtgaaaccccatctctactaaaaatataaaaaattagccaggcgtagtggtgggtgcctgtagtcccagctactcgggaggctgaggcaggagaatggtgtgaacccagaagtcggaggttgcagtgagccgagattgcaccactgcactctagcctgggcgacagagtgagactgtctcaaaaaacaaaaacaaacaaacaaaaaaacaccataaaaacctagaagaaaacctagacaataccattcaggacacaggcatgggcaaggacttcatgaataaaacaccaaaagcaatggcaacaaaagccaaaaatgacaaatgggatctaattaaactaaagagcttctgcacagcaaaagaaactaccatcagagtgaacaggcaacctacagaacaggagaaaatttttgcaatctacccatctgaaaaagggctaatatctagaatctacaaagaacttaaacaattttacaagaaaaaaacaaacaggggcaaagtatatgaacagacacttctcaaaagaagacatttatgcaaccaatagacacatgaaaaaatgctcatcatcactgctcatcagagaaatgcaattcaaaattacaatgagatatctcacgccagttagaatggcgattattaaaaagtcaggaaacaacagatgctgcagaggatgtggagaaataggaaagcttttacactgttggtgggagtgtaaattagttcaaccattgtggaagacagtgtggcgattcctcaaggatctagaactagaaataccatttgacccagccatcccattactgggtatatacccaaaggattataaatcatgctactataaagacacatgcacacgtatgtttattgtggcactattcacaatagcaaagacttggaagcaacccagttgttcatcaatgatagactggattaagaaaatgtggcacatatacaccatggaatactatgcagccataaaaaaggatgagttcatgtcctttgcagggacatggataggctggaaaccatcattctcagcaaactctcacaacgacagaaaaccaaacaccacatggtctcactcataggtgggaattgaacaatgagaacacatggatacagggcagggaacattacacaccagggcctgtcagggggtgggaggctgagggaggggtagcattaggagaaatatctaatgtaaatgacaagttgatgggtgcagcaaaccaacatggcacatgtatacctatgtaacaaacctgcacattgtatacatgtaccctagaacttaaagtacttaaaaaaatatgctaaagggccaggcacagtggctcatgcctgtaatcccagcactttgggaggccaaggtgggcagatcacctgaggtttggagtttgagaccagcctggtcaatatggtgaaactctgcctctactaaaaatacaaaaattagccaggctggtggcacatgtctgtaatcccagctacttgggaggctgaggcatgagaatcactggaacttgggaggcagaggttgcagtgagctgagattgtgccactgcactccagcctggacaacagaacaaggagactccatctcaaaaaaaaaaaaaatgctaaagggagtctttcaggctaaaatgaaaggacactggccagtaacttgaatacttgaatctgcatgaaggaataatgaacatggggagaggtagatacctaagtaaatataaagggcagtattaatttttttcctaacctctcttttcctacataattttaaaagacaactgcataaagcaataattaaaaatttaggttgatgggcatacaatgtgtaaagatgtaatttgtggaaatataatataaagggagtagagctgaataagaacaaagtgtttgcatattattgaaattaacttggtattaatctaaaccaggttgttacaaattaatatatgaactgtaatctctagggcaattattaagaaaataaataaataatatatactttaaaaagatacagatttagaattatcctagaaaatatggatttaacacaaaagaaagcagtaatgaaggaattgaggagcaaaaaagataaaagacatagaaaacaaatagcaaaatggcaggagtaagcccttttcagtaattatattaaatgtaactcttcaattaaaaggcagagattcaccaaatagattttaaaatcatgatgcaactattatgatgtctacaacagtttcaatttagattcaaagacacaaataggttgaaaattaaaaggttggaaagatcttccatacaaataaccaaaagagagtttgaatggctgtattaatatcagacaaatagattttaacaagacaaagaaggtcattatattacgataaaagggtccaaacttcacatatttttaatgcatttcaactcctgatatgacacacttttagctctctatttctccttgacactcctgcctccatccatacgttgtcctgcttcatctctgattatcccaattctattcatgttcaaggtttaccccatgacaccctctttcttggaggcactatggctttggctaagtgcccagatccagagtagataaagtatatggtccaaaagtagatgtcttcacttactagctctataactttggggaagtcacttaactttcctgagactgtttcctcaactgtaaaattccttacctatatcaggtttctataaagattaaattagatcatgcatgtaaattataatgtaattattgactctacaaataattagtccttatcatattatgcttggttccatgagggaaattgtaactacctttggcggaaaagacaggcttatccctaaggtgcttaagtagtacactcactgtacatttggtagttttaaaaaaaaaaaacttaacaaatgcttttactcattcatccttgaatgagagacacagccctcagcaaaacatccttcatgaagcccacacctacttctttctctttttagaccaagcagactaatagtatctgggcttcctgacagcttgggaacaaagcatgtaaactcgcctactgtcagcctccacaccaccatgagatggatatgggctccctggggtgtgcagttggtgagggaaatgctatacttgactatgactgagtgccacgttcaaatattcatgtagtactcatgatttgtgttcaagcctccttccatgggaagaaccagcggtggacctgaagagctctgccttcaaacagatgattcactcagaacaggttgctggtgactgaacctcagtgacagggtcatcctttgacacccagctctccaagggcaccttgctcagggaggctaagctcagagcaaaagtgccttttggagtgctagcttctttctaccaacaatgacagatttccatctgtgctgccaaacatgtaagttctttccttaaggaacacttataaaagatgacttccaggccgggtgcagtgactcacacctgtaatcccagcactttgggaggctgaggtgggtggatcacctgaggtctggagttcgccaccagcttggccaacataaggaaaccccgtctctactaaaaatacaaaaattagccaggtgtggtggcgggtgcctgtaatcccagctacttgggaggctgaggtagaagaatcacttgaacctgggaggcagagattgtagtgagccaagaccacaccatcacattccagcctggggaacaagagcaaaactccatctcaaaaaaaaaaaaaaagacttccttttcccagaaaactaagggcccccctacatcaaaattatttccctttggctgttcaggaacaattgctcatctcctttcgattttttgacttttaactcctcctcaaggaagttaagggatgttttttgctattggtaggttgtgcttttctagagggaaatagttctagtattgagatctaaactgagaattgctgattatccatggaacaagcattttaaaaacaagaccagaccctagctcccacagaggacatggttgatagcttagtaccaaagcacaagcattatcttctgagtgggaaagcagatatggagcttccttgcccacctgacacctaagccaacatgtgcagaattggagccctccaaaacttgggcctcttccaaggttctccaagtcaatgaagggcatcattgtgtcagcttgggtcctcctagagcagacaccaagatggaattaaacctggaagagtttattggggaaaatgcctatgaagaataaagaggagcagaagcaagagtaagcagagagagccccacaccgtaatgcaggtctgacccctgtgaaagagaagagggaaggatggaggagtagataggaagagcctcagactgcagagccattctgagaaagtgctggccagactgacaggaagccccagagtacaggtggcccattagaggagttttgcctctggcattccctcttatagcgtcaaatgcatcttgtagtatttaggatggcattctatatttgaccaattatttgattgctttattacctcactcaagtgtgtttcccgagggcagagaccacatttatttttgctcatcactgaatccccagcattagcagggtggctgcattttgtagttgccacagaatatttgttgaatgaaatatctaaaagggttatttttttcatttttatctgaatcacacatcaggtatttttttttcctaaccagtgactcctaagttagatgctgcttgcaccatgctttcattccatttatatcattcttcagctgggttgcgtgatcatcagctgtgccccgccccccaaccctccattgcccgattctgtagtaaagtcttttgggactggccttggacttggacttttgcttcttttgtgtctttactgactatcagtgcaggcctggataaagttcttgttgcagaacttgctactgcacaaacttttgttccagggttagatcaggaaggatagtaaggaaaacagagctgtctccaaaaggtgggatagaaagctgtcctttagaagttaaattataaatcaagccaatcagagcaaagatacaaaatgtctccataaagaaaaataagggctgagagaccttactgagtaatgttactcagtaacgccttgctctatctaaaaatgtccatctgaggagaggcggcctgggtaccataatacagagagcctcatcgacacaaacagatggtgtccaccaggccccatctagggagaagggctggccaggccagcagggatgagtgaacagtacttcctataggttttgacctgtgttgtggaaagagacatcccacattgcccgagcctgatatcatcaaacatttaagtcagacaattcactcttccgattctgattttaggctcactaagccaccttctgactatggggctccaaactgcatggctacaagaagagaatgtgttcatcaggtggcctcgagtccagtgttcccgacagtcttgcttctaacaggaatggataagcttcaggttttggggtcagatggccttgattcaaaccctgccactaacatacatagtaactatgtgaccttgggatttccttcatctttttttctcccaaatgaaaaataaatagattataatataccacatgatagtagggagaaataatgaggtaataatgcatgtaatgcatttagcatagcacttctctagcaaatagtgaatgaaatcagtcagttgtcattctgactttatgcaacagtgctaatcgactctggtacactggaagtcagatgagatttttggccccacaaagtcaaggaccaaacctggaccttgggaagttgccaagatgaaaaacatcaggccggccttgacctcctgatgctctctgttcacatgtgtgatgtctataaaaggtaaccaggatttggcttatctgcttacatctcttcctgtcttttcctgatcttcatcttcccaaacatagtttttatgcagaagcagatttaactctactttgctatcttggagtcaagaattgtcctataaggaggaagaggctccaaggcttgccttttttgttttttctttttccttcatactacagactaaaagtagcatcttctggacagagaaacaggctgttgtttttctaaggtcatcatttggcctgccccactttcccacctgctcttgagggaactattgcaaggacacatacaagcccctacatcagtcacagaccagggcctccatcttgcagggaatgtgcccaaattacaaacaggtaaaccaaagtgactctgggcagatttaatagctcattttggtttcttgttccagttataacagactgctctgtgtttgctctatggcaaaaacttttatgtttgctttgcaacaaacgtacagacagggcaaactgtgtttggagtatggtgtcttaccaatgttttctaaaagcaagtgaatagaaatgcttgcaaaagtattttcagacctcagtggccagcgctgaacaccgctgtaggaatgtccatcaaacgttgtggccatgctccactctaacaaaaacctggttccgtggcataattgtgggggctaattgtcaggctaagtttcagacaccttccaaaaaaaattgcagggcttcctcagtctttaaactccagataatattgtccaaactttgacaactaacctgttatcatggagatagctccaagttgatggactggccattagagaatgtctatcaagcatccaggtaaatgacttggttgctgccctcaaggaacccacttagaggctgtcagaaaattttaagtattttcttccttctattgttcattcctaaaattctggcagtaggtatgattattattattcccatcccacaggggaagtaattaagtctaactacttgaatattttgccccaaatcactgacagtaagagacggccagacactgaaacctggaatctctaaatgtttagatattgatgggcaccgcttagaccagggagtccaaaccataggcttgctgttccagtttctcttatcggatgaagggacccccatttcaccgacgtcattgacttttgggttctccgctgaccccagatgagatgcctggtacctcatggtcaagtcccctccaacggggactcctcagaggcttggtcccagttgctcaggctgccatctgcctcctcaggccagagcccgaggcgccgccagcggtcaggtcccgggccggctgccagccacaggcccaagtaaacgctgaatgaagggcagatggaggaacctgtcccggtcggccgaagcgccgcgggcgcctttccacttacggcgggcctgcccagcctcccgcccagcccgggcccgggtcccgccgaggcaggtgtgcgtggcggactagctctcgggcactcggctggcccagctccaccccgaacgccaccgggccaggccacgcgcagacccgagcccggggcccccgcctctggctgccggcccgcgcccgccgcgcgccccgcgttcactgcgcgctcggccccggtcccgcctcccggagggtttcgctttcgctttcctgccgatgtcgttgaggaaaatgaaagcggtcgtggccaggactggcgcagctgccgtttcaggcgaggggcgcagaatgcagcggccgccagcctggagcgcgggccctggggccgcaacccgcgccgggcgaggtaagcacagccccttcgcggccgcctcgcgggctcctccttgcggacccggcgggcccgacgccaggcgtttgacccgggcagggtcaggggttctgccgtgggggcggggagggcctgagaagcggcacccttgggtttcgtggctttgagcctccaggccaggctggaagacctgggaggcctcagacaagcgtgccaaggggctagcagcccggggtcgagctggaaccgtggcaagtcgggccacctgagcacgcctttcccttttgtagagcaccgacctccctgggtgttggtaaaaatcaaaagtgggagggtgtacgtaaaatgctgaacagaatgcctaacctgagctcataatctactccctctgacctgtcagactcatttttcccactgggccccaccccatacctcatgtagtttgcttaagtttcctagatctggtgcacctgggggcacttggagtgccttccaagtgttccttgaccgagcaagctggcagctcatctcccttgatcacgggcatggagagcaactaggccaggatgtggcccccttgccctggccctgtccatgtgaagtcagggccttactctgctggggcccccatcccggggctagcatagatgtcagggataggtgcactcacagaccgagtccttcccagaccaggaaatttccagtccactgcatctgccagcagaagcatgaaagatgcgtgccaccttgtctttgcccttcgtcaagtatagccaactcattcttggtatgcaggaagggggttccaccccagggctgtggaaacagcccctgcccttagggcgttcccatcccctgaagagagaaaatatgtattcaagttacccatcaggcaggttgtgtagaacaaggacaggtgagtgaaagagctaagagctgagagtaaagtgactaaatcatcagaaactttacatttaagttatgacaggttttgcaggccaataccaagaatcccctttaactcaatttttgtctcaataataatgaattcagcctaatcacacagatctgatcatacggcccattactgaaacaaaacttgaatgatctttactttgagaaaaccatctgaatttgacaaaagatggtctaagttcctaagtttcaaaacatggagtccgccgctgccctacctcagcaggatggtgttgagtactgattgcttttagaaaatgctgctcttgccgggcacggtggctcacgcctgtaatcccagcacttcaggaggccgaggcgggctgattacctgaggtcgggagtttgagaccagcctgacaaacatggagaaaccccgtctctactaaaaatacaaaattagccaggcattgtggcacatgcctgtaatcccagctacttgggaggctgaggtaggagaattgcttgaacccgggaggcggaggttgcagtgagccaagatcgcgccactgcactccagcctcggcaacaagagctaaactccgtctaaaaaaaacaaagaaagaaaaaaagaaaatagagaaaatgctgctgttttcatgagccagaaaattagatgcacttccattcacattccattggcatggactagtctcatgggtctcacctaattgtaaggtggctgggaaatgtagcctggtggtgttcccaggaggaaaagaacgagagactggtgagcactagtaacctcttccacaatcgactaatgtggtgaattactttatcatgatgtatttgtaatacactttcgtatttgattagataatattttatttaggagtttaacatctatgtttataagtgaaactatcctgtatttttctttatttgtacagtccatatttaacatttcaaaatcaagtaacaaattgggcaatgttttctctttttttctattttctaaagcaactccattaagatagagattttctgctccttggaagttagtaggaggcacttgtaaaatcttctgggtctgaaactctatggggaagaggtttcaaaattatttgagtctcttaagtggttattcacatttttgtgccaaatttggcaatttttattgtctagaaattattcatttcatctgtattttcaaatgtattatcatgtgtttatattattcctttataagttttaaaatgtctgttttatttgtcatttcttcctttttctgtaatctcatttttaaaaaatcttctgtcagttattcttgatcagtctcactagaggtttgtctactttcaaataaatacttcaagttttgttaaccaccttttttttggtcctctatgtcctctattttgctgattctgcccttatgtttattattccattttttcatgtttctttagtcatatgcttttgtaataaattcaaacagtatagacatttgtaaagtgagacaggaaagtccacttcagcctccataggcaaccacagatatcatattggtgtgtttttctggaccctttcctatgcttatacaaatatttttctacaactttctaaactgaaactcataggtaaactgctctttataggcaaccacagatatcatattggtgtgtttttctggaccctttcctatgcttatacaaatatatttctacatctttctaaactgaaactcatgggcctctttctgtggtgtatacacacacatacacatacatacacacacatacacatccattaaaatggaatacataccataatttatccattttccatttatgggcatttagggtgaaagtcttggtcttttaacaatggaatttaattcattcatatttattttgatcactgataaatgtggtcttatttttgccatcttgttttgccatgtatttatcatgtgtgttttttttttccttgtgactctatggattcatcaaagtgtatttgtcccctgtttcttctttccttctttttattcagtgagttggaagttctatatcttacaataggccatcatttagttcttaagcttagataaacttgtatttttgtctctggcaaaaattaatcagaacctataacctccttccaaacataataaatctttttttttattttttgtttttgtttttgtttttgagatggagtctcgctctgtcacccaggctggagtgcagtggtacaatctcagctctctgcaacctccacctcccgggctcaagcacttcacctgtctcagcctcccgagtagctgggactacaggtcccaccatgcccagctaatttttgtatttttagcagagacggggtttcaccatgttggccaggatggtctcaatctcttgacctagtgatccacccgcctcagcctcccaaagtgctggaattacataagtatgttttctcacgtctctttttccttaccttttccccacaggcacatatacacataggtatctgcctgggaattattaaaataacctgaacaattccaattgttattaattcttcttgcttcaaaatacaatttcctttttctatgttagaaatattaacaattgcattaatctacaatctaacctatttgtgcaattgcatattataccaggataggaaagtttaaacatgtatttcttttagacttttcattgaattgctgaaaattcatagtgaattgtatcttgagtaatgcttctctgagtctcttatttcccaaaagtatactttggaatccatgcaattctgatcgttgtttgacctttgctggcacaaaggcattctgaaatatttgcaaatgctaaagtcacttcctcatcttttacagagtttacttcagcttggtgaaaccaagtgcagtatcagtttgttgtaagcttaccactaattaaaggttcataaaatagccctgccctagggtcagggactagctagaagagcatgaaaatagcctttgaagattcagctgctggatattttacatcaaaaagctgaaacgttttaactattttaatattttgtttatagtacttaatatttgtgaacgtgaagtaaaatggacacagtcatagtaaaactgtggtaaaactaacttggatggtgtttgggctgtggttatcagaagctgcttaaagtgtccatgccttttatcccagttctacttccaggaatatgtcctaaggcatgttttcatatgaggttatttcaggtggcgcagggtaattctagttgggacacatttgccacattgtctaacactgactcacagtgagaaagttattcccatgctcaattccttttcagtcttctgatcaacggaaggtgaaaaactttagcttggtgctagcatacctttaacacctctctaagcctctctaatctcccattttatataaaagaatgggcaaaggggtagcagtattttgactatattttaaccacagtgtttttttattccaataaaacctattatgattgccttcatttatggcatatgatgttggttttccacttaaataaggtttgtttgtttgtttgtttgttttttgagacagagtcttgtcctgttgtccaggctagagtgcagtggcatgatcttggctcactgcaacttctgcttcataggttcaagcgattcttgtgcctcagcctcttgagtagctgggactacaggcacgcaccaccacacccggctgattttttgtatttttagtacagacggggtttcgccatgttgcccaggctggtcttgaactcttgagctcaggcaatccgcctgccttgttttcccaaagtgctaggattacaggtgtgagccactacaccgagtcaggtttgcttttaaaatacatttgtttaaggacagaaatgagttgatgtaaagagaaatgttaagtacattacagatggtaattaattatagcaaaatagtaatggcaatgcatggatgtaggaaataggaccctaaggaaataatcagagctatagacatagatttatatctagggatattcccgtagatgaggaggttcctcccaatgacttatgttaccataaagttagaaactactcagttgttcagcaattagggattggttaagtgattttcctactttcatatgatggaatactagcattatgaaaaactgtatttaatacatggaggattatatactgttatataaaactggttataaaagtatatacagtattgtaattttgttaaaaatgaagtatgagtgtgtgtgtgtgtgtgtgtgtgtgtgtgcgcgcgcctgtgccgaaatcaatggggaaaaaagactggaagaaaatatttccaaatgggttatctctggatcattggactacaggagttgtttgtgttttccagtaatagacatgtcacttttgtcaccagaaaaatatatctatttttaaattaacatgctcctacactgacaggactacctggtattttgtcatctgcaggcattcctgggtcctttcatgttcttacaattcagttaggtccctgtggcctgctgcaacatcatggggaaatagtacggttaagacgtcattgtcatctctcagtacagtccaaggtacttggttttggagtgtgcatatttatatttttggagtagaatgggagaatgtttctaaaattctctcgaataatttttattgctttttcttcttgacagctccattaaacaggaccaaattaggatcccattttttaagtaggtctggattattaagcaagaatagagtagacgctgagtctcctagtttcttgtttagtctttctttaatttctgcattttctgctgaccatgaagtttttagatgttagatttaatcatggttctgtatcacctgtgttggagatgtgtatatttaaatctggacacctctcttccagaattacaaaatctctgttcacggaaaaaaaaaaaaaaagttcgctgcaaggcttaatgcttggcagaaataattgctaccttttgcctagtaaaaattccccacgtgttctttcttagggcttgttcctggagactcttgaacttttttgtgggaatggggttggcaggttaagtgagtaaatggtgcatctgcctgggagtggtctacagccctggtgtgagcttcctccttctgtaaagctgctgggctgtagccagggtgagccagccagggcctgagcctgaaagaggcctgttgtggcattccagtaacatctgccagattgcagcgagacctttgactggtcagctcttcccctgctggggtccttcaactgcaccactcctctccatccccacggccaccactgtggtgcaagctctcacacctcttgcctggaccacagcagtgacctctagctggtccctgcctcgcctcgcccttacgtccagtctggttttttacaggagctagtatgtcctattctcctattgctgctgtaacaaattaccacaaaatcagtgccttaaaacaacacaaatttactcttttagaagtcctgaaattaaggctttggcagggctgcgttccttctggaggctctagaggagaatcgttttgttgctttttccagcttctagaggccactgcattccctggctcagggccccttcctcctcttcgaagccaagtctttctcgtgccacatcattctgaggctcctcatctgaagtcagatctccccctgcctccctcttataaggacacttgtgattatgttgggcccacctggataatctccggttctcaggacccttaactcgatcacatttgcaatgtcccttatgccatataggggaacatacacacaacctccagggattcacacatagacatctttggcagggccattactcagcctacatagataatcttttaaaagtacacatctaaatgcattaatcctctgcctaagacccttgtgtggtgctccagttctccagggttaaggctcgaactcctcttgtggctgggagtgtcatgcaagggtcacctacactgcttctccagcttcaccctgcctcctgtccctgccaactacccatgatccagcctgtgcacagggtgtgcttttgacagggacactgcttgatatggtttggatgcatgtctcttccaaatctcatgttgaaatgtgatcgccagcattggaggtggggcctggtgggaggtgtttgggtcatggggctggatccctcatgaatggtttggtgccctccccgaggtaatgagtgagttcttactctgttcaggcgagagctggttgtttaaaggaggcttggcacctcctcccctttcttgctccttcttgtgccatgtgacatgccagctccccctttacctttcaccatgattgtgagcatcctgaggcctgaccagaagccaagcagatgctggtgccacacttgtacagtctacagaactgtgagccaaacctcttttcttttctttttctttttttgagacggattctcgctctgtcacccaggctggagtgcggtggcacgatcttggctcactgcaacctcagcctctccagttcaagcaattcttctgcctcagcctcccaagtagctgggattacaggcgtgcaccaccacacccagctaatttttgtgtttttagtagcgacagggtttcaccatgttggccaggttggtcccgaactcctgacctcagatgatccacctgcctcagcctcccaaagtactgggattacaggtgtgagccactgcaccccgccttaaacctcttttctttataaattacccagcctcagatattcctttatagcaatgcaaaatggactaacacattgctcctccccacactccatttcaggcctccccttagacaaggtcaggcctccttgagatgctctcacaaggactacatgcaattctgctatcacacctatcacagattaacatctttgcatttatttaggtgattatttgactaataatagatgttcctcttatgtaagtactccatacaggcagagaccatgtctatttcttacccacaattttatctggcatagtgcctggcatgcagctgtgggcaagaaatgacatggttagtaagtccttggaaataagtgaataaatgaatgggtattaacagcattgtcattgtgctctatctctttttccctgctttttcttctgcatggcatttgtctccttttctactgttgcctccccgcactggaacagaagcttcgtgagaacagggactttgtcttgtgtgttcgctcctctcttcccaggtcctagaacagtgtctcgtccataacaaacactcaatgaatatttagggaatgaatgtctgcaagatgctgagaatctctcatagagttttcatatgtgacccctctttgaaattgggtattatcaagttattcattttaatgattcaacctaattcagtaatcaggcaaattggcagagacctaaaatatttacccgttgttgtgaggatgaaataagtaaacaagtgtaagttatttagagcagtgtctggtaaccacagccctgtgtaagagtttgctgctgttgttaagaaatgcttgacttcttgatatcttagagtttttgctgactctgctgcctgtgttgggatcccaagcagaaactgtttgtggcccagcaggtgttggcactgggtgagtgcttctggctcttgtcccacgacgggcatccaggtcttccagcggcctgaggatataggaggggcttcaggcggatgattggggccgttgcttatgttttttccttgtttggcctgcaggtggcagcacaccctgggccccccactccccgccgcaagtcctgaggatggccagcagagaaacaagaaaatggactccctggctgctggagagttgaatgccagccaccagccatgggtgagtggagagcctgaccggagtttttctctaatttgttctgcattatttgtgttttgatatatgaattggtgtaaatcacatgtgttcaattttgaggccatttgttgatttttgcggtttatttacaaaaacaacaaacaatagcagtgaaaccagaattattcctgcaatgtttcagagagtatgagggacaagggcgcatcctctgcattgtaagtgtgacttcccttcccttctgcatcttgggcctgtctcctttgccatccaggtaggaggtatccacccagaatagttcaacaagtgtgtggcaagctgggagtgtgaggtgttcttcacggggaccctgcagtccttcttccagtcactcccagggtggactattctgcactgtcatgcctggcccctaagaacccagggtttccatctgcctgcacaggcctttcagccccttggtggacttctcccgctgaccctcccctcttctcacccctattaatttcacagctctatcttatttatcccaagatcctatttgtgctgcattctgagcacttgaatgaggattgtttattttctgttttgatcacatttgttagctttgtgcttagaataaaataatttcagtttcataaatgggaataagcccttatgtcaagggccactacatcacttcttggcattccagtgaggggtctagtgaagagcttccctgaatttcagtacctttcaaggcctctcttgaaagaatgtggaattaatttgggtggaggcttgtgcatggacttttttctgagtgtatttggccagtgggccaatggggaagcagaggcatggacagagagaggaatgcggcagaaggagaagctggggctgcaggatgccatttgctgtttgtatggcttcccatggcccactgtagtggctagagggcactgccaggaatccttcatgtggctgttgcttgctgttggggaacatgattcagagctgtgtagctccatgtccagttccactctgcatctcactcacaaagctctagcgttgggctgctgggttttggtgaaagcaggtgctatgaatatattgaaggacaaatcagtccctaagggacttcgatagacgcagtcctaaaaacatttccgggctggtttcttttttttaaacaccagttaaccgttttcagtttaactgtgttttccttcctgaaacctttaagtgagactaattggtatgatttttttttgtatgctttgtttttagggagtttctcaacttgtcaagtctgcgttgcagacagagatgaaatgatttttttttcccacacagaccaagcatgcagaaatgggaatgatttaagtttgtctttaatttaatttctatatctttcttttcctttccttgggaaatagaggaaatacttgggggcattttcaccaaattgtaacttgtaacttcacaagagcccatcagcaggaatttctatgcgtgttttaatgcctggttgggggagacatgaaatgacaacagacagttgccctcaaggatcctttgttctgtttggggaatcaaaactgtgttcctccctgtaacaccaaatactagagccccaggggcaggtcccatcatgaatgcccagtagtcagtgccaaaaaaacccaagtcagggaagactatgagacctgcctctggggctctagtaaattcagatgagagaaaagaaggtgggtggtgtttccaggcacacaggtgtgagaaggactagggagcacttaggtccaacttgaacattatttggaggagtgcagagagattgtattggacaggttggttaaccagatttcagtggtggtgagagtttgactatcaagccaaggagtttgaatttgataccataaggaataggaagtggccgggcgcggtggctcacgcctgtaatcccagcactttgggaggccgaggcgggtggatcacgaggtcaggagatggagaccatcgtggctaacatggtgaaaccccttctctactaaaaatacaaaaaattagccaggcatggtggcgtgtgcctgtagtcccagctactcaggaggctgaggcaggagaatggcgtgaacctgggaggtggagcttgcagtgagccaagattgtgccactgcactccagcctgggtgacagagtgagactctgtctcaaagaaaaaaaaaaagaataggaagcacggttggccctccataccagcaggttctgtgtgtggacctgtggatacggagggctgactgtgctacacattttttgtttgtttgttttttgtttttgagatgaagtctcactctgtcacccaggctggagtgcagtggtgcgatcttggcttattgcaacctccgcctcccggatccatgcaattctcatgcctcagcctcccgagtggctgggactacaagtgcatgccaccaagcccgcctattttttgtatttttagaggagacggggtttcaccatgttggcgaggctggtcttgaactcctgacctcaagtgagctgcccacctcggtctcccaaagtgctgggattacaggcacgagccattgtacccagccctacgtcactttttataaggaatttgagcatcgtggcttttggtatctgaggagctgtcctggaaccaattcctcgaagatgctaagggacaactgtaataggcttctgaatgggggacaactgactgttttaaataggaacttttatttccattttacatctgcttttcaaataatgtcttttcaaataattctccaaggtcacaggttggtgggtggggcttagatctgccagactccagagtccatgtacacgctaacccctgcactggcttgcattatctccagacacaggttggcctgcatgtgaccaaggctccacccagccctgaccttggatgactctgagtctatacatagctgcatttgcgtgtcagcctcactccctgggctgaactgtttatagggtgaaaggggactttgggtaagtcacttccctgtctttctgagactctaggaaatcaggggcaggaactcagctatgcatccatggtctgcacagcagcagcccagataagttccaagagctgcagaggctgtcagagaagcttcagagctgtaggtccctgggcaagtctcctccaaagtgggagctgcagggctgatgcggatccaggcaaggtgacagcacagcacaagttgactcctgttactgccctaatcgtccagcataggcaggaggagttggggatttgaagtttgaagttcgaggagttgaactttgaagttctttatgcattcctttgtcattccttcatagaatattcagcaaataacttagcacctaattgttccaggtctggccctgggccctgggcttacagcaaggaacaaaacaacccaagtccctgccctggtgccacttacattccagttggggagacagacaatgtataacacaatgttaaggagcagtgaagtagaagaggaaagcagggagaggggatagagtactagggccagagacctagaggtccaggaaggcctctctaaggaggagcatttgtgcagaaacctggcatttgagctagccagggagctagcaatgtgaatgtctaggttgcaggcagagggaatggcaagttcatagacctgaggtgggattgcctgggaagcagcgagtagggcaacgcattagggagagaggagagtgggaagagcccaggctgcatggggccagaccttgccaccttgccagctattgaagaaaggtagggttttgttctttctccagctctaaggtatgtttcaggcatcgttcctggctgactggctctaaatctgcagccctcccagagagcctttgatcaacccagtatcctcctatatcatcccttttctggctgaactaaccactgttcattctgttgtctacaactatgaaccctgcctaatacagagctttggaggaggaggagagtgccaaccagctttataaggaaattaaatatgtttttaaggttggaaaagatgcacttggatattatactaaaacgtttaaactttggtagaaagggctccaccttggccatgcaaaggggcctttgtcatcactgtttcctcccctaggagccaggaggctggggtcagtctcctccttacctgccagccaggggcctaagctggtcacccttgcttgaccttcgtggtctcacctgtataattcagttagttatattattcctgcctgaagggaaagaggaatgacttattgagggtcatttctatgttggaggtctctgatgttgcgaataagttccacagaaggttcttgggggttaggactcttccctgaattatgtctgggcggggcagggggtgatttatgtttattttatgcatcctccccacttttttttttttgctttcaaaacacttttacctctgtccttgatctctgtaaaagggctctgtatgttacagtggttaagagcatggaaaaacagatgtggtactgagtgccaggtccacctttgctaagtttgtcactttgggcatgtcccctaaccagcctgttccacagtttcctcatctgagaatgggtatgaaaatagtagctactgcaaagggtgctgtgagaataaatatgataatgcacccaacacaattcctgacccagagtacagcctccctgaaggtcagctgtaatgattgtgatatgtaatgattcccacccaacaggcaggagagcctagaccatggaggctaggtgacttgcctatggtcacctgataaagccagagatagaagccagggctcatggagtcccaggccagtggtctttccccaggattcctgttgttttttaggaggaaatgttaatatagacagttctgtctgtgtctaaccccttagtagctggttctggcttttgtaggggattgggggacaggacttcctcagcacacaagaccctcaatcctaggcattagcccctctgggtggggcatttgtgggagcaggggacatggcatgactccctctttgttctgtgagaggcagagggggttaggagtgctgtgctcccaggactctcctcctcccaccgccacctgctgcctgccagatcctgtagtccttcctggggaatcatcacagaggcctccaggaacctggagtggggagggagcaggacaggcaggtcctccctcctgtggcaggactctgtggctcaggcctgggaactgagtgtgggaggaggtatggtctccctaaatagttgctcccagcgggccatttggaaagagaaacagacttttgcgctagggggcaggggcatagataccctctgcagctgccctggtcaccttgttgcctgaagactgttcccagtggtcttagatacagagtggtggcccttgctcctgtcagagtaggtttaaagaccacacaggtagatttctcccagaaacaacaccacttagaattttccttcagggagcatagcacaggggagatgtccacacacagtcatacctgtgtttgaatcccagctctgcctttttgcttgtgggtggtcgagttgggagtgtgcttgagaaattattcagcctcttcaactctcagtttctacctctataaaacgggaacaagaatacttacctcaaagatttgtggtatgaattaaacaaaataacctgtttgaactgcttaacatgtgtgtgcacgtggtagcccgtggtagctatttttatcatcatcatcatcgttaagcatgtcagtggcctctaccagtctgtgggtggaagcagctttcatgtgtggctcagcctcatggaggctgtgcatttgctgtgactcaggattctagaatgactgagccaaagatctcaaacttctctttgctatattgttatttgcagtcacactcacacactcagttatccagggtgaataattaagtttctgttgatgtaggttgccatgctgtttatttccctgtttctcttctgtttagttcagcgtccttcaaagaagacaatagttaagtagctaaactatattgagggcttagtatactaaaagtgttacataaattagcccctttcattcacataaccagatttagaaacagagtttcaataatgcctaagactacactgctaccgtgcagcagacccagcagacccgggcttcacatgtctcattccagagcccacactggcctctgtactacccgcttttaaacaggacagtggttgaatttggtgaccttgagagatcaggtagtctggtctttcttacctcctttccaggctgagctgaacatcacagaggggaatatctgtgattttcttgagaaactttacagcgaaagctgctggctctgcccttggtagccatttttatggtctggagggacagtggcttcttcctagagccactttgcagtgttcccttgaggccagctgtccatcctcgagagcagttaggaggtccatgttgagagtgtgctcagtccttagttggaaacctggaaacgcagaccatgagggtggtgtcccactggcacatggcaggtggggccttctgccaccctggctgtgtgtgtggcgtccagtgcgagtggtagccagacatcatgcccacctgccctcgagctgcttgcctgcagctggctccttactcacagatctgcatccatccggcgctggggagcagaggaagtggtctgtgggccagctgaattgcccaaggagctgagtcactggctgatttcggcctgccctgcagtccctggggtgactatggtgataggggagagaaatctgcttatctaggggccttgaagcctgagaactcagacactccaggagggtccttcatgccacagcatttactgagcacctactgtgtgcctagagaggtcatgcgagagacctcagcatgggagtgtgtgttgggctgcctggagcccgggtggctggtggccaccagggagctccactgccttagaaggatctgaggctggcagaggggccaggttggtgtgctgctgtttatctgagcagattccatgacaaccaggagataaatgcctgaggtcaagcaaaccctgaaacaagattaggtgtctgggtagggtgggacctatactgtgatttggagacccttaagtgaccagtatcttctgggtgactatttagcatgcttaattaatttgttaattaactaatgccccatcctactccagaaaggattgaaagtgactcaattcagcaggtcttttagagggaggaaggcatcctgagtttgctgtgagtgaaaagctagggtttattcaggccccgagagggtcatttaccagctgccagcccagctccacactcctagggctggctcccatgaaagcacagcctttgctgccaaagctggtttgcagcgttgctgggatcgcctcctggtctctttgcaacaagtggccccgacaccttcctgctttgatgcaaatcatgtgacttaagagaagcaacctgacctcaattaccaggtgcaaacatcagtcactgagagtaagcaggaggcctccagtgtccctggttgttttagcctccagcattaaatattaagagtgaactgttcagggtgtgataaaggctgtgtctcacagtttatgatttccagtaaaccagagggcttaaaggaagggccagggacaggtgagagattccagacctggccctctgctgagctggtagagcaatttctgcaggaatgggaggggcagggagtgagtccacagctagtaaagatttgccctgttctgtggcacagctagagagctgcattgtctgcccagcaggccccagaaagtgaggccagtttctgctcccagccaggcagctgcatgcactctcagcatagggatatgggaaaaagaagaagtgtgatgtgtcctcaccgtgctggccactgtgcctgcctcctgctgggtgccaggccagccaggagccctgggcacattcctctatcagtgtaggcaatgggcagctccaactgctctcacagaaagctagaggaacatttcggtattcagagccttcagacacatgggctggggttgctcagcatctggcctccatggggaagtccaggccacaaggaagctgcaagcaggcagcatatcccacttaggcctaggaagggaactgaggtccccctcccaccctgcaatgtcataaggagactcagccctttctgagtttctctagagcacctaatctgatagcagtgatagaagccatacatcaaattaactcagcatgcagtaacagtggcatgcattcatttaacaagtatttaatgaacacttgactctctgccacacactgtactagatgctgggcatacagtagtgaacagacaaggtccctactcaaatggagctacagcataatggtggagatagaaagaaaacacagaaataaaacattggtgctagcagtaagtgctctctaacaaattaaaatagactgaagtgtaatcaagtgactgagtgactgctttggattgggtagtcaaggatagcctctgaggaagtggcatttcaggggatacctgaaagaaaagactagaaaagagcaggtgaaagagcagactctgtcctgtctgctgtaggcgcaggagagccagagtgacaggaggagaggaagaatgttctagaacatatagcttggttaacttgctttggtgtttgtgacactttcttgcttattttctgaattacgcgctaaaccttcattcagtaaagttttattgcatgccctctgagtgccaggaattttgccggatggcattaaaatcaagatgaatatgtcaagtctcttctcaaggggtgtccagtgtgttgggagagatgagccaggaaaccaagacagtgtggaagtgctgtgagtgagagaatcaaagagggctaacaggagcatacagaagggcttcccaactccccgtgggcagtccagcagggctcccagaggagaggacacctgagaggtcctggaggctgcggaaggttagccagaaggagaatgtatgtcccaggcacagagagtggcctgtgcaaaggcctggagggtagggtaagcaaatgagagaaggatgctggagggtcttggagatggaacaggtggccaggaatcacagaaagcctggaatgctctgctctagagcctgaaccagacactggagaatagcttgcggaatgaagacagattcctaaggggccaagtcagcagctggtaaaggctggaggaaaggacactgagtttatgagtcactgttcagaccactctctggggctcccttcctacctgggagctatcccaggcgacgaccaacacactctagccatttcccaaatcagaatagaacattcacctgacccaggcacccaggcaggaacatgcaggtatttaaacatccaggttaacacatttgactacttggttttgggggagcaggcatgatgggttaagacttattaatctggaagtaagcactaggttttcctttagggcaggaagaccttccttgcaaaatccctttctggcaagtctcactgggctgtaaaattgcaaacgcactgttatcacatcccaataagtgcatgatttgattttaaagtaagataatcttgcgttcattccagcctcatagggaacatacagttttctccatccttttctcttacttactccccttcctctgtttccctctgtcatctctaatccccagagtatctggttatcttttttatacactcattactccttcaaaacactccaatatagataacaatacttgattatttggaagttatctcaactatacatgagctgatgaaaaccaggaagtaagcaataagcaaaacaggcagacagagagtccaaagtccaaaataaattaacatttgttgaggacttgtggacttactatgttccaggcattatgctaacctcatcacagtctctattttgattaatcttctgtttgcccctgcagatccactctccgtcctctctacctgctctgggttgggaggctgacctgaatgggccacatcactcatctatcttgcctctggattctagttagatttggtccatggggagcattagcaagagatggaaggactcaggaagatgaggtcaggagttccccgaggagggcaagtggttaagttattcccccgggtccctatcaggtcgctttaggccaactgcatcctccactggagcccacagctcctgccagacacccttccaatagctgcctcctttgggtccccttacccatttattcccttccttcataccttcaggttacaagtggtaacagctccccattgttgctagcccccatatgcttcactgtctcatcttgatttccctgagccctccccacacctttgtaaacagtcccagtccaagttcaccatctgtttcctacccaacttgatgatacaacgaggtaagcactgtattagcccatcttaagacaagtaacctgagccccagagaagtttaataacttgtcccagaacacacagctggtaaaccacagagctaggtctcaaatccaggtgtttctgattccaaagcatgggcacgtttcgtcattatatcatattgcttcccatgccctaaagatcgtctcccccagacttcatgaaacatcagtttactctggtatttttcccaatcagcaaccatttaaaaagagcaaacactagaagtaaatgctttcaaataaatcgtgagaggtaactgatgctggtctggattgagaaaggcacaataactattcaaaataggcctatgaacttcagaagcctgtggaatccacacttgccgtgtcctctgcactttccttctctgtgccttctgaagggtggtggcattgacatcaccatctgtgggagctcacataaagtcctgaatctgccaaaagacataacttgaggttgcctaacatcacccccatgtagtatccaaacactggtccttattttagtggctggttttcatgtttaatttgtgataccccaagaatacgacagaggttctttttttttttttaagttctgaaactgctgattcagtttgcatgaggatattacttttttaaaggaactttcaaaaacacctaaaatttaattttagccatagtttagttagagaatccctgggtacagaatttttctctacttcccagcatttacagaatctgatgtcacttgggagttggagggagactttgggggaacagccaggaagtggcccttgggtccttgagccatctagttggggagaaagggccatttttaccctgaaactctgttctgttcatgtgcattgtcccaaggttcttatgaagacagtcggtccttatgaagacagtcagttcttgactgtcttcatgacttgtctggccagctcttcaataccttagccagacaagaccataaaaggccacctgctttacttatatttgactgttggtaaggttgaccctgaaatcttttacatttgtatttcttttgataattttgttcacatgtatgttagaaactgctcattgctctacagtatccattccctctttcttagtaacaaaaccaattttttgctgatcccttttccacccagctgaaaactacgttcccctggcaattttgcagcaaagtgtgatcatgtggctgggttccggacaatggatgcaagtgggtgtcatatgggacttcgaagccagctccttaacaggagggggtgtgccctttattcaccctcctttctccatcctactttcttaaatgaggatgtggtgactatcactctagcaactaccacaagacatgagaatgagagctgcactttaggaataggggcaggatgagccagaagaagcgtaggtccctggtgacacctgaagtcaccaaaccagccctgaactgatcatttctagaccttttttttcagtgagagaaagaaagaaaatcccatcttgcttaagccactattgttttctgttttatgtaactgaacaaaattctaaccaatacaaaataatgtttataatacacaataccataatcaatgctgtttttctttttctttctttttttaagagacagggccttgctttgtcaaccagactggagcgcagtggcacaatcatagctcactgcagcctcgaactcctgggctcaagcaatccttttacctcagcctccagagtagctagaactacaagtgtgcaccaccatacctggctaacttattttttatagagatgggatcttgctgtgttacccaagctggccttgaactcctgggctcaagcaatcctcccaccttggccccctgagtagatgggattacaggcacataccaccatgcccagctccagtgctgtttttctttggagagtgtatttttattactgattacaaactcatctgtgttttttgggttttgttgttgttgttgttttgttttttgctttttttttttatatgaagtctcactctgtctccttggctggagtgcagtggtgcaatctcagctcattgcaaactctgcctcctcaattccagcgattctccttccttaacctcctgagtagctggcattacaggcgcaagcctccatgcccagctaaatttttgtattttagtagagacacggtttcaccatgttgcccaagctggtctcaaactcctgacctcaagtgatccacccatgctggcctctcaaagtgctgggattacaggcatgagccacacccaaccatatgttttttatatatgaaggacatgtcctttctgtcagtgttgctgtaaatataattccttgtttttgcttgtcttttgattttgtttatgagttctgtttttaaagtcttggtgtttgtttttaatatggctaaaatttctttaaaatgctgtttgctcttttatccaaaattcttccccccttagataagtattcaccaatatttttctggtttttcaatgacttcactgtttacaattagcgttttagtccattggtgagtactgttggtaagtttttaatcttttgtaggtcataagtgtttaggcctaaatactctcctgagttctaaagcaggagccagcgtcacctcttgtttatacaccctgtcctggcctgagcctcctgaaggctggcacattcagcacagacccctctcactcctacttcccacccaccgcccttctgtgggtcacctgcccactactcaagatagcactcttggcttcttctggaacttctgtcttcaccaccctgtgttcggctctattccaactcatctctaatttctctttaccgagaccaggccgctgacagccctctcaacgattctaggagatttttgttatttcttctctggaaatacaatataaagaatttttatatggttttccaagtagatatgaagctttttaaattaaaattttgtgttctgataagagaaatgaaccatcttcatcattttaagaagtagaaaatatattatagaaaagcaccaaagaaaataaaaacaacatagaaagtaaaaagtgaaagccctaccaccttcaagaggtgacctctgtcaacagttgatatatctctttccagacttatttatacaaacaaatgtggatctttataaatatacgtatgcacagctttgttcatgaaaatgggagcatgctatatactttgtacagcaactggctttttttttttttttttttttgagacagagtctcactctgttgcccaggctggagtgcagtgacacaatcttggctcactgcaacctccacctcccaggttcaagcgattctccagcctcagcctcccaagtagctgggattacaggcacccgccactacgcccaactaatttttgtatttttagtagagacaaggttgcaccatgttggccaggctggtctcaaactcctgacctcaggtgatccacccgcctcagtctcccaaagtgctgggattacaggcgtgagccaccactcccggctagcaaccggctttttacaaatagcagtctattgtgtatatttctctatgacagtacatagagacctgctgtcttctttttaaaggctgcttggtatgtattccaccacgtagatgtactgctagttcatctcctcccctacagatgaccacaaagtttttcaatgtcctgataatatttataggccactacatcctcatttttatacttttatgcatttgtgctagtgtttctataaaatagatttctacaattgagactgttgagttaaagggtatatacatagtaagttgtatatacttccagttgccccttgttgaaaccttgtaccaatcagtgcagtgtccttttaaatggtcttttcattgcctgttgcttccctgtctccccaccccccggctcttcaccctagtgctagaattgcttttatgaaactcagatctgaccatggcttgccctgtttaaaatacctcagtggctcctcactgtcagcaaaacccaaacattcatctaagctccttctcagttggagtcctctgggaagcagacaccaaaacagaatgaaaagtgcagaagatttattgggggtaagaagagctaatgcctatgaaagataaaggagaaaggagcagaagtacggagagaaaagacagctttcagactgcagtccagatctaactctgggacgcaagagagggaaggataattctgttgaaagagcatcagactgtgatgcggctgtaagagtgtctcaacgagcccagtggggagttccagccaaagattgcccaggagaagagtcgcactttgggcagaaatggacaggcccgagcaaccctgccatgttctgtcattggctgggggccacccaggaggcaacatggtctgacttgaatggtgtggatccgaggctgcagcctgtcagctgtctgcactccatgcaacaggtcctttgaatggcatgtgttcgtggctgccataaactgcagcctgccttttagccttacctcctttgctcttgctctctgaccccgtgttctggcaacactggcctgactacacgccgtatcacatacaaccaactgcccataccaaccccaaccctgacctttgctcactcagttctttctgcctggaatgccactccttcccagttatacccagcaaaatcctaatgtgctttcaaggcccaacttaaaaatcatcttctctggttgacctcaccatgtagaattaattgttccttgctcctatggtgctatgtgtatattagtacttcccagattggagtattcttagctgtttttttctcagatttttgcctcctctaaacctagcaaaacgtcagcacacagtaaatgttgactgagctgtttccctgctcctcgcaaagcaccttgaggttgcagaattccaactcccggaatggttggaagcacacagtacatggtcaataagtgtttgttgacttgtctgggacctagtattggtggggtgaggtgggcagaaggctgctgagggtgggtatttactgttgttggggctcaccagtctggggccacattggagttttaagactagagcatgtcttcccctgtttttatttttctccatgatttggaaagaccccagaggtgggtttttttttttttaagtaatcactttattgtctctggtcaacaaatgagaacttttatgggtcttccctttttcaaccacattttcatgagttgggattttgcatttcttcattacccattctccttatgggtaaaagaagagccattatgatacctaggatgagagctccaggtcagatgggtaatcattttcagactggaggctcatgggatacagggaattgggaaggtagaaatgatatttttcctcttcctctttcccacatccaccaattaaagaacttccctgggagtggacctgtgggaagtggctaagggtttccggggtgggtacagcagggagtgacatcagggcgtggtggggatgaggtgggtggagaggacaaagagggactctccaccttcctttggatctatgaggatgttccttggccactgtccctcagcagaaggaggctagagctgaggtggccacaccctccactcattttcaatcccttcaaactgtcaggccctcagaggaaaccctagggtttccccaccaagatgtaagggctgtgtgcctctgccttctctcttagggtggtcagcacaggtggaagcagggaggtactgggctgaggcttcggttgtcagtgctagcttgacagcagttaagaattttttttgttttgttttttaaaatttatttttctgtaatttttaatgtagttaaaatttatacataattcacaccacttcaatttatacatattgaaacatcactatgtatcccataaacgtataattattatgtattatcattgtctgggacctcatattgtgtgttataatgattatacatatttacaaggtacataatgatgtttcaatacatattatgtatagtgatcacatcagggtaattagcatatccaccatctcaaatgtttgtcatctctttgtgttgggaacagtcactatcctcctcctagctattagcagtggttagggattttggaagttgtgtagtgtgaagaagcctgtgggccagaggttcttatcacagactctttcttcttcaggagctatgaaccatccttccccaaagtgttatcaaactgtgcctttggtggaggcatagctctcgtcggattcttttttgccagaaagatctgtgaacgaaactgctactatgttaactcagagaacagcctccctaataaagaagaggatgtgttcctacaagagccaggttttagttggattgttagtgtgagtgatgaagacctcagaatggctctagaaagaagcccagatctcagctttgcactgtgattgtcccccagcaactttgcattccccctgtatgggaatagggacctgtggattctgttgccatagatccagagattggacctaggaaagtgagaccaggtggtctgacacctacctccagagcggacaacccagagacagagcaggcccctgcaggtgtaggggctggcggcgagaagacagctatgtttacccttgtagactaggaatatcagtatgaatagactagtcctaggctttgaaatgaattttagtgttcattattatttggtcattctaaaaacccctattttgaacctccacttcagagaaatagttctgatgttctcagaaaatgtcaggagtgtatggtgcacagcagtggacaacaaaggaagagaaaaccagaaaaggagaaaagtgaataaaaagaaacttctcaaattagagcaaaatactgaattcagttatgcaagcatacaactgtaacgtgacaacctctctgattttgacagtccccctccacttgtatttttaaagtcctggccacagttataaatagggaaccatatctgttgagacttcccaagggttacataaacagtttggatggttacatctttttaaacaacagtttctacaaacactgaaaaaatcccacttatttaacagtctgatgccttgagccagtcctgggagtccctgggaggccttgcagaatcacttccttctgactgtgagtgggggcaggggcctggcttcttgagagagagcaggggaggaagaacccagtgtgtatgggggcgggcagggaggagtggggtggggcagagggagggaggaggaggccccagactgctactcatacaggcagctgtatcttgtctccaggagagagcagggacccaggatggagcagacataggtcttctggggactcagccctttcaggagggagtgtgtgctctaggcacacccttcccatttgacaatctgatatgaggtggaaacagggtccttgggcccctaagtcatgttgggaatgtttccttctctcaagccggaagagctgaggtttatctgagaaatgcctatgtctcttttgacacatcgtagtcactaaccccttgttcctgctccaggagcctctaaaaagccatctagaccagaaaaattggtcttttttagtgatgggagtggctttaatgtcattctcccctatttagttatgagctgtacctcagttttgtcattagaaatataattttaggtcaggtgcagtggctcatgcctataatcccaacactttgggaggctgaggtgggcagattacttgaggtcaggagttaaagaccagcctgggcaacatggtgaaaccctgtctccactaaaaatacaaaaattagctgggcatggtggtgggcacctctaattccagctactcaggaggctgaggcacaagaattgcatgaacctgggaggcagaggttgcagtgagctgagatcgtgccattgcactccagcctgggggcgacaagagcaatactccatctcaaaaaataataattataataataattttagttaagcgttctcccttcccagatgtctttttagaagtgcagttagctaaagatacatagctcattactataaattaattttatcaaactgatccatgcacttccatttaaagaggactcggtccagtgggtcttaacctttttttgaggtcacacaccccttccagaatctaatggcacacatagaccctttccccaggaaaattcacaaacatccagaatttcatatgccactaggggatttaaaagacccctttgactccaccctgggcttctgagttcttatgagagggtggcacatggaaaaagtggtggtgaggggcaaggaacagggacaaaaaaggaacctgggtccttaagagatcacttagttgttttacccaagacttggcatacaaaaatatcagaaatgagtgtctgctgccaagtggggtcactgcacgtcctagaaaaaaagtatgccttcatctgcagtgacacacagccatggtgttgggactggcacactgcatctctaagccgccaagagcttgaccctggatgggaagaaaactgccccagagatgctggagctggctttatgaactggctttatgctggggaggtggatggcagatcgcatccatctggtaggttgaggtcctcttggcaagcctactaccatcacctcccagcagaagaggactgcaaactatccttaaaggggactcggtccagtgagtcttacctttttttgaggtcatacaccccttccggaatctgatggcacacatagaccctttccccaggaaaattcacaaacatccagagtttcatatgccactaggggatttaaaagaccctgcaaaggacactgcaaactcataaccttgagtccaagatctcttttttttttttttttttagggaagtcaattgtatgatgtagcttgtgactcccagggtattgttctactcaaactggggaaaacatggggaaagtttctggatctagacttcatacacaagcatcacaggggattttgaaagtgatgcagcatcgtgaaatgagcatagggatcgtttggagtcgagcgcttgttatttgaagctcctcctgtctatgtggtgactcaaggaggggagaatttcccctttgtgagccagctggacaagtgtcagcactgctgtctttgcaggctctggcacagaggcgcagggcctggactaaagggagtctccagggtttgggggtcagacccagcttaacacacatgaaaaggagtgatctttctcttaagccattgagccagggtccccctacagcccacagagccctttccaccacctggtgcagcatctgaaccaaacagagggcatgtttgttgcactgcctgggggttcagctcccatccataccacaacacaggacaaggcccgggctttgcacagcacagtcaagtgagcacactctcacgatctgatgcagtccttctcccacacccaccatccaattttttccttcacttctttgtcttttttaatattagtaatttttgttatttctgttaactggacttcttggaactaagattacttaagcaggatacactagccatagatgaaaagatgggtaaattgaacatttatgaacttttgttcatcaaaaataccattaaagagtggaaaggcgtctgggtgcggtggctcacacctgtaatcccggcactttgggaggctgagatgggcggatcacaagtcaggagttcgagaccagcctggccaatatggtgaaatcccgtctctactgaaaatacaaagattagccgggcatggtggtgggcacctgtagtctcagctacccgggacgctgaggcaggagaatcacttgaactcgggaggtggaggttgtagtgagccgagatcatgccatgcactccagcctgggtgagagagcgagactctgtctcagaaaaaaaaaaacaaaaaacctagtggaaaggcgagccagagactggaagaggagaggatattctctgtaacatatccgacagacgactggggcttatatccagaaggtccaaagaattcctgtaagtaaataagaaaaaagcaaataggcaaaagtcttaaacaggaacatcttaaaagtggatatataaatagccaataagcaaattaaaacgtaaaagatacaactctatacccacaggaaggactaaaattgaagactgataataccaaatgttggcaaacacttttatatgctggtaggagtgtacattggtacaatcactttggaaaactatttgatagtatctactaaagctaagactatacccattccataaaccatcagttccacctctaggtacatactcaagaggaatgagtgcgaatgtccagaatgtccaccagcggacataaaccaaaatgtttttgtcttatgtctaatagtatctttctccataagagccccaaactagaaacaacacaaatggccatcaacagtagaatggttaaattgtgtcatatctacacaatgggatacaacacagcaatcttaaaaaagaacaaactgtgtctatacataacagcatacatggatcgcacagataatgtgtagtgggaagaagccagacacccgaaaggtacattgtatgattctatttatatgaagtttaaaaacaaataaaattggccgggtgcggtggcttatacctgtaatcccagcactctgggaggtcaagacaggaggaatgcttgagaccaggagtttgagaccagcctgggcaacatagcaagactctgtctctttaaaaaaaaaaaaatagctgggcatggtggcacatgcctgtagtcctagctacacaagaggctgaggtgggaggattgcttgagtctaggcgtttgaggctgcactgggctatgatcgcaccactgcactccatcctggacgacagagcaagaccctgtctcaaacaaaaggcaaaaacagataaaattaatctctggtgatggaagttagaacagaggttactttttgggtgggtcccaacagggaggggcatgaggggccccctgtggttggaagcattctgtctcagtgctactcaaagtattgcaattgccagccaccttgccattcaccccactggctcctggatgataagtataagggtgcacctttgtctgaaccccagtgcctagcacagcccccgccatgtagagcagatcctcagtggacatttattcaaagaatgagcaaattgcaccaggcgcagtggctcactcctgtaatcccagtactttgggaggttaaggtgggcggatcacttgagtctagaccgagaccagcctggccaacatggggaaaccctgtctctactaaaaatacaaaaattagccgggcgcagtagcacaggcctgtaatcccagctacttgggaggctgaggtgggaggatgacatgagcccaggagtcagaggttgcagtgagccaacatcatgccactgcactccagcctggacaacagagccagaccttgtttcaaaaataaaaaataaaaaagaatgagtgaagtaagacatggcctttacagagtaacatttgtgtgttagaggggaatcagtgtgggaaggcagttaacaactgctcaaagtttactataaaacaaagcagaaaatacatgctgcaaagagaagcagaaatgaaggtctttcactagaatgggggatggggtgacaaagaagctgtcggttcaaggaagaggccttcacaagtacttgggggactacgggggcttcccaaaagagatggtattgagctgaactttgaaaggtggttgagattataataggcagaaaatggctgagaaaggcaacctgggctcagggaatggctcacccagtggttctcaaactttagtgcaaccaaaatcacctagaagactcattaaaacagtttgctgagtctcatcccacaggttccaattcaggaggtctaacaagtcccaggtgatgctgatgctgctggtctggggactattctttaagaacccctagcttaagccaaagccagcctgtccaggcaactgcatctccctttgggcactgtgttaagtgagtgaagggcaagatgagagggaggtgtggatggacaggtggagtgggccagagcctgagacctttggctactgtctgcggagtttaggcctaattctgtagacttaatttagggcctcaatagatggacatagtgtaatgacctgttctctagggaagtcctactccagggtttataacaccctctacctgaagcttaaagctgtacacacaggcaggtgataagttcatactgagtttggtcctacagagacaagccctgcactgtcccccacagcatacctgccaggggagacacagtttacactgatagactgaagcaattgaagcaaggcactattttaaatgtgcaacatcaggattatttgtagccatgcatgcagtggggatggcaagtggaagaggaatcagtcaatctgaccattcaggcaaaagcagcagttttggtctcaataaagagataattggtctgtttgtttgtttgtttgttttttctcatatcataggtcccttccagattcccaggggcaaggatttataccacatccccagtccatttttgtcactagggaagcacctagatccaggtagtttcctccaagtggtgtctctttggctaagaaagggagagtgtgctgggagcggtggctcatgcctgtaatcccagcactttgggaggcccaggcaggcagatcaactgaggtcacgagtttgagaccagcctggccaacgtggcaaaagcctatctctactaaaaatacaaaaattagccaggtatggtggtacatgcctgtaatcccagttactcgggaggctgaggccagagaatcaattgaacccaggaggcgaaggttgcaatgagccgagattgtgccactgcactccagcctgggcaataagtgagactccatctcaaaaaaaagggaaggaagaaagaaaggagggagggagagtttgttgcctggggagggagcaccctctgtggatgctatggatgtccttgtcagaaccatcctggtcaggacacactggacattggccctttccctgatgacccagacatgcaaggcggatgccatctgtcatcctgcctactggcttttggttacaccttcaataagctgtacttactgagtatcaactctctgtaaagtaatctgctggttgtagtagagacacaaggatggatcagccatggacccatcctccagaaacatacaacataataagaggtaggtgacattaaaacacctactacctgatgcctgttccctccctctgcatccctggcttgagtctagctgcttcttctccctaatgccctgatgctggaggctgggagctctcactcattcagccttcacctcagcaggtatcacaggggtcctgggctcacagggtgagtacatcaagatgtgtgtggtctggtagggagccttcccgccccatagctggagataggctaactcctgagcaggtgctctacagccatcatcctgctgctggggccacaacaatcaactctgggccgccgatccccagtccccttgccggctgggcttcacaccagtagagggaacctgggggccccctttgcctcagcttatgctgaactagaggcctctgggggtcacagctgctgcatgcacgatgatccacggggagtcaggatggggctgaggcaagtgcagtgtcctgctgcctccccaagcacctccttcctctcgaagctctgcctgcctttttctcagggacatgagaattggctcacttccttctcacctccaactcccttttgcaagagaatcatctagaatagagttgtcggtcaaactgtaaaatatttgaagacatctattctgagccaaatataagtaaccaatggcctgtgagacagccctcaggagatcctgagaacatgtacccaaagtggtcaggccacaatttggttttatacattttagggagacatagccatcaatcaatgcatataagatgtacattggttctgtccaaaaaggcaggacaactaggttggggagtgggggtggtttcaagtcatagatggattcaaaaatttttctgattgacaattggttgaaagagttattatcaatagaaagcaacagaaaggaatgtctgggttacgataaggggctatggggaccaaggttttattatgcagatgaggcctccaggtagcaggcttcagagagaatggactgtaaatatctcttatcagtcttaaagagtcagtaattccaaaagggaagagggtataacgaggcatgtctggctcccccttcccatcatggcctaaactagtttttcaggttaactttggaatgcccttggccgagaggaggggtctattcagacagctggggagtaccttggaattttctttttggtttacagaacacaggcccagaaatgagaaccaggtttaggtcttgctctcctactctccactgtgtgacttgggcaaggcatctaatctttctaagcctcagttttctcatttgtagaatggaaataatgcccttgcttacttcatagtgtcattcagaggcacagacgatagagaggcaaaattcttgtctttaactgccctgaagcttcatggaggagttggacaagtacacacacaatgtgctgcatactacaccagaggtatgtctagggtgtggtagtagcagtgtggaggtaaactagttctgccaaaaagaggagactacaaagcatggggcgtggtggaagtagccctccagggctttggactctaatgtttctcaaacagtagagtgttaactgtattaagttgtatttagtccctacaacaaacctgtgagataggtgtcatccatttcacatatgagcagctgaggctcagaaaggatcatgcattggcctggcctggtatttatagagcccctgttgaatgctaaggggcgcaaatctaagttccttcctcgtagctcacattccacaggtgaagtcacttgcccaagacgaggctggaatgtcagagcctggattcaaaccctcatctggtggcctcccaccttaccctagaactcactagccctcaggacatcctcttacggggagcatagactgtccctgccagcccctgtggggaatttgaggatttagggaaaaggctgggtcagggataggacaggccctgctactcctatggaaccttctgtttcctgagcattccctggcagcccctccccaaagagagattgaaggcctgaccgtgccaatgttttccccagggacggagggcaggagaagcttccccaggggatttcaagggaggatggaggtggtctctattctggggtcagagagtgacaccctcttcctgctgaggtggggaatccccttggatttctctgggtttatgggagaggcctattgttttcgtactgatcaggccctcaggggaggaaaactcaagacctggcatgtcataggactaaatcagcctctggcatctgagtggctccttaggcttggggctcattcctgccctcccatgccctcagcctcaggctgccatgagacccatggcactgccactgggcagtgacattttgttttaacccaaggaaataagagattggcaaacccccttctccaaggaaaaatatacaggattgtttattagagcatttgctggtagtaacaatcataggaaacaatgtaaatggccaatgtttaggaattaaataaaatatggtaaaaatctacatataatgaaatacttttaatgcagccatttaaactcattatgtagaagaaaattaatttcatgagaagagtgctttataacagatttagtcaaaattcagatcataaaacacaatgtacatgatctcatttttaacccaaggaaataagaaaaaaaatacctatatatatgcatagaagaatgtctagaaggatgcatccaaagttaattgtagttatttctgggtagtagaatgacacgttttctcctgttttcaatatttccaagtttccttcagtgaaaatgcatgtattttgtaatcatggagaaaaagttcccatggtgtgtattggcgagagaagaggattgtttccttttggctttgcacttagatggcccaaggccttggccttgttcccagagtgcagatattgtagaagccacggggaaggctgggagcagcagaggagaggccagcttgaggagaataagctgggcatcgctgtctaggtgtcatcctaaatgtcacctcccagagaggcacctgaccacacagcctggcgaaaggaggtcgctcccacacttactctgtgtgtttcaccccagcttactgtcttcatagcacccatctgcatctgaagttacctgcctgcatatccatttccttggtgattatttatctcctgcacagaaggcaagctctccaagagcagagtcccttgctcactctgacttcccattaggagaaaggacccaagccagatcttggtcaacaagcaactgaggacttgctcagcagccccaagctatgggcatttatcctaaggctacacacagcagtgagaaaaaggaaataacttcataggaatctagaaacaggtggagagctagcttataggaccagacctgggtggtgctcagcaagctggaggacctggcccagtgttagtaacaacagcggccacgtacaggtgttgaggaagtaccagctttgtgttttctcttaaggtggaaccaatgtaggttagatccctctccctctgcttccagccctcctgctgtcaccagccaactccacccctcagctcccaaattcagctcctctctttagaacctgctgtagtcagattctcactccaactgttccactgaatcatccctgaccaggatcacctgtgactccaagatgctaaatctctgtcttcatattattaaatagttgatctatcacagtggactatgccatcctcctcagaagtctttctccaggtttccctcctactgtacttgctagtccttttcagtctcttttgctgagctactgaatggggctcagccccttgcacagcttccctggttttttttttttcttttcttttcttttcttttcttttttttttttttttttgagacagagtcttgctctgtcacccaggctggagtacaatggcacaatctccgctcactgcaacctctgcttcctgggttcaagtgattctcctgcttcatcctcctgagtatctggggttacaggcacctgccaccacacccagctaatttttgtatttttagtagagacggggtttcaccaggttggccaggctggtctcgaactcctgacctcaggtgatccacccgccttggcctcccaaagtgctgggattacaggcgtgagccaccgcacccggccgacagcttccctattgacatccaccctcttgatgatctcatcctgtgtcacagctttaaagaactatgtgctgagaactcacaaatactcatttccagcctggacctctccccagattcacagttccacctgcctacagtcttctccacttaagtgcttaaaaggcatctcacacttacatccaaaaccgtattccttatctccccacaaaacatgctccatctgtacgcttccattcagaaaatggcaattccatcctcccagttgctcaggccaaaactgggaatcttcctgctgctcccagccaactctgtctcctagttcacagcttcagctcctttctttttaacctgccccagtcaggttctaaacccattctttttaatctctcacttccaatccatcagcaaatcctccatgctactgctctggtccaagccaccattgtctcttgccaagatttctgccatagcctcctaactggttctactctttctctcagtttattctcaacacagcatccagagtgatcctgttaaaatgtgagttacatcatgtcacttctctgtaaaaaaccctctagtggctcctgtctcagaatcagagcccaagttcacacaaggacctcccttgaatgccgtgaacactgtggagcctctcactacctctctgatccctctcctgcttctcccttattctctctactctggctacaccaccctcctcacttatctgttaacatgtcagacaggccctcactgccaggctgttgcacttgccattccctccacctgggaagcttcttccccgttaattctcagggctcatgtcctcacttttttcaggtaactttgttcataatttaccttctcaggtgtctagccttctctggacacacattttagaatttttacacgccttctcaccttctgccccaatattccttacctctctctcctgccttattttttcctccctaggatttaccacttctgattcctatatttttaatttatgtatcttgttagtttttggactcttcactaccaccaccgccccacccccctacccagtagacttcaagctccatgagggcagggtgttagcctttttagtccaatgctctattcccagagccctaggacagtgcctggcatatagtaggtgctcagtaaatagctgatgaatggatatatccatggaaatgaatgaagggacaacttattttttatacaaggccttgagacaaagtgggaagggcactgaggtttctgccagtataggagcattaacaggccaaatgagaaagaaaccctctgagtggagaatgccgctgggtggaagcttgtgcccgtgtctgccctgggccagcatcctaccaactcacacctcagcagctttcaaagaactcaccacagatgggctctcatctttcaacttccatccaggcttgcgttgttcaaaggcccaccttcagtgccctgcttcaatcatttactttccttgttttttgcaggtgccagagtttgtagcctattggaggaaaacacaccaaggtaagacaacaataagaccacatcttgtttgggactgcccaacgtagccttggaaactgtccaaggaagaccagggtgctaagtgttggcagctggataaagggaaggcccaagagactttgcgttgacttcctggatagagtgagagtcctggggacagtgaggcagctcagtatagtcagtgatggctgtgaggtctttagactcaggaagacagtgttgcacttgggaaaatgtagcagcctcccccaagccagttggttgtgggcccacagcatggccctcttgccctcacttccctacctccctccgggtctccctttcctcacttgcccagaagtgctgcctggcccactgaaggcacagcaggctgctgcagagggtctagtgcttttttttttttctgagatggagtctcgctctgtcgccagactgaagcgcagtggcacaatctcggctcagtgcaacctctgcctcccgggttcaagcgattcttctgcctcagcctcccaagtagctgggactacaggcacacgccaccacgcccagccaatttttgtatttgtaatagagatggggtttcaccatgttggccaggatggtctcaatctcttgacctcatgatccgcccacctcggcctcccaaagtgctgggattacaggcatgagccaccgcgcctggcctttttttttttttttctaaagtaagactggtttagttcaagaggtatatactaagatctttccagcatagggcttctctgattctgtgtttaatctcagtccaaattttgtgaagatcctcagcaaataaatggatgtgggaaatgtgtgattgggaaagaggcagcttttaaaaatgtgtctggcctttgaccacgcaatttcactttccagtatttattctaggaaaatactcatactattgcaaagtttatatataaagatagttataactgcattgtttatcatttacaaaaagaaaacatctgaaagcccaacaagacggaactggttattccacattggcacattcctacaagggaatgtcattaggaagaatgatgaagataaatatttattgatgagaaagatatttgaacataccatttttttaaaaaagaaatggaaaaatcttacaaaccattcaaggaaagtagctttggattcagcctgaagggttgagatctagcttagtctcttaaccaacttgggaactcaggcaagtaatgtgatctccctgaacttgtttcctgcctgtaaacggggcacaataacacctatcttgtgaagttggaaggattaagagagattaacacatctaaaggcctcagcacagcccagtaggtgatgattgctcagtagctgggtgcttagatgagacatggactgtgatagtatttttacccgtttataagcctggaaacattctggaaattcatacaccagcagtggagttttctgactgatagaatcatgggtgattattaatattttcttatttttctacaaggaatatctcctgcttatctaaggatggtatagtttaaaaaaaagtgacaatttaaaaggttaaaaaaaaaacagtgcatttcagcaggtaagtttgctaagtagtccctgcacagagctctggagaactgagagagaggtgggaaagaaagggaatagagagaacaatgggtgaaggaaaagagaaggggaggtcagaccccagggctagtggccaaggagatgcacctcggcggtaacgctagagccccaccaagcatgtgtttgtcctcccatcccctatgattggcacctcccgggagagctccaggtaggagatcttgtaacccaaggctcatctgtcccagcttctgatgacaataaatgtgtgtagcctcttttagcggccgagacagcctgactatggcacgtccagggagaggccccgtggctctagtcctgggcctgactcatccacctttggtaaacccagcatttttttccatgtccagagtaggagaggcagggcatcctggtgaattcccagaagtcatcctaaaaggattagcacctctcttctttagcagcccaataggatctatacccaagagataggtctcccaagcaaatacaggctgccaggagagggaaatggtgaccacctaagggctgccatgcctggctctcatccccaccctcaccccaccaactgccttagtggccagtgacatcaggaggaacccttccatgctgatggtgcttgtgcccacctatgccagttcattgagcattcttagagaggcatgactcttctacataagcgaattttccaaattattaaatttgatcccatcacattgcagttttaaaattgtacccttttaaattaatttctattctatcaaatttatcaaaataatgcacaaattcaaaatagctggaagagatgattttgaatgttgtcaccacaaagaaatgacaagtgtttaaggtgatagatatgctaattaccctgatttgatcatgtcatgctatatgtatgtctggaaacatcacactgcactgcataaatatctacaattattatgtatccattaaaaacaaaataaaaaataatgcatgcatatggtttaaatatcagttgtactgagaagcccataataaaaatcccttccccgcctttctcactccccctctctataggctgcctctttcaaccatttactagtttccatttctgtttatactattttttgatctaccgattttaggcatttgttgacttcttgtgatagatgaggattgaactttcctacagaaccatccccacttttcctctctccatccttccaataggaacataacacaatctgtggttaactcaatagtgaatgtggacatattcgtcactgctgagttatgtagcatctttgagtcctggaagattttcttgtattatttatttaataattttcttccctgtattttatctgttggatcatctggattaatgttttagtttccttatattttctctcctacttttcatctctttgcctttttggtctactttcttgggaaaccttcattgacttcatactccaacccttctgttgattttttttttaattttggctttctttttctaatatcctagtactcattcttgttcttcctgttctttttcaaaaataccacattcttttttatgcatatactatctccatcctattcttcttgaggcactatttatttttcatttgtccatttgtcttaatagtcttctagtctctattttgtttttgtttctacctggaggtggcagcggcggtggtggctgcttcttgttgttgttgttgttgtcgttgtcgtcatcctccttcttcttcttcttcttcctcctcctcttcctcttgttcttcttcttcttccctcttctttcttccttcttcctttttccttctgctttctttttcttctccctctctctgtctctccatctctccttgttggaggctttccttaaatgccaaatatctcagctatctgttggtatttattaatggagcaataaaaggctgaactaaactctgcttggggagaatttatcaactggggtttcactacaggaagcaagacagtcttttagttaacaagcctccaatgagcaccttttctctagagctaggtttcttaaccttggtactagtgacatgttgggccaaagaattccttgttgtcagaggctgtctcatgcattgtagaatgtttagcagcaccagtgacttctgcctactaaatgccagtagtaacccccctcccagagttgtgataaccaaaatgtctgtaaacattgccaaatgtcccctgggggacaaaatcaccctgttgagaaccaccaccctgaagccattcagctcctcaagagaagcattctaactcctagttctagttattgaacgctacataacaaaccacctcaaaacttagtagcataaaacaacaaccattttttgggccactgtcaaggagtcagaagggcaattctctgctctacgacggctaggatgactggaatgactcgaggtgactggaataactgggagttggaacagctggggctgaagggtccacttgtaagatcgttgttcacttggcaaagagagctggaaggctgggctcagctgggactgttgaccagagagactacacatgatgtctccagcaccatggcctggtcattggacctcttacgaggcacctcaagtctctggtgtgagtgttctggccagcaagacagaagctgcatggctgtgtatgtcccagccttggaagtcacatagctcatttccactgtagtcagaaatccacacaggttcaaggaaggagacacagacccacctctccattggagaaatgtcaaagaatttgcaaccatcttttaaattcaccataccctcatccagagtgatatatacctggggtggggcagggcaaggtaagtgggtgggacattgagtcccacgcttcattcttcagacttttccctcacctccctgttttcatccctgtattcatctgccctccctcctgcctgtctctctcctgttcagtgtctttgtctccagctgtgtggggcagggtgtggaggtgagacctggggaggatttcaaccagtttcctccattcattacccccacaggctgctgtacctcagccccaccagccacaacacctggactccccaagtctgagctcctcctgcagggttccaggggtaaagtggcttgcctcctgtcagtgtgcccctctgcaagcccttcagagcctagcttcctccatgtcagtcattattcctccacctgcctcccagcttcctgtagtttggggaactctttcagccactcatgtctcctttaccattctctttgcctttgagagttaataccatttggttggttggttgtttgagacagagtctcgccttgtcacccaagctggagtgcagtggcacaatcttggctcattgcaacctctgcctcctgggttcaagcaattctcatatctcagcctcccgagtacctgggactacaggcatgtgccaccatgcctgactacttttcgtatttttagtagagtcggggtttcaccatgttggccaagctggtctcgaacttctgatctcaagtaatccaccctcctcatcctcctaaagtgctgggattacaggcatgagccaccgcgcctggccccatttgatttttttaagagacagggtatcacttcatcgcccagactggagtacagtggtgtgaccatagctcactgcagcctcaaactcctgggctcaagtgatcctcccacctcagcctcctgagtagctgagactccaggtacacaccaccacacccagccaattttttttttaagacagggtcttgctatgttgcccaggctggtcttgaacttctggactctaatgatcctcctgccttggcctaccaaagtgctggaattataggcgtgagccactgcacctggccccatttgatttctagactagcattttagtggtgcttcaggagagaaaggaaactaggagtgtaaataactgatgtgttgaactggaaaccctgttgtacctctcttgtatggatctatctctacattgtgttatagtcttccctgccctgtaacagctctgtgaagcagtacagtgacatttaaccttctgttgatcattcagagtcctccttatgaaaatacttgtttaccttggaattattaagctattaagctattaccttggaattattaagtaaagctatttgttcttccataatgaggaccccagtcattttgctgggattctttaaacctttcttcgtggccgcctctgtccctggctgcctttcatcctatgtatttgtggtgagagtgccacattacagcacgttagcttctgatgtactcttttcaaatggccagccccggtgactctgccgggcattgtttgtttgccacccccccacacatccctgctccagttgattttctgctctttcccactcctcccaggatttgacctttgtggattccatcagccaggctccaggtccccaagcttccagttgggtttggccaattgaagacccctcccctgaccagaggttggaggctgggaggggaaatgggaggtgctttatccccccagctccctcccttgccaggtctcaggtcaatagtgcctgtgtttttcaccctaaaaccacagctcctgccggcagtcccctcctactggtctctctgggttccaggagccctcccacctcctccctggggattggtggtcacagctcccactgttgctggctgcaggatgcttcacctttccttgagggtttctcttcatcttgctcacccttggaaacggtcctttcctcagtctctcctgttaccagtggagtgtgcatctgtttcctgctgggactgtgatcaatacagcaaccttttctgatttgcatctaaaacaaggatactcaagcagagagggtatcaacatttaaaaaaataaaacaagaataaatagtccctgagtgagccctgagagactctcttaggcgagagtctgggtgtgagctttgtgacttctctaggctacgcaagggcttttgtttgttcatgtcgatgtttttaactataatgcagataatagagggcaatagattagtgacttctgtacttactggagtgatttgagaaggaaaataagcatgtaaatcaagggaagccaggatcactcactctcctggtcccagtcagccctcgtttttgtttaatttgtgtatttcgaagcacacatatctctagggaagaaaatgaaatcaagaactcctcctggccaccggtttcctgaagcatgaaaaggaagcatttcataaatgctttgtaaagaagacaacaggaaggggtagtgtcactggctggcaagagctgctgttgtggtatttcacagacaagggaggtgacgtggcacatgggggctgaggtcccagccagaggccacacaggcacaggcctcagagcccaggcctccctctggcctgtagaccctcagccctactggacaggaggaaaaggcctaggggacattgcccccatttcacagagaggaggctgaagccagtgaagcagagagttgcagcttcagtggggagacactgttatgccccgcctgtcttattcatgcttcttttacctgtagggatttttttttacatggctacccttgagtgatagagccttcatcagcttagcttgtcctcttgcagcctacgccactctgtgccctttagccaaggaagcccagctgaggccccgcagcgtccctgcccagcagagctacaggaggcccgaggccccttcctgttcactcttgctctatagacgccacgctgcaaagcagatgtgcagggacaccacctgaagacccagcctgcagctcagccctacacactgtggatggtggagatcccagagggccaagagaagcttattgagacttctctgcactgcccctcccacagcaggaggttcatggcccatgcatttctgggagggttgacagggcccaggttgtggaatacctgtctgtgagccccatgtcctgtcttgtcccagctgcctgtagtttgacagagtatgctagaggtcagccattgctagggaggctgccactaaccacacagagaggaaggaaaattctcagccacagcacttagagctgagcctgacatggtcctcagcaagatgttgcaagttcctaatctgaacacagaggccagggagtaagcatcatctggagcccagagctgactgtcattacccacaaacataaacaccctgagtctggccttctccccaccctgccgaggttgtcagagcctcagcactggctctgccctgggtggcagcccctgggaagcccagctgccacctctctacaaatggccctgtagaagctgtgctcagtgatccacttcctggggggggctgggcccaccttgttgccattacaccccattacaaactgatgcaaccagctttcaacagacactgccaaggaagatacacattacaacagcatgctgcaatacctctgcctgtgcaagagactgacccacatccaaaaaatggacatcttcccaccccagtgtctcactccactgagctggaagtggcctttgtcaggaccctgtgaggtcttgagtggatctgcttttcccaagatattaaaccagtgactttaaatcctggctgcatattaccatcatctgggatattaaaaaatactgatgcctggatcttgctcccacccaaagagtctgactgaattgatggggttttcaaacattttttaagtgtttgttgaaggatgacatacatgcaaaaaaaaaaaaaaaagcacaaaccataagtgtaaagctcagtgaattttcacaaaatgaatttaccccgagtaaccagcatccaaatcatgaaacagaacatcaccagcaacccctggtaccccttccacttactacctggctccaaaggctaatgtccattctggcttctaatggtgtacagtcatttctcctgttttcaaactttatatgatgtaaatggaatcaggcagtatatatcctcttgttgtgtttgtgagatgattcatccaagttgttacttagagctgcagtttattcactcttcttgctatagagtattccactctatggatattcctcgatttatccattctactgtgatgcatttttggatattcgagttgttatttataattcggaactattctgactattgcaatgacatgctagtgtgtatttttggagtacatgtatatccattgctggggaagcatgggtatgagtatgttcagctttagtaccttatgccaaataatgttcccaggtggctgtacccatttacactccctccagcaatgtatgagagttctggttgcttcacatttttgccaaccatagatattttctatctttttcatgttagccattctggcaggtatgtagtggtatcacagtgtggtttgaatttgcatttccctgatgactaatacagctgagcaacctttcatatgtttgttagccatttagatcttctctttgcaaagtgcctgttggaatatttggacatgagtatttttaaaaagctccttaggtaactctactgtgtagccaaggtggaaaaccactgaactaaaaccacaaattagtatctgcgtctccctttcttcatgatttgcctttgaacttagagcattttggatctgagaggacctcgtggaactgggaaaagattatattcactccctactaagatgagcctgtcaggaagaagcaattggagctggcagttaagaatctttaggaatgtgacctctacttcagaagggtccagggagggcctgtggtgtccacagctgccacagacatttcctaaccacaaaaatggccccttggtggtctccccagagctccaggcagtcatggggaggaagcggagggccccatgccaggtacttcccagtttctaggccaacatgaatgggacacagctcatatggggttgtggttagactggggacagtggagcatatgttctggggacctgggtgtggccaagggaggcctcctgtctgtggcctttgtcccagattggaaatcagccagtggggctctcctacatgggtccaggcctggctagctcttgaattctgtgcgtttgcatgtgggtccttatgcatgcgtcctagagcagggtcccagggggccactcccccccccgaccccttactcctctaagctgggaaacacgtggcatgagagaacacactgtggcttctaatgacatcgtgtcttgattgcatccccattgcatcatctgggctcatctcatccccacctctggactgtaacatcatcccagggactgccggacactcatctgtgctcccccacagagagtataatgccatttggtaattcagtacagcctcttccaacttgagaaagaagatgcatttccttccctcagtcttgagctgtgcaggtgtcacgctgagctgccctgtgtgggctccatgttggcacacatcggttgcaaggggctctgtgtagtgagtctggagttggaccactggccaggcgctgggatgctagtgcctggactgagtgtgcacagaggcccctcaggcagagccacagtgggcgctgaacctcctggtgaagttcaccgcagtaactagagctcagtgggaggggctggcctatcagcacctgtcctgtgtgctttttgaaaagagcagggtctaccttctgtcaactgaagtcctgccagctgcatggcatgagatgagggacaaagtggcacgtgaacaaagttgacattttggaggctgttaggctcagagccaaccctgggctccatgtagtgccatgactcatggattcaggcccatcttggaaattgctctgggcgtagagctctcatttctgatagtccaagtgcagatattggggttcctctaattggcccaaatggtggcctgcaccaaccagcgaccagagtgctgtctgaatctagaataacaggaagaacacgcctccagcagtgtaggagagttccccatgcagtgtgcttcccattcttaccagcagttggtatcttctgtctttttcacactggccatctgagtctcataaggagactcctctccttccactgagcctgcatcccagcctctcccctttcttcagggacctctccccagcaattacgcccttccattctctcaaccagggaatcttcaaactcttcttctccactggctcctgctgtgctcctgtctccatcacctgtataatgcttcctgccatcctgccttccccgtggagtacagccatgctgtctgctgcttacagccaagattctggaaagaaatgtctcctttttcctcgtcatcaaccactcatttattcagcaagtgtttcttttacacttgcctgtgctgggcatggcagcaatgcagcagtgaacaaaaccatcagccctgctctcatgcagcttataatcaagtagagagacagacataaatgattaatagatgctcctgtaatggtggttgtgaggtgtgctgccacagcccagccacacacgccagttcccttctctgcacatgtacatgtctgctcatccttcccacctgaactcatgtgccacctcacttatgccccttcccaatgccgcacccacacaacagggtgtccctctgtgcccacagcagcccttgggtataactgttccccacagaggctgaaccccaagggcagagtccaggccacactcaccacggagacccctgcctggcacagagcccagcccagcagagatgctcagaagatgaatgaaagtccctgctgagattgatccaatctgtttgtgaacatctctggggtccaagaattcacggctttctttttctttagagagccttttgtttctttttgccattatatactatatttgggttagggcacaacaatgtgaatatacttaatactgaactctacacttgaaaatggttaagatggtaaagttttaagttatatgtattttgccacaattttttaaaatgcagagcataggtacaaagaaggaaaaaaagggggcaaggtccattttattgagaaataaagaacaaagggttcaattcagagaggattggattttaaaacgtaatttagattagggaaatgcaaatgaaaaccataataagtaagataccacttcacatctgttaggatggctattttaaaacaacaaaaacaacctgaaaataagtgttggcaaggatgtgaagaaatagatacccttgtgcattgctattgggaacgtaaaatcatgcagcctttgttgaaaacaatgtggtggttcctcaaaaacttagttatcatatgatcccgcagttccacttctaggaatatacccaaaagaattgaaagcagggactcaaagtgatatttgtacaccagtgtttgtagcagtattattcacaatagccaaaaggtggaaacaacccagatgtccatgacaagaggagtggataaacaaaatatggtgaatatgtacaatggaacataattcagctttaaaaaggaatgaaattctggtacatgttataacatagatgaaccttaaaaacattatgctaagtgaaataagccagacacagaaggaaaaataccagatgatcccacttatatgaggtacctagaatagtgaaattcatagagacagaaagtagaaggatggttgccaggggctggaaggaggaagaacagggagatactgcttagtggatgcagagtttatgttgagggtgatgaaaaagttctggagatggatggtggtgatggctgcacaacagtgagaatgtacttcatactatggaactctgcacttaaaaatggttaaaatggatgtagacattttatgtctattttgccataacaagaaagtaatttgggtgtattttagagattttagaaaatactgtaagcacaagaggaaaaaaattaaaatcattcgcaatcaccaggtagagacaacgactgttgaaagatcagtgtgtatcttttcattctcgttctctctctcaaaaaagtgtgtgtgtgtgtgtgtgtgtgtcttcagatgtcacactggactttcaggaaaggttcccctctctgctgcttccctgctggagccatggagagcaagtctatccctgttccataggtcaatcctttgaatgatttctcatggctgagttcactcccctgcacctccagggttgcacttctctgaaaatactcatttattttatgtgtctactaaaaacatggcacccacgacccaataatatgttggaaggggttggagagagaaacgcgagtacctctcacaccttctcacacactacacatcttagcgatggccgagtgagcatgttggctctctggactcctcagtctgttggtctgggctgcgccaggctcaggctccctgcctcccccccaaccttgatccccttgcttcttgaacctgatgctgggcctcacattctccgttgattctagctcttaaatcctgcttctccagcttgtcaggaggctgtgccctcacaccccaaagagcagatctgccctctccactgagagggaaggagtgaaggtcccacagcctctgacccctgctgggcccaagagaggaacagctgcttgctttatttctcgtgggagaagtgtgtctcctctttgtctcaggcacccctctgccctgtacagcagcaagtcagcaggaatgagctgagccgcccaagtagtggctccctccactatgggggctctgtggtcctgggggctgtcctgcctccactgccataggcctggccccagagcatgctgcagtggtcacaacctgtggaggtgcccccagacccccatatttgggcccaactacagcctccttccccagctttgccacctggcttgggagccagggcaccaccagcttcactggcagggagagatgaagaaagaggccatagccacgcaagtgactgaagttcatgttcgtgcacaccaattagagagggacagcacgttcatttacctccaaatccagccacagacacatcgcccttttctcttggctctgaggcctccacagaagggttttttaaggttgcagccaggacctttatagcctagtcctgagaagattatctttttattgcaactttgattaatgattgatcaaaaactgatactagaaacactgaagaacaaatttgctgtagacattaggaaaggtctacatctggcaggcctggagacctgcccaccctctccccccacggtcaaaccagggcaaaggtacattggaagacccaacccctacacactcttacacgtgcactcgcacacacacactgaggggaaagaaatatttaattgtccttaaatcctcttggattaggctataaattgcaaataaatggagcaacagacagagcaaaagcacataaggtcctttaatagaatttctctatcttattctgtttctatgaatgcctgttacaaattagcagcttaaagggaaacctggagtgtgggaaagagcgacccttgtgtgaagtccacagccggggtttcctacagacctcaggtcccagagaacatctaagatgcctccaacaccagatggaggagggcaggagatgctgcacagagaagcagcacttcccgagcatctgtggcaggaagtgacttggagaggatgaggccgtgcctcaggtgtgctctagctgttctgatggtctctgaggccacgactgccatggtgaggtccacagcctgcatcagaatcaccaaagggcccaaacgtacggcctcagagcctggagagccaggaatcggcattgcaacaactccctgctcagtgggttctaccagtccagtacctgccctctgagggtgcccagggagcagggtgcttgctggctggaacactttttcctgcccctcagctcctctgtgatgccctgaggcacgggcactggaaagctggcagagctgcttctaaattgaaactggaaaatgaaactggaaatcacagtttcattttccagtttcactcgctccccctactgttggggtttcttttccacaaggagagtcccccagggagaaagaagcaggagtgggagtgggggagcatgttgggggaaggcagtgagggtgtcctgtctgcagcagggcatggaggggccccagcgctgcacttgcttcctttaagcctggcctgcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctgaagcgactggaatgcggggaaggagggcagtcggggagagccgagaaccagcccccctgccaactccaccccattcctctcctcacctgaaatgtctcatccttagaacagctgccctaaccccctaatcccacacactcctttgtaggttaagacccctgaagttgcaccctctcgtaggagctatgtttttcagagatccatgtgattatttgcctaatgtctgcctccctcagggaagtaaagtctgtgacgcgtggacctggtctgtgttgttcactgtgcatccacagtgcctgggtagtgcctggcatgcaggaagtacacacaaaaaatatgtgttcatgagtgagggcaggcttgaagagcccaagagaaggacagtgctccagggaggcgtctgcatcaggctccccagtgtctggactgcatcccagcccctccgagcaacttcaggggaggattctgtgaacagatgccccagctcttccgcccacagctcctacccccagcctgaggaatgctttgactgtccccagtgtgtgcaggcagtggggaggtgatagggggaggtgtcccacatggcacactctccctagcccttgctttgcctccgttacctacatagatgggcttcacagcctcttccagataggcagggcactgagctctgtgggccacacctaaaaagaaagggagacaagctggcggtgggggcatgacagtgtttttgtttgtttgtttgttttttgagatggagtttcactcttgttgcccaggctggagtgcaatggcgtgatctcggctcatcgcaacctctgcctcctgggttcaagtaattctcctgcctcagcctcccgagtagctgggattgcaggcatgcaccatcacacccagccaatttttgtgtttttagtagagacggggtttctccatgttgctcaggctagtctcgaactcccaacctcaggtgatccacccacctcagcctcccaaagtgctgggattacaggcatgagccaccgtgccgggctgacagtggtttttaaagggggagggcagatgaaggacgttggtggaccatcctctgggaggagatgtggactgaggaagcaacgctgacctcaggccccacaccaccctttcacctcagcctcactttctcatcagtaaatggaactcgttcttgtgtatgtgccatggaggcaatgtagcagaagagaatagggcagactttggaactcagccatctgggagaaaatcctagttatgtgatgaccttgagccaatgactgaatttctctgtctcattttctcttctgtaaaatggggacaattacagtgaattctgtgaattcattcatgtccctgacacatggtgtgagctcagtcattacctttgcgagggttgcaaggatgtaatgagatggcagatgtgagcacagctcccagacccgaaggtgctgtatgaatgggagggagcagtgagtgttatttgggaaatattgaagacacaacttccctcccacatttgtctggggtggagcaacagttttacttatttaatgataagctggaagatgcaccaaagggaggtgaaaaactgaaaccgccaaccgtttgagctccaggctgcaccgaagcggtgtggctggtgcagatggtgagagccccagtgccggcccacttcctccatgagtgccacacgcctttctcaagctagccggcttcccaaggctgcaggaagtggggccaggaacaggccctccggctgtgttgggggaggcctgggcaggggttggcagctgctgggtgtgaacggaagtcttggaggtccttgaaggtcctggggccgcctgcacagcagcccctgccctctccctgtccaggcctgcccaggactagcttgtagcagactcttcttgtagcctaggctcttgcctcttgcagtagtgagccattgtacaaaagacatccagcggagggaggcaggctggagaggaggacagccgaatcttttctcaaaggaaatgcagttgtggttttgagacgttcatatttcacatctgtggttggcgtttcccagggttctcagaggtgaatgcagggtcagccctgtgtcaccaaataaggctcacagtgaccttagcaacaagctttgctgcccattggctgtcactgctgccgcctgccaatgcggcctcctgaaggccagcactgatgctgagctgaaacttctgcatgtgccaaggtccagctgcctctgtcagaaatcaccgtccttggaagcagccacagataggtagagagctccggacaaaggtggacaaggtcagtgggaggactgtccaggtgtccatgtttcagagtccacctggccagcattccattctcacatagcaccaaaccagcaccttggtggcctggtcccagcttgccaggacaaccccccattccaccctgtcaaccttgaactctataatggtcatcatttcatagctctgctcattttagttccactgggttctcccttgtgcttggcacttgactaagctccttctacacattacatcttttacctctctcaacaaccctgtgagccaattagccccattttacaggtgcagaaactgacaccaaaggaagtcagtaatggcccaggtgactgcaccactagtaagtggggaagtcagaatttaaacccaatttaaacagacctagatcccatgctattaaccattgcactgtattgacagacactcaatgtccgtgcagctcagtgtcttcattctgtgacatggggatgacagtaccgtacctcacagggttggggtgagcattgtgtggagtgacttatgtccagaagcacacctttgcaccagtggccttggcacccccaaggcatgctccacaaacagcttgcacattcctttctcacagcgtgtgctgctgaaacattgaggtttgtggaccggacttctctgtagcccttgtatttagttttcacttcctctttcttgacctcctcccaccccccacccaactgcaaggtagggaggctactgaggggccagcctgtggattccagagggcacagggctatctgggatggaggggacagggttctgaagacagaaggtgggaaggtcacactgtaagggcagacataccccatttcttctacctaaacaactgggtgtaataccactgtttccctgagaaacactttcaggattaaaaagtatataagtaaagaaaataaagcatataagtgatctggtaaagatgaaaacatggctgatctgaaggtagtgaattatctcaattgacttcacagtcagttacagatcgaactccttgttctactcttttcccccttctcactactgcccttgactagtctttttttgttgttgttttttgttttttttttgagatggagtctcgctttgtcacccaggctggagtgcagtggcgcgatctcagctcactgcaagctctgcctcccgggttcacgccattctcttgcctcagcctcctgagtagctgggactacaggcgcctgccaccacgcctggctaattttttgtatttttaatagagatgggatttcaccgtgttagccaggatggtttcaatctcccaacctcatgatccaccggcctcggcctcccaaagtgctgggattacaggtgtgagccaccgcgcccagcgactagtctttaaaaaaatgaataatataaatttttttaaaagatgaaaacatatatataccctgtaacccaagagtcccactcctcagactcttctcaaaccacactcttacccatgtgcaccagaatacccacacagcaccagaaaatgtccaaatgaccatcaaaagtggagagtacaaataaattgtgcagtgttcctggagtgaaatgaactacagcgacttgcaataactgtaatattgtcatattggataataatactgtaataacaaatgactcatcaatgaataaaacctacaaaagaatgcatacagtataattccttttagcaaaaatttaacagctggcaaaactgtattgttaaggatacatgcagaggaggtcaaactacaaaaagcacagaattattacaaatgtctacttatgcagaagggagggttggggttgtgattagtaggggaacacgtaggtgctttgggggtgctagtattgttttctctctttaagtttgggagattaccctggattattgggtagaaactggggtgggtgagcccaatgtaatcacaagcattcttaaatggagaagagagaggcagaagggtcagaagcagaagcagaagcagagagattgcaatatatgaaagacctggccagccagtgctggctttgaaggtggaggaaggggccgcaggccaaggaatgcaggcagcctctaaaagctggaaaggggaagaaaggaaagagattctctactagagcccccaggaaggaatgcagccctgctgacaccttcagtttagcccagtgagacctgttttggacttctgacctacggaactataagaaaagaaatttgtgttgttttaagcccctaagtttatgttagtttattagagcagcaacaggaagctgatccactgggaaaccatctgggatatgcagctgcccaaaatccctgctcgtggttagattcagccttacgaggctccacagcccctctgcgaaagactccattccctcttggagaagctcagactctagagccctgggcaaggaatgggccttcatggcatgggggcgatcaagaaggatgccccccaggacagtgactctgctggacttctctacagaaaacagtatatccctcagtggcatgagaagatccaatagggtcaccacactccacaactgcaggggacactgttcacattttagtctatgcagcctctggtggccaaagattaaatgagaacacctttgctgtgtgacctgaagttcatggtcagtaaattgtagctattgttatgcacgacttagggggaagcaggggtcactgcagagcagcagtggttttatagagatttgctttatgattatttgttaaactgaacatatattctatgtatttttctgcataattattgtttcacaatttttaaaaagcatatacacacatgaatcttctctagccccgaacagcacagtgaatggatagggcagcagatgagctctgccccacgccggccctgtttcagaacagcactccagagtgccgcactgcttgctgaaccacagctgttactgcagattgaggagcctcagagggaacagaagataaagatcattatggaatttaggattgcaggacattctttgacatttcataacagccaggggagatcaactgtggtcaggggacaggggcaggaagaaaccatggccaaggcctgtctggcaggacttgaaggggcagagggacccttgcaaatgaccctgcctggaacccacccccagttggcccctgtatagcactgatccagctggggcttttatcccaggataccctcttcagggatgcctgtatttgttgattatctgccatatgcctggtcactgcagaatacaaggaagaaaatagccttcagcagaagctgagacaggagcctagaggatggacagtaaggagtcgaaggctcaggatgaggctttcctgactttctcccctagaggactgatgttctctactggtacagaccttgttttattcatccttatgtccctaacctggaatgggcccagggtgacagttataataagtgtttgtcaagtgagcaagtgtgtggagtgtgcattgtagagagtaaggtctctacaggatcctgctggagaggcagcccactgggctcaccacttctccagaggagggactggtcccttgccagacagccctgccagctggagcaggcttcctcaggggtgcctggagctgttgaccatggctgttgccctctggcccctcttgggaagagcaacctgtcaggtgttaaagacggtcttcatttctcttctccaagtaaacatgactagtttccatctcaccatcttctggccctcagcagactggttatccagtctggagaggcaacagtagtatccagatgtgatccgaacagacagaacgatggatgcagacggaaaattcaggtttgtgtgcttcggcagtcagtatatgcaagtcgtaatggggacagtggctggcatggcctttagcactgtgggaaggatcagggtgtctgcccatcatttttctctctttgatagacactgtttacgtagacactgttttggtgtaaaaccctacgttgtagctcttgtcaacagtgttatgtttctcctcaactgtcctggaaactccctgaggtggctggcttgtaggcactccatacctgttagctagtattatttatttattgttttattatttgaatggacaatcaattcatgtcatttaatgaacatgggctatgtgccagaaaccaccaggtgccagaatacaacactgaactacagtaggcctgtccctgggccccagagctcccagacacactaggaagacttgttgatttaatgataaaccttgattgagctcatgattaacatcttcaccaccagacatcattgagtgctctctgtgtgttcaactcagaacatacccttcctgccctcagaggctggaatgtgagagtcattaagggagacaccattgtgggagtgagaaaatcctggacttggagggaactgactagggatcacctcccagctctgccatggacccactgtgtgaccatgggcaagttacttgacctctctgagcctcagttatcttatcagtgaaactgggttaataatatatctctcagtggcacaggaggatcacatagggtcaccacactccacaactccaggagatgctgttaacattttagtctatggatcctctggtggcctaagatttaaatgagagcacttttgctatgtgacctgaagttaatgtcaataagttatagctattgttatgtacgatgtaagcaggggtcactgcaggccagaaggctgacacaatttggccaggctttgttcttcaaggaagggcagggctctgagaagtgcagaccgtgatgcaggtgaaggccaggaggcagggactcccagggcaggtctggaaggagcgaggctggtgacggaagtggtcagcaacctcaaggcatgagtaaggcgcttgcccttctctccaggcacagaggagtcactggaagctgggcaaagagctgggatggatgagaccaaggcgaatactttacttattaagctgcaaaggaccctagggagcatcttgtcttaccaggcaaacaaaggccagggagggaaagtagtgagtctccagggtcacacagcaaggaccagggcccgcgccaagactcccacccctgcagaacccagctcaaatgattccttgagcccagtgtgtggctccacaaaagaaagttcctggcacttttcatatttatttataattttttttctgattataaaagtaattataggccagtcaaggtggctcacacctataatcccagtactttgggaggccgaggcaggaggattatgtgagctcaggagttcgagaccagcatggacaacatggcgaaatcctgtctctacaaaaaattagctgggcatggtggtatgtacctgtagtcccagcttctccggaggctgaggtgggaggatcacttgagcctgtgaggtcgagactacaccgagattgcactaagccgagattgcaccactgcgctccagccttggtcaacagggtgagattttgtctcaaaaaataagtaaaagtaattataggtcatcatggaatatttttaaactatagaaatataaaaaatatataatcacctgtaatcccaccatccaaagataatcacctttagtattgtgatgtattccctccatctgtattccacaaaaaaattatatattaattagatttgaattgtgtatagtttcacatctcccttttcctctgtaaaattgtgctttatgagaaggagggattatttttaatgtagaagaaactagaaaacctttttcttaaaaaaaaaaaaaaaaaaaaaaaagcaaagccccacagtctgtagtggttggaggacatcctgtggggctgcatggtggctctgtcgcacatccggtgtgagctgcggggcggtggcagtggctgggtccttttctcccctggccaggctacacccttctgcctgtgggtaagacagagttttgaagcgtctgtgctcaccctttcctccctaacacaggatgctgtgatcattcaccctatcaaaaggcatgtggggttgtgatcgttactgtttgcatctcaagttgtgcggcacaatgttttctcgtgtgttatctcacctgagactcacacaccctgtgagacagataagacaaatgatgttatacccattttacagatgaagaaactgaggctacaaaagatctagtggcttatttgaggccacatagctagtaagtggcagagtggggactttttgcagatctggctggcatccagtaactattttttttcctctatacttttttttccagtagtcctagcttttccagagctaaactgagtccccttagtattcccttagtaaggccaaggactgagagtgttatgagtattgtggatgtgtggaggggccatgcaactccttcctgggaatcttaagccaagccctgtggcctctgactagctgtcctaggtggcctgacctcaggcaagcccctccatgaccactcagagccagcacctcagctcactgaggtttggggagggggctcaaagaggcagctgcttcctatagagaggtccagcagaggcactatcctggggggcatccttcttgaccccctccatgccatggaggcccattccctgcccagggctttagagtctgagcttctcccagagggaatggagtctttcacagagaggctgtagagccttgtgaggctgagtccaacccacgtgcagggattttgggcagctgcatcccccaaatggtttcccagtggatcagtttcctattgctgctctaacaaattatcataaacaggggcttaaaacaacacaattttttatttatttatttatttttttggatacagggtcttgctctgtcactcaggctggagtgcagtggctcaatcttgactcactgcaacctctccctcctgggctcaggccatcctcctacctcagcctcccaagtagccaggactaaaggcacgtgctaccacacctggctaattttttgtatactttatagagacagggtctcactatgttgccctggctggtctcaaactcctgggcacaagcaatctgcctgcctcagcctcccaaagtgctaggattacaggtgtaagccactgcacctggcccgtttcttttcttatagttctgtagtcagaagtccaaaacaggtctcactgggctaaactcaaggtgtcaacagagctgcatttcttcctgggggctctagtggagaatccctttccttcctttccctttccagcttttagaggctgcctgcattccttggcctgcaaccccttcctccactttcaaagccagcactggctggtcaggtttttcacaatgcgatctctctggttctgacccttctgcctcctccttcttcatttaagaacccttgtgattacactgggcccacaccaataatccagggtaatctctctatttgcaagtgagctggttagcaaccttaattccatctgcagttttaattcctctttgccatgtagcaacatattcataggctcatgcattaggacgtggacctctttattccactgtggaccaatactctgccttccacacctagcctctcttctgagttttccaagggccccccatcctcaggcatcctcaggcatagacagccggctgggccagaccacagtcaggatgttcccgccactatcagagaggtcctttctacctaagtcccctcccacctgcctgctcctctttcagctcggtctgtcctggattcctcttccttcatcctctgctcccagtcttaggtagagaagagctgagcaggaagtgccagggggtgtggagatggaggagggggaaggtaaggcctgaggcaccagggctctgggagcccagggagctgaggcctttcaatccagacaccctgcacttctctggctctggggcctctggggaccacacactcagctccagggctggaggggtggccagccaagtattggaacccttctgcttgtacatccctagctgcccttaacagccacagttcacctggcccttttcttgggtgatgacagactgtctgccttaatttattccctttcccctgtccctccctaggcctcaggctggaactttcaggagcttccacgggaggcaaggccccagccaggcctctgtccctgggctgcttggtgtggggatgggggatccagaaccccagcaggagggcagatggggagcacagggcaggaggggcaggacaaagcctttggccctcagggagggtgaccaactggccctggtttgcctgggactttcccagttttagcactgaaagtcccaaatcctgggaaactcctcagtcctaagcaaactggaacagttggtcagcctatctccaagccttttgcacctcctaatctactctagatcacctctgcagcctgcacagccgggcctttggactcctggatgctagagtgacctgggcgctgaggagggcccccgagccagtaccaggaaaggatagactcctgcttgcagcattcccagcagaggcatcgcctgtggacaccgcgtctgtgtctgtatatggcagagctcccagatatatgcacaagggagtgaaaaaatgtgtttgcaccccagtctctaaaaattcaacagcctggttacttctgggtggtatatcgtaggtggctttaatacgtgttatttgctcatctgtatttcttactctttgcacaattaaaccatgttccttttacttatgtacatttttaataaaagaaagttgttaatgactcagccttctatctccagtactgccgaaaagagacaagcggtcatgctgcatgtcatgcacacactggcccttgttctggggactttgaccttggctgctggttggtcatggcctgttttgcccagggctctactgcaggggcagggttggttattcctctgtgccctttttgcctctcagcctgcctgctcctctggaccccagagtctagcctggttcccccaggggagggactcagaaagtgctactatagagagatgctaactacatctctgctgagcagcaggagatgctctgaagtgccaatcctggctgaacactgtgagaatatggaagagataagctgcttgcccctggggagcttccagtctggttggcgagattgggtaccccgcagaccctgtggggactggcagacaggaagggacaggccctagagggtgaggctttgcctgtgagggctgtcactggtcagagaagggagggccccagggctccattgtacaagtcttaggatggccaaagaccaaaaatggggtcctcttcagtgacctgaggcaggccgcacaagcttgggggtagatggtctcctgtgcccagaactctggctgctcgccacctatgacagaagaatggtgatgaacactcaccaggctgttccaagtctcggaaagttggacaccccttcaggtcctcctccctgtcccaccccaccccacccctaccccatatgggaatgccaggctgtagccttcgctgtgacccatcccaactccagctcctctccccatcccaactccagctcctctccccatcccaacaagccaagcaggagcacttggaggggagccctgggtccccagcagaaacagccctccactgcctccacaatcaggtcatcagcccctgccccagtccactgttgccctagtgtggccgacatgacaggacttcttgtaattctggcctaatggttcccacatccccaaacaccaactccatgtccatatgcctcccttgttacacaaagtcagctttctccaagaaaccagagaagcacatgatccccgccacacctctccaggggcctccctcctgatctgagatcctcggtatatcccatggcctctctgagccaaggtgtagctgagttgtgtggggtttttgtttgtttgtttgtttaaccactgtgtaagaactcactacttgggccccaattctggacaaattccagattgacagtgtgagggagaggtggtagcagaactggacacccccacaaccttgttgctttgaaggaaagaaggagggcagaaacaggaggggatccagccaatccaaggcatttggcccgaaatggatgtgaagacctcacccaggctgcccctctgggctggcacaggagggcaggggagggccttccctaaaggaagcctgcaggtgaatcccagcgcccgcctgatgtaaggtggcaactggccagcagccagaggtgccaggtgttctcagggatcaagaaaccaggaattaggcccaccagagccatagggtctgacccgagcctggtggctgggaatgagaatgcatctgtgcatggtcctgagtctcacagccatccagggtccagacctctgaggaactccaggacccaacagagggtctggtttaaagcagaacaggagactaggttgtcttgctgagacagaaacatggctaaaaagtcctctttgatcctgggagctgagataaggcctagcaggccagagtcccccgtttgctccaaacaggcctggtgtggccaagctgccccctgcactgaggccaagttacaagcctgtctgtgtctcggccccctggggccccacccttcgaaactgcaggtggcctccagggcataggtggggcaaaccctaccctgttggggccctggggcctgtagcggcagagccatgttgccaggggtgttggaaggtgtgtgtgctgggggaagggaggagagctgaaggcagggcagcacagcagctgcagcttttgccgccttccctcagcatccacaagtgcttgcttggcataaggtgctcgggccctgccccttgctagctctccccagcttcttgtgcaggcctccgtgttcttctctcaggcagcctgatatggaaccaacctggattctgggcacagatagatgatgtgggttggaaccaaggctccatactgattaggtggtgagagttggtttcctggtctgtgaacaagggccgtggtggggtgccagtgccgtggtacacacgtggtgcttggcatagcacccagcacaaagtgagcactcgaggcctgtgttgccattatccagccacactttgaggtcttttccagttctgctcatttgtgagcttgtgggatcatctccttgggtgaggaatggtgggctggacgtctgcctcccctctttcattcagtccccatgtccttgctccatagcctccagtatctccccagctgaagtttcactcagcagactctgcaggcttgtgtcttaccactgagccagcagaggtggacttctgtaactccttaccctgagaaaaccagcataaatgggtctcttgagagctgcctggagctaggaaaactatgcggccagccagctatacccttctgaggccttagacttggccccacaagggagctccggatgataaagccaagctccaccctgccaagtactttcacccctggaaaaggagggcaccagcttccccttctcccaccccaggcctccttcctctgtgacagccagcagaactggggaaaggttagtgctgagttctgatgaattggaagatcagttgtgcccaagttaaggaacagcattacatctgacagagacaaaagctttctatagggtcactatattagccctgggtgctccaacaggactgcctggaggacatctgtaccccctttcccctccaagtataagggcagagttttggatctgtacacagtgtgaaagatcaagtggtcccagagaatgacaacctggctgtttcccagccccaccaaccaggagacatcactcctagagaaaaaaactccacttcccagggctaccccaggatttcagttcccactttggcaggccccactggagacttccagaaaaatcagagaaagctctttcctttggagttgtaatggtcacaacaccctgcacacagtgcactgagagatgttgaaagctgacacaccaagaagggatggtttgcctattagcttctagctttcttcctattgccaagtgagctgaatgaataaaccagcccaatgaaagtgaccagccagctatacccttttggagttaaggcaaggaaacccatgactaaccacaaatgcccgcaaatgtctgtaaacttggcccaacatgagaaatctagctggtgtggctgagcaccacttttgtcagtttaccccagtggaaagtggtccttgatgacagttatctcatcacaaccccagcaaaacagatctttcaacaacctcctagctccctcaacctagaacttccaccattagtgcttatactgaaactcttgagaatgacccacagaagcactgtcaggtccttagaatgatctaattattaagcacaaacttggttcagatcttactaatactgctccgtttcaggcactgtttggctaatgactcggtagtgtcagctgccatcacctttaggtgagctgtcagaccttatttagtttcttttcctaggaaaaggctgaagtcttggtaggatgtgatgggacagctctccatcctgaaaggtctggctctatcccacactactccaggcttggtccctaggacccagctccattgtgatgggggccaggggagagttttgaggtccctccctggagattccaagcaattgctaccaatcatttaggactcctgggatcagaggggatggggaaattgaggactacatcttggttgtggagattggaagctgatggacataattcctctctctttttggtaatttacaagcaattaactttgcttttagaacttgagagatttccacagctgcctaagacttcacatactcactgcctaccctccatcagggattagattgaagggcaggagaaaaagaagtcagagctgctgcttgttctgggtggtatcactttcctcccgtcagtccactctaccttgctctgcaccacctgccatcacccactaggagaacccagatggaagccacaggtggctagccacctcaatccaaatcttaaaaagggctggtccctgaaggagctggaaaagtccatcctgtctattcctctgttcccaggtgaagctattcttgagaaatccaagtggagcttccaagtagaacttcttttttttttttttttttgagacagagtctcgctctgttgcccaggctagagtgcagtggcgtgatctcagctcactgcaacctccacctcctgggttcaagtgattggcctgcctcagcctccctagtagctggaattacaggcatgcaccaccacgcctggttagtttttttttagtagagacagggtttcaccatgttgcccagcctggttttgaactcctgaactcaggcaatccacctgcctcggcctcccaaagtgccaagattacaagtgtgagccaccgcgctcggcccaaggggagcttctgacaagcagggcctgggataggggcctgtccaggcatccacatatagaatatttacccagcaggagtccccctgccactcacacagcatctccaagatcagggaccagtacttcctgagcttgacagagaatgaatgtgtcagactgacctctgcccattttgtagttttctcatcattttctcactcagtcttcccttttcaagggcccacactcttcccgagggctgggcctagtgagcggggtcacagtacatatggtttctgggactgagaaggtggaagatgtgtccatagagcttttgtttcctaagcaacgtattactgccatgattccattccctagatgatgctggtgatgcaagctggcttctcttggccagcctacctactgctgggtagtgtttatgccccatggccagacactgaagagggagacaggaaaagcacatatccacaccttccaccctcagacattcctgtaacttgagcttatctaagggggcattgtcatatgtcaggggttcccaaactacggtcttcagaaacactgtttaccctccatagaggttgtgtgcatcagcccaggcagaatcctgcttcatgaaggtgttttcctaatgcatgtgtgcatggacctgtctcatgctacactgcagggctggtattcagcaccaatagttattgttggctgctaaaatagcaaactactcaaaatggcaggtaaatagccccaagcccctatccccagtgtcctcccactactcaaacccctctccctcagatctgcccccagtccagtatctacctgcactgttcaatatggtaaccactgaccacatgtgactatttacatacagtttattaaatgcaattaaaagttcaattccttattgcactggccacatttcaagtgcttagctggcacatgtggctagtgccagtgcctactgtattgaacggtacagacagagcatttcatcactctagaaactggatggcaagtgctacccagcacagcagccgtgaggacctttcttgggctgctgactgttctgtctgtgactgtgtcatatcaactgactttttggagcagcatctgtgtgttagcaggacacatcacctatggcacatgcctcaaaacttaacactccttgggccccaggagcccagaatcaactgacagccctggtgatagtcaaggacaggtgactatgtttatataagcatgttcctatgacaggaatgtcccctccttctgccattgtctatgtgaacataaacaaaaggatttttttttttttgagacaaagtctcactcttgtcacccaggctggagtgcagtggcacagtctcagctcactgcaacctccatctcccgggttcaagtgattcttgtgcttcagcctccacagtagctgggattacaggcgcccgccaccaggcccggctaatttttttttttttttttgagacggagtctcgctctgtcgcccaggctgtagtgcagtggtgcaatctcggctcactgcaagctctgcctccggggttcatgccattctcctgcctcagcctcccgagtagctgggactacaggcacccgccactaggcccggctaattttttatatttttagtagagacggggtttcaccgtgttagccaggatggtcttgatctcctgacctcgtgatccgcccgcctctgcctcccaaagtgctgggattacaggcgtgagccaccgtgcccggcctaatttttgtatttttagtagagatgaggtttcaccatgttggccaggctggtctcaaactcctgacctcaggtgatctgcccaccttggcctcccaaagtgccaggattacaggcataagccaccatgcccggccaaatgaaaggtttttttttttttttttttttttggtgcccgggctggagtgcaatggcatgttctcggctcactgcaacctccacctcccaggttcaagcgattctcttgcctcagcctcctgagtagctgggattacaagcacccgcaaccacgcccagctaatttttgcatttttagtagaaatggagtttcaccaggctggtctcgaactcctgacctcaggtgatccacccatctcggcctcccaaagtgctgggattacaggtgtgagccaccgcgcctggccgaaaggattttataatagatgcatgtccctgttcaccccaaagtcaagttcaggcgggatgccaataataagtccatcagtgtttccataaaaagtaaaatcatctacaagttaaatttctctctaaaaaggccacaccccttataaacaatttactttttataaaaagacaaatgtacatatttacacacgtccttatgtgttcacacatgacttaatggttagatgacatttccaattttaagtcataccaaggcgctcacacttccctccctgggcctgttgagggctgctggggcttgagggggtggtgggcgccgagcaaggcactgtataaataaatgcaaaggccaagagctcgggggaaatgttagtgtacacctctgatcagaaatgtggcaagatccacacgaaaaagtgccaagtttttttcccaagcccctcagccaaagcagggagcagggtagagctcctctgaggctgagggagcatcgccccgaaggaccccactttccttcacatttcactggctttggaacagtccccagggctcagctgaaaagggggtagttctttgggaacgagattcatttagtgcaattttctcttagtgcagagccagccctgggattggtgttatgcttttctggggtcactggtctgttcccctaggagccagccagtgacagcgagaccctctccaggcagctgggctcagaggaaaaagccagacactgactcctgtccaagtccctgacctgatacactggtctcagaacctcatcttcccaggaggcagggccagctttacaccacaagaaaaacccagacactggcctgccaggccctgagaggtcaatgacccaaggagggaggccccatccccacttggcagtggggtcacacttggctgttgaggggcccacagaagtccagcttctctgcaccatatccaccatgatgccaggtcctgcttgcctagaggaataagaggggcccaggggccctgctacggtgcacagggaatggcctggatggagggcaaccggactggggtcagcaggctgtccagccaggtggcatccatgttcttcagatctgtgaagacacgctgtagactcagcccaatatcccctagaagatgtgaagaaggttgtatgagggtaggggacggtggcatcaggtgtgcttccccctacccctgaaggccatagacatggcctctgctcttcccagcacagcagtaaacatccactcagcttcaggcaaaccttaaggcatggcagccgtagctaattcacaatgtgtcagtaccccagatgctttaccgccctgctccctggccctgcccccaagctttctccatccctacgtggttctccctcatctaagaagccataaggatccagggccttcttaccccctgggctgtcaatttctggctcctccttacagctaaagtctccatagacagaggtgggctggactccaggttcattgagtaggtaccccttcccatccacgtttgttggctgccactccgactgctccaagagctggggacagaagagcaagaggctatcaactcccttccagtgcagactcaccctgtggccctgccctcaatgagccagctcctctcagccagtatcacacccttggccattttcacaatctcagataggatgcagaagtgcactgcagtcaggacaagggcccgggagggaggaggcagaaatgcatgttggcactggtcctcaattcattttcccacccctctcacacccactctctggtatagcatctccacgacttccctctcaactgtgtaaggacatagtaagagggaatgtggcttaaaacaaaggttagcataataaatcaagaaaagatgactagaaaagctagagataaggaacgacatccatgtctcaattttttgggctaatggaacagctggcgtacaactactgcaaaaacttttttttgaaatggagttttgctcttgttgcccaggctggagtgcaatgacacaatctcagctcactgcaacctccgcctctcaggttcaagcgattctcctgcctcagccttcagagtagctgggattacaggcatgcgccaccaggcccagctaatttttatatttttggtagagatgggtttcaccatgttagtcaggctggtctcaaactcctgacctcaggtgatccacccaccttcgccttccaaagtgctgggattacaggcatgagccactgcccccggctgcaaaaactatattcactttcaaaactgaagcagaaaaaaaaacctggaggataatttgctaactttttctataaagccatcatcatattaacggatcctaaaggctgattattgaagcctgatgtgcatttcccgaactagcagggctggggcatgttggggcagaggatgcaggccagggacccatcgctgatagtgcctgactcacagagctgtctgatgccccaaggcttgcttcaggacggcctgtcagaggccaggcctcccacctgccttcccttcccatggtggctttcccaccagtcaagccacgtgaatgtggcacttgtgggacaatgcaagcagccaggtgacaacagcagctacccatcctctgatttggaagcttcactggttctctctcctcactgagaaacggtcacttcaagagtgcccaggtaggaaggggctttaccttcatgatgtcctcaggtaatttcccttcctcatcctcatctgttgtagctgtggatggggaaagcagagaggttggctggcagtcagccacactcaccctgcagttccagttccagcccaccagatccccctgccctttctctgtctctctgtctctctgacacacacacacacacacacaccctcccggtggacctatctgccatagagattccagaacaggaccctggcctggtgactcagcctctcaaaccctgaagccacgccgcttcccacccctaccctacttccttcctcaccctcagatgctgggctacagaggaggaaggagaaccagcaccccaaaatgcagcccctggcccccttccctcctctcaccagcccccactgtactgcagcccactctgaactgccttcctagtgtccccgtcgcttgcctccccctatggtggctaagactgggcaatgcccaactcaatcaattcagtgccaggtggagttctgatcatcttttctctctcaggaagcccttcacaggacccagacagtcaagcaggcaggccaggccccaggagcaccaaccttcagaggtggagggcatgggtgacacctggaagttgtacagatcactggtgctgtccggcacaacttccactgggatgtgccagtcggggagagtgctgctgacagcacatggcgacagtgctggggaacagcagaagccacaggtcaaggttgtgtgctttcttagtttgcaagacatcgagcgccctccgaccaaccctgcagcctgcactaatgggccaccatgtgccagcaccatgcctccaagagaaagagtcatcccactgacctgtggggtctcctgccagacctggaccagctcacctggagtcagggcctgctccacctccaagtcctgcatgtagcctggaactgtgtagctgctgtggtcatcaggcagagtggagctgctgagtccatcagagaaggtatcagggctggaatccccacatgactgtcgagggagaaagcagcttaggcccaggcccaccttagcatttcttccactgctcaccctggcccacaggtgaccaaaggcctggctgcttaggaccacactcaccttcctcttggccttgctcttagcatctcggctggacttcgactttctttctgtggggcagacgggctgtcagccttggtgcaggctctccagccccagctgacctccttctaccctccctccctgagggcttcccaaggacccagagtccttggataccttttctctggttcttggtgagaggtggaagcatccggtacactcgcacagctgagctgcccttgttcctgctctggtctttcacctcctcgatatctggcagggagttcatggcacagcgaaagttggccttccacgtcttgggatctggctccttttcccctgctttgtatcggcctagagggcaggagaaaaaagaggatcgtcagggccatgggtagggatcctcagctgcccctggcctgaaggaggaaggcaaggtacccctgacctcttatgctaccagagagccacagtggtcaaaccagcaggtactcccggtgacactctgcaggtcctaggccctgggccttctcaaatgcccaggcttggcttaaacacatctagcgggcctcagtgaagggcccagccagaagcactagagtccccatatccccaaagtgtactatctgtgtctcagactatgcccagtcttcctccttgggctatcagcagccagagggtagagtgggcacagactgggcagcagagaacagttactaaatgggtgggctgactgttctgagatgggcctagagctccatctctcaaggataaaggaggccaccaaccacatgaggcttggaccaagggccttggtcaacacgaagaaaaaggcagacctgggtctctttcagtgccctggcttacagctgcttttcacagatgcttttgccagggagaactttcatctagccacaaaccccctgaagccacacactttctaagatcttggcttttccctttgagaatttgctgagatgatcgactctcttctccagaaacacaagtctgccaccagcccctcttcccagtaattctgcatgttgtctcagggagctcagggaccccagtgaagagcctctgtgttaacgtgagtgcctcctcttgtctctaccctgggcttcctaggcctgagtcccaggcacacacctgtgtgaatggcccagctccggaacaaacaggcatccttgttgatgtcccagccatgcttggcagcatgcttccatgggatctggaagatcatctcctcctgaacaatacacacatacacataaggctgtgtcaggtcagagaccacagactttggggctgagtctgagacccaggcctgcccagccagacaggtctgagaaaaggctgacttccccttttttcccctgacatctggcttggacacccatcttgaggctggcttaaacagaccactctggatctctcaggagggacacctagtttggatgagctgcagcattattagctcacaaagacctccctctgcctgttacacatgtgctaggacccacacagggcaccctcccccaaagccctggttttgaagctctgggatgtttctctctggcttgtaagcacccacatggaagtaagaacttcttccattagaaaggactcctcaggacacctgggagcatgggctcttacacagggggtcctggtcataccactgagggagctctgggctagacttggatggtgaacactgtgtaaccctggcattgtcactgtatctctttgcccctcagttttctcttctcggaaatgagaaaacatatccaacaaaattttgaggattaaaaaccagaggatgtgtagggacacagtgacaaatatgaagtctaaggtcttactgttattatatcacttatggttaacagtaaagatttctgagtcagaccgttcaagttcaaatcttggcttcatcactttttgtgtgatcttatgatctacctctcagtgcctctgtttacttatctgaaaatgatgacattagtaagatctaacccacaggactactgcgaggattaaatgacacaatgtaaataacatacttagcaggtgccaggcacacagggagtgttcagtaagcattagctattattatgaatactatcattgctactaagtctatagggtctatgttgccccaagtgcaccagctataggcttcttgggccagagtgactggtgcaagattaactcgtttgtcctctgctaagccaggcacgtttctgcccagcagcatccacttctcagtcttctatttgttcgattggagccctgcagagtgctgtgtatgtttgtaagggtctcgcttagaggagagcagaactccagctctgcagatgctggaaagtcttgctgctggaaactggaagtgccttcaggtgggtgccctacctcaagaagggaagaaggcaggagtcatgcaagtgaggcccaggctgggccgtgcacactccctgcatgcaggacccactgggagaaacacctgcttgtcccgttatcacttccctttttgagctgcatctgaagctttggtccctccagaagtacatgggttaaaacagtggcaggaaaacccaaagagttacactcactttattaatccagatgagccccgggatttggttggaattaatctgcatctctagccagggtctcatgcgcatccgagtgatgggcatgttggctgtaaagagaacacagaggctccagtctggaatctgttgaacagtacctgggcagtgacctgccccacccgaggtcacttagttaccctcccctcacctcagccagctgctaggtactacactcagtgcggaggggagctgcgctggaataaaactgctctccaaattttttcagcatcttaggcaaaaatgcttttgccccttccttcagcccctcccagccagtctctggaggagacaggcatgcaagtgatggcttcaggattcatatgcaggaaaagagacaaaatgcacagataccctaatttcagaacttttcgctcaaaattcaaatcctttgggaagggagggacttcttttgcttgatgccaagaagaaattcccttgacttgagttgtaaccactagctagcaaagggctagccgtcaccctgaacagccccctcccgcccccctgaatccattctacgccttcctgacagccacagcgcccacaacgctaagaccaggacgctaacccttccggcccggtttcccctcctctggagaagtggcccaaggaacacctgtggcgcctcttcccgcagtctccgtaggtcacgattccctccagccacctgggcagtaagccagcccttgccaccagcacagggagcccaaaacctgtcgcctgggcgcggagctgggaccgccgaaagccgggagcactgggcgcccacgcgtgggctgacactcggtccccggcacggcgtgtggatgcgcgggacgaacatagcgggccacctacaggcccctggcggctgcgcgcacgcagatctgcgaaagctgccgggcgccggcagcctcgtccgggtgggcggtccacgccgcgtcccgccctccccgcgccgcggcccgcggctcgcagctcctccggcgccccccggagcccgcgcggaggcccgggcaacgccgcgcgccggcgagtctccagcctggagctttcgaccccccacttcctggtgccccgcgcgccttttattcgacgccgccggtgccccgcgcctcaaaggcgtactcacctctgctgcaggagcgattcggcggtcgcgcgcgagggtcccggcgacgcaggggctgcagtgagggcgcgcggagcgcgactccgagtggaagagggaagaaggcagaggttgccgggttcttaaggccgccgggcacggccggcgtggactgggcacggctccgggtggcctcggttcggcggggctcgggcgcacgtcttgcctcgactaaggagtggcgagctctgccagggcagcggcgccaccgagcaatccaaacacttagcgggattccccagccctggccggccccgcccccggacagccgcgcgggcgcccattggccggctgcgtgccgtcatttcggggaaatcaggctgttgtagagctagcggcgaaggggaagtacagggcggctgctccgccccaccctctccggccgggcgccaccgccccggggccaccgcgggcccgccccgagcgctcccaatccacccctgctccggcttgcccggaggagggctgcccgggacagcccagcgcccctggccccagcctgtcctctcactccgccttgtcccagccggctggctcctggggccatcttttcaccctcctggcggggcgggggcgggggtatatctcccgaacgcaggtgaggggatcgcccgggcacttgccgccctctccagtgggaacactgggccgaatctcccgactggcagcctggctcctcaagcttgccagtgggatatcaagaagggagggtttcagtcctagcactacccctgtttttaggggtgaccccctccctccaggtcactcacctgccctggggaagtgaagaaggcagaaagcctaccctgccccgtgtgctgtctggggctgctggaccaggggaaatcccaacttggccgctgctggcacagcccccaagggacgcaggacctctgtttttcaaccataaaataatagtagccctaccttgatggtttgctgtgatgggaagagattgtaaagcactatgctccactcgggcaacagacgctgagtagttttcaaggtcgccgttgcagggtctaatagtgaccaggatgacaccccaccccttttcggtctgcctccctgggactccccctggctggctttagggaacagaggaggagaaggggttcagagaagcccagacggctgagtgagggtaggggtgggctagctctgatccctcctagcactcttgcctcaggccgcctccagagcctccctgtggcccgcgtatgggagttccgcaatggaagcattgctgtcatctctgagtccccagggcttggcccagagaggttctgggcagcatggaggaattagctcagggctgatcaacgccatggggctagccaaagggttggggagcccaggtcccatgctccttggtaaggcccctacttaactctcgcgcacaactagtccccgccccacgtatagtcctagagacttgactgggtgttcattttccatccaaaactctggcccaggaggcttcttccttcatctccctaaagctcctgcagaagtaagttactctcccaggcgtgtcatttccttcaccccagctctccctccagggcagcaccccattttgcaggctataaatagacacacccatgcaacattcgacttgccagtcactctacctccctcccgtagaggaaatgcatgggttaatcccattctggcgcattgcaatctgagtgctgtgaccaatgccaaacctggttcccaggataccagcaggaatgggcaaaactgtctaccagatagaggtgggtcaggagctaggagaggaaaggaggtaggagaaactgaggaaggaacctaactgagtgttaagcaaagtggagggcaatgacactctggaatggaaaggtgggttttggggtactttaagtgacaaatggaagtggggacttgctacagggaccaagaccttctgagcaagaataagagaaaacaagtgacccctgagtcgtgggatcctttcttggtacagcaaatagatgcttgtccttcccctgagaacctgacacatccactggaaaattcaggatgagattagggaaaggaagtttgcatctttgtggtctgataagttgaccacagtgaccctgtgaaggcaacaggacactataaaaaatgctttaaaacaaaaacttaattttaattcacagatacaggtataaatatacccgtatatgcatatgtatatttagccataatgagcatctttccatgtcatgaaatgtacttatgcaatgtcatttgtaataggtatacattattctttcacaaggataaataaaaatttacccaattaatcccctattgtaggacagttaggttatttccattttttcgtaatacaaacaacactattagctaaatctttgtgcatatcaataattttttgcttaggagaaattccccagttaggatttaccaatgaaactgtcatttacatttacatctttgaccttttttttttttttaaccttagggattcttactttattttgaagcctgtaagaatatgcttattatgactaggggtgctatactccaaatcagtgaaataaagctaagccatgtttaagtacccaacatttttattgtaatggcttttgatgaatcacattctaagatgtagaacattctgtgatccccagcagaacacataggctcctgtaggctcttattaattcggagccagcccttttctttcccacctggtcttctgggtcttccttccctgtatcgggttgtgatttcatagtccaggaccagactattgttgccccaacctccccttgggcctccttgccttgcccaggtagatggggaagatggtgcctctgcactggaatgatctccctaactcggatgatctccctaacactcggggccacccaggagccttctgagctcccctacattcagccccacattcaaatctctgctcagtcttgtcctggggtcccattccaaccttctgtccctgacagcttccctacccttggcagtagggaagatgaaactaaagggggatgaaaagagaacacaggatttgagtctgaaagcctgggttcttattgtgctttttccacttgctatgtgatcttagcaagttactgtccctctctggggctcagttttctcatctgtaaaatagagataatctctctccatctctcctaattgtaaaattagactatcaaaattatttccaaactgtaagacataagtcaaatgaaatgtatgaacaggaacgcatgaacctttcactgtatttccattatctgaacacactgtgtttgtcccctcatccctgtctcctcaggatacttggcaacactcaccctctctccatctctctctcccttgcccaccccaccacttcaatctctgtgtctttttttaaggcccagagcatatgcctgatctcttcaaaatgcccgcaaagcaaccaaccagaagtcctttcttttccctccttggaccctttggtccttaactttcctatgtttccttttcaccactggtcactttctacatggtgggaacaaactctggggaacaaactctacattttttctgtgagaaaaagaactctccatgttttctgtgagaaatctaagcaggttcctcatgcccagcagctgaagcgagctaggggttagctgagggtagccagcaccctgcactgtgcaaggtcttccttacagatgcctctcatccatagcctcactcaatgagggtgaattcattgtgtggcctctctgtattgggacctggatttttctgtgctggcaagaggaggctaactggctggcaggggctcctttgaagtgacttctgcaatcaggatgctgaaggcaagatcatctcacacacacattcacacaccctgtgggagcctctaccctgacagacaattcttgtccccagtcccctccctcaggctctcaaaacactgttcaccccctaagtgggctgcagttagtcctgaagcccagaagcatggctcccaacatgtcaccatgcacacacacatcaatgcacagggccacacggaccacactaaggtgatgccgccatccttgcactcccccgaagagtggctaccatggtaggcactcagtaaatcctagttaagttgatgtgtgacccctcttcctctggagtttagtgttccttctatctcagattatgaattctctcagatacagacatttcttggcaacctgtggttaaatcctctgctgatagagatgagtgtgtgctcagaaatgagagtttgtgagagctgaggtgcaggtgccagtgaggtttaaactaggtgtttttttgttttgtttttttgagacggagtctcgctctgtcacccaggctggagtgcagtgacgtgatcttggctcactgcaacctctacctccaggggttcagcaattctcctgcctcagcctcccaagtagctgggattacaggcacccgccaccatgcccagctaatttttgtatttttggtggagatggagtttcaccacattggccaggctgttctccaactcctgacctcaggtgatccaccgcctcggcctcccaaagtgctgagattataggcatgagccacggcgcccgacctgaactaggttttcgactgggagacctgctacctgtggagcctgctacccagagagggggccacggtccccaaagcagacaaactccccagcatgccttccaggttccaggtccagaagtagtagggctctctgaaatgctcaaagccttcatctcgattttcacagaaacctgggaggcaggcagtcctaaactgtgaattgcagaacacaagccagaaataaaagcatccaaaagcttgaaggcagaatccaagggtcatcaccctgcctgcaaggagcctaactggagagaaagaaagtcccttaattcattcaacacatatgaatcacgcaggcctgctttttggtgaaccccaggtttggttctggagatacactggggcaccagaccagcccctcccctctcaaaggtttggcaaaatatgctgtatgacacagcagaataaacgttgcactgttataaaattcctaaatgcagaatgtggggctgaagctggctggaaaatcactagggggtcatgatagaatactgagccaaggaattgctccagtgctcagggctgttccggaaccccctgagagcggggcggggtgacagtgtgggctgccgctgatggccgctgcggagcttcatttcttataaacaccgccgttgggaggaaagagaactcagccccctgtcagtcccatggggccccgaggccgggggaggctcctgggccaggcccagcggccgcgacctggagcggggcttgatgggatcagcactctcctcccccgcgccaatgggtgctgcagaacggcccacgcccactgccgttcgcccggggcgcccctggcaggcttctcggtctttgtgggggctgcagcacctccacttcaccgtgatgtggagtccttcgcccccaggtgacccacgctccacagccccggccagaacttggtgggggacgcggggggggggtgtttgacggggagggggcacagtcctttcgggccaacttccacattcctgctccgcccaggcggggggtgagtcggggtgagcagccggctccaagctggccggcttcctggaaagggagggccagcaggagaactgcagatcctcccagccctggtggctgcccgcctcctccctacctattcctccccaccccacttccacccctacccccagcaagctggcagccccgcccctgccaggcggctcacctgcccgcgaccaaggcacttcctcctccttccccgcccagcctcttgctataggccatgggtttgcagccgggtcagcagctacaggctgtgtgacctcaggcaagttactaaacttctctgtgcccattatctcaccctgcgagatggagctagcaacaatcggggtgcagagctttccgcgaacacctctgcacttccctgctccccccccaccttccccttccgctcggtttcgcagggacataggggatgcacagaaaaggcgcccgcttgtaaattgccgcaggggaaggccgcgttgcgtcccttgccggggcactgccatccgttgcagcctgagacttgggatagacctgcggctctcccgttggaggcgcgggtggtgctgagcggctggacggatgctgcccgccggggttcggcgcgcaggcactcagatggctcccacctccgcctgggccttgcagctggcggtggggcggggcgcaggggccgggtaggggagggcttgggtccggccatccagtgggggtcagccccatcgccgggttccgcggggccgcgccgaaggggcggagcctgggtttcggtttcttgcaaacgcggcggcaacagggaaatcgaggagtttccgggaaccgaaccacgctgggagcgctgaggtctgcgcagcggcgggggccgggggacgggcgggcgtccagtgttaccggccagtggccagctggaagttccagcgggagccggggaaaaccggccccggaaaagccccacctgaatgcacctgcccaggcctctccggatggtgttcatgctgagggtgggggtgtgaaggatggacctgcctgcagggtggcctttagggaatgagggaggagttctacaagctaaggggtttgagggtgtgcacgcggggaaagaggggactgtgcgcaggcaggtgggatctgaggaattgggatatcccctcaaatgactgaggtccccagctgtcccctcactgtcacatcccatcttattgtccttatacgatgaggtctccttactgagatcatatccgtagtgtcctcttttgcttatttgttggaggatttccccgaacatgacttggagcccttgagagtgagccctgactgtctggtctagtctcctggatctagaacccaccaacctccacggggggcttgtgactgtttactaagtgagaaaaggagtagggtgagttcgaggcatctgtgaggtccatatgccttctgacctgctcccccacaggacccctagcccactcaggtcctgccatgtccccagttgaaggaagccccactctgcagaagatgccttggcttttgtgggaggggcttcccttgtagttccctgagaactgccttccagctgggatggctgggcagaaggcggactgtagtcatcacagaggaatgctggccgtggggtcagccacttccttccctccccagggcttggagctcaggccagggattatggtgggttggccctggatctgagacaagaaggctgggagtttgggtggcagagggagagtccagtaccctccctgatctctgcagcccacagcagtacctggggtcaaggtggacagtgtcactggcaagcccatgtttcctaaatgcatgcctttgagaccacaagtctatggtaaggatctctttccttatggccctgagaccatggctcttggaaagacataaatcagactaaatggagctccctcagcccagaagagctggggctggggcaggtatcagtggtggctattctggaagcagccagctagccagtggaaggagaggcagcaagacctccctagcatccctgtatgggccaacactgactttcaccagcccaggcttaggatcagggtggctggcctgggagagggccagggaaagtccaaatactgcaagagtggagcttgtgccatgagcgcctggcaaccctggtgactcaacctgggaatcccaactccaggggcagccctggaaatgaggctcaggacagtgaaggagtgccacggaggggcccaccaaccgtggcagcttttagtgaggccacagatcaaataggttgttgtcccttctttctcctgtggcccagggttagaaacagtgatgctggtcctctgcccggtccaaatagtatttttgatccagggaatccaactctaatcctagcccataaatttgacctggcagaggacctggtcctcagaatgtctgtgttgggctccatttgatgttacatcttagaaatggtagatgtagctcaagctaataaatacccacaggaatgtgtctttgtggtctggactcagcaaatgctgagttattggtatatttatggaaggaaagcagggcagagacaggagaacaggtgtccctgtgggtgctcggccctgttcactgttgtagcctcaggagccagcctcagctgagcagagagcaggtgccccatgaaccagtgtgacatggttggatggatggatggatggatggatggatggatggacgaacagacagatggatagataggaatatggatggtggattcagatggcctcagcagcatgcacattttccccacgatggtctttgcaataagacaatttccacagaaactggtgggtgccccagaaggaggggaggaagaatgtggcttctccaagcagcgctgtggttgtttctgccaggttctatctctccaaggggacctctgctccctttcccatagccctgttgacatgtgtggcccctcaaagtcctgcagagactgggagcctagtggcaagggccacccagacacagaacaggggaaaggagctgttaacattagctggctgttccattcctctcctggaaagtaggtccacaaagaaatttaggtaggacctcagccaggtgtgaaagattccagtttttttctctgcatgagtaagtccttgggaaagcatctgttgaccaattgactgattgactggcaagaggagcaaagggtcagcagagacccacctgcctggatggtgtgggagaaagcatgaccgccctccaccttgacaggtgacaaaccacagtgaatgtgtcaccacatcagatagccagcatgaattgctgcactgggagtgtttaaaggtctgggtgcataattgggagcaaaatggacaagggtatgctgggagctctaagccaggaggcctctggtggctagtcacctccaggaagcaaaagccgttatttcttccttgagaatccccgtgaatattggagagggcttctcacagccccatgggctggggcatgagtgtgttatgctttgcttttagtggaggaggtgactccagaaggctaaagatttagggacagctgatggtcctggaatgcttctcagccttgggcctacgctgggccctgtgaggggacttagaagtaagcaccgtggtctccactactaacctgcatgtgagctctccaaggacagaggatgctcagaaccacccccacacccccactctggcacccagcacattgctctcaggcagtaggcacttagtaagtgtgctctgattgcagtgccagacgtatgtcatacctcgagtaagaggcaaagaggcagagatgctgggagtatggagacggagcaggttatctcagtcattgttcacagatggctactctgaggaggggacagttcagcaaagcctcaaaggatgagtcaaaggttaataggctaatagtaggggagggcattccagaacgtgaaaacagcccaaggaaaggcttggcagctcagaagtgcagaacggatctcgcttttggtgtggcctggagtagctgccccagaagctgaggctggaccaaccagtaggggccacactctgaagagcctggatgctgtgctcaagagtggactctatcctggtagacagaggccgctcagggctggactgatgttgccttcctttctggagccaaggcccagaccagggtctatcatcaggtgtctgttgaattaaatgctagggcaggtcttgtgagggccactggtggcctgacctatgctttagaaaactttctgtggctgctacagaggattacgcctgtggcacaccagggcaagactagggtgagatagtttcctaaaggcacaacatttaaggaggtactcgctctcaggggccaaccctatacttgggtgagtctgacggtgagtagctccttaaaggtttcaccctaagcacctgccctgcctgcttgctccaccctatctggtcccttctgcacactggaggctgggaggtagactagaggcagctcaagtgatccaggcatattagggctgtggccacaggggatagagataggcctagttgagagcagaatcagatgacaggatttgccaggacatgagactggctggagcaggacccatcccccctccctgggtgccccattctgggagaagtgtaggagaccccccactctgcctaggagtctatatgtccacagccagggccaaaacaagatcttaggccttggcttctgtcctaggttatgagtctagggaaccaaggacactaagctaaagagagtagggcagcaggtgaaaaagccacaggctgccccaggaaggcccaggccactggagaccacagctagaacctacaaccatgtcccgagactgctcggccttgccctttggatgcttgggcacagcaggaaggaagtgataagggtgcctccactgctggatggggcgtgtctgtcagtccatcttccccccgctgtctgcccagcaagaccaggggccacccccaggtgctccccaggggattagcagcttggttccccagcccacacccctagaagctctgaccctatggcaacagcaccccctgctggctaatatggaaaaccaacccctttccctcctctagcaggcggaagtttaggggtcttggagaaagagaagggtgcaggcacaatgctgcgggaaagggtgggggcaggaattcaggatggactttggctatggcagataagcaggtgccacctggtaaacagagcacctatttcctgatcagtagcctttgaacagatgccagagaggccaggacacaagcaaaggcagaaatgggggtttctaaggtaactgctgagcgaggctggctctcgtgggagtccctgccttctcctacagcatcatggcccaggaaggcctgcatcctctgttgagcactgttctcctcaggtgggctcaggaactccctcagattccccctgagcaagccacctggccccacagaggatttggcctaggactgaaggctgagagctaggcctgagacagggtagtgccccaggcaccccaaaaagaggatttgtccctaaaattcctcccgcaactatccaaggctaggaatagaggcagggacacatcagcagaacaaaatctcagagcgtccctgagcagctgcctggctcttcagatgcaaacctggttagacacacacttctcctgagctctaggcccatggctcaggcacaaggaccacctcggagtgctggatgaggtgcccagtggacagaggagtgagaggacccagtgtatgccactttgacccttcagctgtgagccaggaagtccaggcagacacagccacaagcagggccatgccctgggcagccacttcccagaaaagtttctgccgcaaaacagagagagtggccttccctgccctgcatgaccctggcacctggagtcctcacctcagataagaagccagtagttctaggagtttacttacatcatggctcttgattacagtgaagaccggggccttgccctaccccagggaaacttctctcccgggccaatggtgtggatggctgctgttctcttatgactcagtgtgggcctggtgctcaggagagctgctccttcccatgccctggatgtgagctcagcagccatcttgattcaccaggacaatgtgagctccacacaccaccctcagaccctcacctaccgggctctcagggagagatgaggcctcccggagagtccacaaagagaaaaaagcggcttggctgccaaaactgcccacgcaccccagatgccatgctcagctagcagccctggtgccacacagcctgagagcaggtgggagccatagatgcaacaagctgtcatcaggcatgggagggctgggctgccatgctgaggctggtggggtgggaaaatcaacttgcagccaccaggaagtacaggagcagagtaaacaacagttgaggtcaaaagggtccaatttccttggacaagcaggcctcaagaaggcctctgagctgcactgccaactgtattgtattcttgtgtgtgttctgtgtgaacctaacacccccggcggccaagggaagccccttggccctcccttgggtggcagccaacactaggaccagagaagtggcagttgtgtcataaagttcccaagacacttctggaggaatcaatcttcttttttagtcttctctgctcattttttcttgtcattttcctgtatgtgtatcttttccctctctcttctagcccagaaatgcttattgaccactggtggcctattgggagtggattacttgacacattcacatttactctgtgcccagatgctaggcacagaagtaggtgctatgggcacaggcattcgacaagaatttattgagcccatactatgtgccagacatggctctagaccctaaggatatagaaatgaataaggcaacacccctgctcttatgaaactcatataccggtggaggcagacaacacacaaataaacaaggaaagtgtcacatcgtgataattattctgagaaataaaatagcatgatatcatacagagtacagaggtggtcacattagatttggcactctaggactgtctatctgaggaggtgacattttagttctctaagtgacagaaggggtgacaatgtgcagaacaaggggaagcgcattccaggcagagggaatagctagtgccaaggccttgggaaaagaacaagctcagtctgtttgcaggaaaagattggtgtggctgcagcatggtgggcaaggaggtgaatgatagacgatgaatgatagaacatgcagctcataaggtaggaaggggtcagataaggtgggcatttggggcctctgatcaggggcttgggccttatgcacagggtgaaatgggccagtgtgcattttacttatttttaaacttttaagttttctgtttttcatttttttagatggaaaaatgttgtccaggctggtctcgaactcttgagctcaagcatttatcctgcctcagcctcctgagtagttgggattacaggtgctcatcactgtgcctggctcagtgtgcattttagaaagctcactggctgctgtttgcagactgggctgcagtggggcaagtgtggaaataaggagaccactggggagactggagtaggagggatgaactagagtggtggtggtggcaatgatgagaatggggaatgaacccaggcagagtatagaggggaggacacacagagatgaataaaatgtggtggctccgaatgggagaaaatatttgcaaaacatatatctagtaaagggtatgtatctagcatatgtaaagaatgcttacaactcaataaggcaatgcatttttgtttgtttgtttgtttgtttgttttttgagacagagtctcactctgtagcccaaactggagtgcagtggcacgatctcagctcactgcaaccttcgcctcaggggctcaagcgattcttgcgcctcagcctcctgagtagctgagactacatgcgtgtcaccacgctcagctaattttttgtcttttaagcagagatgggttttcaccatgttgcccaggatggtctcaaactcctgaactcaggtgatctacccacctcagcctcccaaagtgctgggattacaggcatgagccactgcacccatcttgacaaccaaattttttaatggacagaagatttgaacgaatttttcgccaaaaaaggatacgcaaatagtaaatacacatatgtaaagatgctcaacatcattagtcattagggacatgcaagttaaaaccacgatgaaatgccactacacatctacctggatggctaaaatgaaaaagactaactgtgccaagtgttggcaatgacgtggaacaactgggatgctcctaaactgctggtgggaatgtaaaatattcattttttcttgactttttaatagagatagggtctcagtatgttccccaggctggtcttgaactcctgagctcaagtaatcctcccactttggcctccaaagatgctgggataacaggcgtgagccaccatgcccagctgggaaggtaaaataatacaactacagtcacgtgctgcataatgatttttggtcaaggacagactgcatatacgacaatgatctcatgagattacaatactgtatctttactgtgccttttctgtgtttagatatgcttagatacacaaatatttacccttgtgtggcagtcgcctacagtgctcagcagagttacttgctgtacaggcttgtaccctaggagcaataggctataccacatagcctaggtgtttggtaggttataccatctaggtttgtgtaagtacactctatgatattcacacaaggacaaaattacctaatgaagcacttctcagactgtatccttgttactaagcaatacatgattacattggaaagcaatttggcagttttttaaatagctaaatatatgcctatcatacagcctagccattcaattccaggtatttatccacaataaaggaaagtgtgtgctcacacaaagatttggatatgaatgcttacagcagcttaatttgtaatagccaaaacctggaaacaacaaaaatgaccatccacaagacagtggataaatagcttatggtatctacgcagtggattaccaccaggttccaggtttaggtaagataaagtaaacatactccaccctgtctcttccactaagtgaagcaatagaacctgtacagaatgtatgaaggactctgaagagtaaatagcagcagatgaattaggaaagaaaaatcagaatttggagtaccacggaattggaggagtttcccatttttccctctagtactccctgggctagactcgaaacagcctgaaacctggaagtgagcagcaggcacagacagtgggaatcccagagccctctagttctgctttgaggagtggggagggaactcctaatgctcagaaagagtgagaaaataaccacccccacgccacctttttttcttttctccattctctcatgcctcagacctctggcattcttgttgcaatggcatgagaggactaaaggcacctaaaattctaagggagagaaaactgtctgttggacaagccccaagagggtctccctccttccccccttctctctctctctctctctctctctctctctctcaatatctctctccttttgccagttgaccctagctgagggcacagtcgcaggaagtacacagcagagcaaggtagctaaaactccagatttctggccagaggaccaaaaggaggagacccagggaatcagaaagtaccagggagatcatggaaagggaggaatgctggaaactgaacccacaaagttgtttatgaattcctgggctcaactccaaactgagcttgcatggatctagcataccaaagacttgagaactgaacctaaggataaacaccacccttttctcaagctgaccactggagggtgcacacacaggacagatctaaacagcactataaaggctttgaaaatggaacaaacattgaaactacaatccacagaaggctggtcggaacttgtggcccaaatgcagctgcattgattgcctgctaaaatataaacattaacactctccacaatgttcaaataatacccagagtctcataaaatttaaaatgtccaggatacaaaaccaaagtatgatcttcctggcctatgataggaaaaatctcattttgcatgggaaaagacaatcaaaagagaccaatgatgagatgttggaattaagtaacaaagactttaaagtactactatgaaaatgctccaagtaaaccctcttggaatgaatggaagatggacagtctcagcaaagaaataggagatataaagaatagggaagtaaaagttttggaacttaaaaatataagggccaggcatagtagttcatgctataatcccaacactttgagaggccaaggcaggaggataacttgagcccaagagttcgaagctagcctgggccacaaagtgagaccccgtctctaaaaaaaataataagttaggtgtgttggcatgaacctgtggtcctagctacttggaaggctgagatgggaggatagctcaaacctgggagttcgaggctgcagtgagtcgtgatcacaccactgcactacagcctgagtgacaaagcaagaccccgtctcaataaataaataaataaataaataaataaataaaatataagaaccaaaatttcagtgctcactaggtaactcaagagcagaatataaatgagaggaaagaggaagccagtaactggaagacagaccaacagaaattatccaaacagaaaaacagtgagaaaaagatttttaaaaagtgaatagaacctcagagactagtgagacaataccaaaggtctaatatttatgtcattagagttccagaaggaaagaagaaagagtgcagtgaagataaaaatgtttgaggaaatattgactaaaaacatcttcaatttggaaaaggacataaaactgaagaatatatgtacatatatatatatatatatacacacatacatacatataagcatacatgtaccattgctagagaaaaatgacacatcacacataggagaacaattcaaatgacttcagcttcctcatgaggagagaggaaatctcatcgtagagaccagtaggaagtggaatcacatctttaaaatgaagaaaaagaaccatcaacccaccattctcttcacaatttcaagaatactcaatgaaaatatgcttcaggagtgagagtgaaataaagacgttttcagatgaaggaaaactaagagagttctttgacaacagacccgtcctaaaataattgctacaagaagtttttcagacagatgagaaatgataccagaagttaacttggaatatcaggaatgaaaaaaagaccaacagaaatggtaaagatctgaggtaatgcaacattctgtgctgctcttgagttctttaaaatacgttttatggttaaaacaaaaattataacattttttgatggtgttttcaatgttatatgtagatagcacataagacaactacaacataaagagggtagaataaaagaaactaaagttttacattacacttaaaatggtaaaatattgattctaagtagaccatgaaaaggtaaagacgtatattgtaatccctggagcaaccactaaaaacaaaaacaaaaacaaacagaactatacaagcagataaagttaaaaacacaataaatgtccttaaaatggtagacacaaatccaaccatatcagtaattccattaaatgtaaatgatctaagaatggtatcagcaaaaatggaatagagaactccaaaactcctttttccataaaaaacagtgaaaaaaactggcaaaatcaactttattagaactctggagactaataaaaagtttaataaataaaataaattcttttttttaataaaataaattcttttttttttttttgagggagagtctcattctgttgctccggctggagtgcagtggtgtgatcttggctcactgcaacccccacctcctgggttcaagcgattctcctgcctcagcctcctgagtagctgggattacaggtgccctccaccatgcccagctaatttttgtattttcagtggaggcagggtttcaccatgttggccaggctggtcttgaactcttgacttcaaatgatccacccacctcagcctcccaaagtgttgggtttacaggcatgagccacaatgcccagccaataaattttaatcaagaagaaaaacggctaaatctcagtgggaaaacactgtggtgttttaacatacctgggctccattctcctctttcccagcttggtggcagccttgaagacaacagcctgcattcttgatataggttcttagtgttcgagggagcagaatggaacttactctcaaaggattgtggttgcctgttttgacctgtctgttggttccctgaaggatgagcacaaaagatttactttaatttcacctaacttagaactctcccagggctgaagcagctacctggggcatttggaaaaacaaacaaaccacacacacatgcacagagttaaaaacaaatgcattcactaatggtaacagttagggaaataatagacaaaccaaaagcttaagaaaaaaggctggagaaggaaacactttaagaaataagggctttaaaaagctttctggatatctaagaaggtcacacatatgctcagaaaatatcctagaagactctacactctcacctctgactgacctccagactctgcaagcagaaaaggaaggttaaggcagagttgtaaacagcctggctaagtgttaaaagccacacctcaaaacacatacagagctcatctgaagatattgggaattttttttttatgttgttctaggtataaaggaaatttcagtcatcactagccaaccactagtggaaaagtttaatggaaaagtcttttcagtggccacacgtgacaaagaatacagactttaaaaaattagttcagaaaggtcactaagtaaacaacaacaacaacaacaacaacaaacaaaaacaactagcaaacaatgacaacaaacctgaaaggggagcagaatgtgatttccagagttgtcacattataacagtaaaaatgtccagttttcaacaaaaaaaattacatgccatgaaaagacagaaaaaagtatggttcatacgcagcaaaaataattaatagaaactgtccttgaggaagctcaggaattgaacttaatagattaagattttaaatcaagtatttttaaatgtactgaaagagctaaaagaaaccatatgcaaagaactaaaggaaagcatgaaaacagtgtctcgcctaatagcagatttcagtaaaagaatagaaattataaaaaaggacttagaaattttgagttaagaagtaaaataagtgaaatgaacaatgcactagaaggggtcaacagctatgtgagtaggcaaagaatgaatcagtgaatttgaagacaggtcaattgagattacccagtctgagggacagaaaaaagaatgaagaaaaacaaatagagcgtaagtggcctgtggaataccactgatggtaccaacatatgcataccagaagacccagggggagaggaaagaaagaaaggggatgaaagaatatttgaagaaataatggctcaaaacttctcaaatttggtaaaagtaaaggatatgaatttacacatgcaagaagctcaacaaaccccaagtaggataaactcagatattcatattgtgatacattataatccaatggtcaagataaatacaaagagagaatcctgaaagcagtcagagagaagtgatgagtcatatacaaggatacttaatgtgattaatggctaatttcccatcagaaaccacagaggccaaaaggcaatatgatgacatattcaaagagctgaaagaaaaactgtcaaccaagaattccatatgtggcaaaactattcttcaaacatgaaggagaagttaagacattcccagataaacaaaaactaacagagttctttgctagtatgcctgttgtacaaaagttgctaaagggagtccttcaggctgaaatgaaagaacacttgtgatgattaattttatgtgtcaacttgactgagccacagggtgcctggatgtttggtcaaacattattctggatgtttccgtgaggatgtttacaggtgaaaataacatttaaattggtacactgagtaaaggagattaccctccctaatatgggtgggcctcattcaatcagttaaaggcctaaatagaacaaaatgactgacccttccccaagtaaaagagagtttctcctgcctgcctatctttgaactgggacattggctttttcttgccttcagactcaaactgaaacattggttctttctttgtctggagcctgctggccttcagactagaactaagtcattaactctcctgggtctccagcttgccaagtcaccgtggagattttggtacttgtcagtctctgtaatcatgagaattaattctttataatctcctctctctctctctacacacatacacacaaacatgtgtatatgtatatacatatataatatatatatatatatacagcttgctggttctgtttctctggagaaccctgactaatacaactaatacaacattatgcagtaacttaaatccacatgaaaaataaagaacaccagttatgataactatgtaggtaaatataaacattaatattaatgatatattttttgttttaaactctttattttctatatgatttaaaatacaatcataaaacaatgatcctaaaactatgttgatgggcataggttgcataaagatggtttggtgtttttgtttttgttttttgtttcttgggtttttgtttttgttttttttgtagacagagtctcactctgtcacccaggctggagtgtagtggcaccatcttgactcactgcaacctccacctcccaggttcaagcaattcttgtgcctcagcctcctgagtagctgggattacaggcacataccaccacgcccagctaattttttgtatttttagtagacatggggtttcatcatgttggccaggctggtcttgaactcctggcctcaagtgatctgcctgcctcagcctcctaaagtgctgggattaaaggcatgagctaccaccccggccacattacataaagatgtaatctgtgacattaacaacaaaagttagagatgaaattatacagcagtaacttttttgtataccattgaaactaagttgttattaatttaaattagagtgttgtaaattaagatgttaattgtaatccccaggacaaatgctaagaatataatatgtagtaaaataaatgagaaaggaatcaaaagagtatactacaaaaatctatcttacacaaaagaagacaataatggaggaactgaggaacataaaggataaaagacataatagaggacaaatagcaaaatgacagaattaagttctctcttatcagtaattatattaaatgtaaatgaattaagctcttcaatgaaaaggcagagattggcagaatggattttaaaaagaaccatgatccaactatatgctgtctataagagacttattttagattcaaagacacaaataatttccaagtgtaaagatggaaagcataccatgcaaacagtaaccaaaaatgagctgaagtggctatgctaatatcagacaaaatggacattgacacaaaaatgtttcaaaaaacaaagaagtacattaatatgataaaatgctcaatgtattaagaagatattgcaattataaacaaataggcacttaacaacagagaccaagaacctatgacaaaagattgacagaattgaatgaaaagttaaaaaatagtcggaggcaaggtgcagtggctcatgcctataatcccagcacaatgggaggctgaggcaggcagatcacttgaagtcaggagttcgagacctgctgggccaacatggcaaaaccccgtctctactaaaaatacaaaaattagccaggcatggtgaagcacacctgtaattccagctactcaggaagctgaggcacgagaatcacttgaacccaggaggcagaggttgcagtgagccaaggtcatgtcattgcactccagcctacatgatggaatgagattctatctcaaaaaaaaaaaaaaagttggagacttaatactcatgttcaatcgtagctagaacaactagacaaaaggtaaacaaagaaatagaagacttgaacaacaataaaagccaccaaacctaacagacatctacagaacatttcattcaatgacagcagaatacatattattcttctctgcacatggaaatattctatagaagagacattgtgttaggccacaaaacaagtctcaataaattagacaagattgaaatcaaacagggccaggtgtggtgcctcacacctggaatcccagcactttgggaggccgagacaggcagatcacccgaggtcaggagttcgagaccagcctgaccaacatggtgaaaccccacctctactaaaaatacaaaattagctgggcgtagtggtgcatgcctgtaatcccagctactcgaggggctgaggcaggagaattgcttgaactcaggaggtggaggttgcagtgagccgagatcacaccattgcacttcagcctgggcaacaagagcgaaactccatctcaaaaaaaaaaaagaaaaaaaagaaatcaaataaaatatcttctcctacgaaaaaggaatgaaattagaaagcaacaacaaaaagaaatctggcaaatacacaaatatgtggaaattaaacaatgtacttttcaagaacccatagggcaaagaagaaatcaaaagggaaattacaaaatattttaagatgaatgaaaatgaaaatacaatgtacccaaattgatagaatacagtaaaagcagtgttcagaggaaaatttacacctttacagttacattttaaaaaaagaaagatctcaaattaataacctaaccttccattttaaggtgctagaaaaagaagagcaaactaaacctaaagcaagaagaagagaggaaataataaaagttagcgcagagataaacaaaatagagaatagaacaacaatagaaaagttaaaaactgacaagcctatagtttgactgaccaaaagagaaagagagagaagactcaaattactaaaataaaaaatgaaagtggggacattactacagaccttaccaacaaaagattataagagaatactatgagcaatgtatgccaaaaaattagataacttagataacattgacaaattcctagaaacacataaactaccaaaactgactcaagagaaaatagaaaactacagaccaatatactttatgaacatagatgaaaaagtccttaataaaatactagcaaaccaaatacagcaacgtattaaaaggattatattccatgacaaagtgggatttctcccaggaacgtaacagttattaaacatacaaaaattaatctgtggggggaggagccaagatggccgaataggaacagctccagtctacagctcccagcgtgagcgacgcagaagacgggtgatttctgcatttccatctgaggtaccgggttcatctcactagggagtgccagacagtgggcgcaggccagtgtgtgcatgcaccgtgcgcgagccgaagcagggcgaggcattgcctcacctgggaagcacaaggggtcagggagttccctttccgagtcaaagaaaggggtgacgaacgcacctggaaaatcgggtcactcccacccgaatattgcgcttttcagaccggcttaaaaaacggtgcaccacgagactatatcccacacctggctgagagggtcctacgcccacggaatctcgctgattgctggcacagcagtctgagattaaactgcaaggcggcaacgaggctgggggaggggcgcccaccattgcccaggcttgcttaggtaaacaaagcagccgggaagctcgaactgggtggagcccaccacagctcaaggaggcctgcctgcctctgtaggctccacctctaggggcagggcacagacaaacaaaaagacagcagtaacctctgcagacttaagtgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaccagaaaggacatctacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgattttgacgagctgagagaagaaggcttcagatgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccaatgcgatcaactggaagaaagggtatcagcgatggaagatgaaatgaatgaaatgaagcgagaagggaagtttagagaaaaaataataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaaggaaagcccatcagactaacagcggatctcttggcagaaactctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaacgagcaaaagcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatttatgcaccgaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcaacaccacaccacacctattccaaaattgaccacatagttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctataagagaaagcaggaaagatccaaaattgacaccctaacatcacaattaaaagaactagaaaagcaagagcaaacacattcaaaagctagcagaaggcaagaaataactaaaatcagagcagaactgaaggaaagagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccaatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggatctgaaattgtggcaataatcaatagtttaccaaccaaaaagagtccaggaccagatggattcacagctgaattctaccagaggtacaaggaggagctggtaccattccttctgaaactattccaatcaatagaaaaagaaggaatcctccctaactcattttatgaggccagcatcattctgataccaaagccgggcagagacacaaccaaaaaagagaattttagaccaatatccttgatgaatattgatgcaaaaatcctcaataaaatactggcaaatcgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctt

SEQ ID NO: 1277 - DNA, 20741 bp, Homo sapiens
ctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctgtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacatagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctgtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtctttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaa

SEQ ID NO: 1278 - DNA, 112182 bp, Homo sapiens
acctgtaatcccagcttcttgggaggctgaggcaggagaatcgctttaatctgggaggtggaggttgtagtgagctgagattgcaccattgcactccagcctgcacaagagcgagactctgtctcagaaaaaaaaaaaaaaaaaagttagctagctgaagagtataggaaagaatgggtacaggaaattacaggtgccaagttacagaggtgagagaaattatggtatctataggtaattgaaagtaattcagtatagtgaacattgaatagggctgggcggatgaaggcaaagcagaaaaaggaaagcagatgggccatggtaaggagtttatatctcctcccaagagcaatcgaagtgactgagagttttaaacacagcagtgaagtgaattacattaaaaaaataagaacttgggctctagaataaaaaacggatataggaggaaggcaggagtcacagtaggaatatcttttgggaggctgtgacaataatccaagtgagaagtaatggcaacttgagtcggttaattgtgttgagaatggagagaagttgacaggttcaaaattcatttttcttctttttttgagtctcactctgtcacccaggctggagtgcagtgatgcgatcttggcttaccgcagcttccacctcctgggttcaagtgattatcctgcctcagcctcctgagtaactgggattacaggtgcctgccaccacgcccagctaatttttgtgtgtttagtggagatgtggtttcgccatgttggccaggctggtctcgaactcctggtctcaagtcttccgcccacctcagcctcccaaagtgctagaattataggcatgagctaccacacctgacctcaaaatacatttaatagagcaagcatgagccactatgcccagcctcaaaatacatttaataaaccaatggaatttgaggtaatgatgaaagacacatgtcaaggatcattcctgtgttgttggcataagcaacagggatgaaaagcattgaggaagagcaagattttgggatgcgttgtcacacagttgattttaggtatgttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagtgcagtggcgcgatctctgctcactgcaagctccgcctcccaggttcacactattctcctgcctcagcctccggagtagctgggactacgggtgcccgccaccatgcccggctaatttttttttttttttgtatttttagtagagacggggtttcaccatgttagccaggttggtctcgatctcctgacctcgtgatccacccgcctcggcctcccaaagtgctgggattacaggtgtgagccaccgcgcccggcccaagagtaaccttttcaaaagcagctttgctctactgatttgggtaaaagcttagttgcagttggtttgggaggaaatgggagcagaaaatttgagagagtgagtgtagacaactctttcaaggaatttcgctataaatgggagtagagatctgaagactgaataattagcaaactgaaaagtgggaagacgtaattctcttattatttcatttttcttagtgaaataagaggtgaagttctctgagtaataggagggtcaaacaggtgttagaagttcacaaagaaaggaagaggtttgaaatagtcattttgagagtgggaaatgtagaagaattaacagtcattgctgagggtgcgtttgaaatctgtcatgagtttaaaataacttgtgtcatcatcgatgtgtttattttcaactatattcaactgcttgggtgtaggcatcaggtaggtaaaaaaagtgggttttattatgagtagaggttttgccacgtaattaccatggagggagggaagagcaaaggagttgagagtatagatacaaaggaatgattactgtaatgtgggtaagagaggaatggaaggctcagtgggcagtgggagtagggatgttgataggtaaggaaaaggtgataggatcaatgcatttggttctgcaagtgtcaaagtattgttggggaaagcatgctggaaggaaagatagggatgctggtgttctcagggtggaaggcttacagttgtagtctggaagtggtgattttattggcaattataaggtcaacggtatgactatggaattgagtggctaaggtctgttgaagaaaagattgtcggaaatgcaggggtcaaggaactggcctgtggatgttgaactcactggcagtgatcaaggaatagtagtggagtgaaagtagttaatgaatcaggcactaagatctccaagggatgaaaggatgcagtttggagatgacaagataactgtagtaatcaggaatagcaggttttgtagctctgtctcataggcctcagaggagatgggcttttgaaggacaagagaaatgatgatgaataaattctaagcaggggaagtgtttgggaaagcagggcaggctttgtgctgttgatggcaaatgatgtaccagacaggatgaagttgagaatttggaagttgatcactgattagaaaggcttacattttattttggccgggggtggcagctcatgcctgtaatcccagcactttgggaggccaaggtgggcggatcccttaggccagaagttggagaccagcctggccaccattgcgaaacactgtctctactagaaatacaaaaaaaaaaaaaattagctggtcgtggtggcacatgcctgtagtcccagctactccgggggctagggaatgagaatagcttgaagccgggaggtggaggttgcagtgagccgagattgcgccactgcattccagcctgggtgacagagtgagactctgtctcaaaaaaaaaaaaaaggaagggcttacattttattttggtgctgactgggaatgaaggcaatgagggatgactgttggagaaggctgtgcttactaaacagtattattaagtagcagcatacatggtgttatactgacttctgattttgcaatagtacagacaggttcagattctcatttccaccttctccttctgcctaggtgaataactgctgggttatagtacagatgactgcagatcatttggaatttactttaaatgtaaacagtaaaaatttgaaagagagggaaagtgattgaggcaatttggggattgaataagaaggtctttttgttggaattcatttaaggaaagaaaatgaaaatttgatccctaatattatttaatgaagtggctaaatgaatatctctgctttgtggtttgaaaattaatattgattttttttccccctagaggaagaaatcctacttagcgacatgaacaaacagttgacttcaatctctgaggaagtgatggatctggctaagcatcttcctcatgctttcagtaaattggaaaacccacggaggttaaatattaccttttttttttttaacttaaatcaattctgtttatttttttatcacattttcctatatgtgaagaatactattcattaaggctgactcatagaaatttgcttgaatacacacacacagactgatgcataaatttgagaaatatctttccagttgttgaatagtgaatccaaaggtttaagccttttctgtctgctttgtaggatgttttatgaaacaaaggaatagaaattgtattcatattatacattttgaaattatatctatattatattttttgtcaaagcaaaataaattatacattaaggaaaatatttaagattcaaagttgtcattttctttctgttaatgagtatctttgatttaataacatttatagtttggtcacttgaaatctatagtgaccaaaagcaatgtcatatttagtagcctcatttctgttactatctgattattacttaagaattctacttaattaatagattattagaacaaaaggcattccaattttagagattcttttatggttaaagcactaggtaacttaaaaaatttggatcaaatgttatacagattaatagaccttggaatacaggggctatgtctttttggaatcagaccttgtcctggccttaattgcaggatgacttccttattaaatctctaaaagcaggaatgctctggaacaatgaacaattagaatgtggtaatgtaattttgggccaaaaaatactttgtagaaatgtgattctcttacttggaatagaaagaattctgactcgaaaaagtgcagttaatgtatgcttttctgggtaagatttgtgatagattttgattgagatttaaaaccatgatatataaatttagcttttttgtcaaagtaatttgccaccctagaatttgtgttggtaatttttaatgcaacttggacaatttctgaaagatgtaactttcttttttttgagacgagtctcgctttgttgcccaggctggagtgcagtgacatgatctcaggtcactgcaagctccgcctcccgggttcacaccattatcctgcctcagcctcccgagtagctgggactaccggcgcccgccaccccacctggctaattttttttttatttttagtagagacggggtttcaccgtgttagccaggatcgtctcgatctccggacctcgtgatctgcccgcctcagcctcccaaagtgctgggattacaggcgttagccaccgcgcccagcctgaaagatgaactttaaaatggggaaggatactagtaaagccatttcttactcatgtatacatttttccctccatgaaattagagcagccaccttttacatgacttttacatgcatttcagatttttgtactagcaattaaaatatctactggatgtaaatcacatgtgcttaatgctttgcttcataatatctgttgaagtcaattaaaatatagagacagatctttaaattgaacatgttttatttgggaagcaagaattaaatttgaggcatatacacagactgggtgtccttggtatctctgaagaacaaagagaagtttggaggttatagaaaaaggaaaatgtgacattgtttttccagaaagttctttggcactagtaaattttggggagttggaagctctgatgggttagtgactgtggtgggtaaaactagtcttagagtcacaacaggttgtttcagtatctattagataaaacaggttttaggttacaataggcagtttcagcagctaggcttgcagaaaattacattcttagagtaatgttatgtgccttgagtgcttttttccccttggcccttgactctgatttagttgggtatgacaagaattatcaatttatataattactttttacatattgaagctgaataggttttcttaaaacttggaaatgggaaatactgggtcttgtgaagttttagtgtgaaaacgataactagtctcttatttcatgctctttgtaacaagtctacagtaatacctaatgtatctagatgacacctcagaaccaggagggaacaaaaaagacctctgagcagtcaaaataatgctataagcatgtattccagcttactttcggcatttctgtggagtgcaggaggccacattttgttcatagatccagtttgacaagcttgggtactgagttaaagtgaaaatggtgtaaataagtaatcatattcacatgacagtaggtggaagtgacagctgacaatctgaaagagtggacaaaactataaaaattagaactaagaactcttaaaatagaacggtttgaagtttgttacagaagggagcagctttatgcttcagtggactctgaaggtattggcagtgtatagtactgcttagtcattgatttaaattcggtatatatctcttctattgctgtcatgtacttgacattctgctgggtgctaaggctgtctgcaggctactaatatgcataataacaatcctgaaaaagaaggaaaagtatactgtgccttactgaagaaggcaggacagccgttggtatttgttagagtaaatattagttatcttacataaagcatgttatattccctgatgtcagggcctgataaatgagcccttacactcttgatagtcaatctgtgccactgttgctgtgtttgtatgttacaccatttcctgtccatgtaacagttaaactgtatcacatatctgttcctactaaactatttgcatataattttaacatttgagtggctgtatataaagctaaaagttctttataagatttatagcatcttagaatgtttaaattagataacattagtgtgcttttagtttttgaatttaattttgctcttgattttgtttgtgttaatgtagactttgtctacgtaagcttgagcccaactttggagtggtgttttcagtgatggaagtaactggaaataactcatgaaaccacttagtacttttgatagtttattcccatgaaggatcaaatttttacttgagtcattaatataaaaatttaaaagacatgtcagattttattaagcatggattttaaatatataaatattagaagacctaaacaaaatcgctaatgaaagagtaaaacatgtccctgcctatcatactcccttcactttcactgatttctgcttttatgaagtactttaataagctctacaacaaataaacaagacattgtgcctcattttacactctagcagtggttttccattccaactaactagattgggtttataatatagtcatttaaacttacttagttaaaatgttatacattagcaactgcaattaaggagctaagaaattcagctcgtatttatttatatgcatcttatccatagtttctcacttgttatatttgcctactgatggcaaattgattttttctgttccaaaaatgtagtgttttgagatttttggagatgcaaaacagcatcattttcaaattagatcacaaacaatcttacttgttgcagttgagactagtaattgatcagtgaggtgaaaaaattaggcaaaacggtatcatcaaaattttctttctttttttttttgaaacagagtattgctcttgtcgcccaggctggagtgcaatggcacgatctcagctcagctcactggggcccctacctacgggattcaagggattctcctgcctcagcctcctgagtagctgagattacaggcgcatgccaccaagcccagctaatttttgtatttttagtagagacagggttttgccatgttggccaggctggtctggaacttcagacctcaagtgattcacctgcctcagcctcccaaagtgctgggattacaggcatgaaccaccgtgcccgccccaaattttcttttaacttaaagtgttaatgtttgtttgttcccaatatttttatatatgtcaaggctttttcattatatacaggccagctctttggagttctgcatagtgtttcttgtttaaaccacacctataatgtaccatctacaatttccaattctttaagacagagtgaaaaattaagacacctgaagcaatctgagtgcggagtcctaggcattatgattttccttgacacttttagggttcttttatcacagtttatcaaacacctttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaacaaatgtgcctgtctttcaataaaactttatctacaaatacagatagtgggccacatttggcttgcgagctgtagtttgctgttcctgacttagtatgatatgcagcattgtgtagtggaaagattttatagtatcaacagacatttgtaggagtttgctattttataatttcgtatgcttttttcataatagatgtctctgctttttgtggattctcttcatatctactagtgtttactcttctgactttgatttttgggggtgtattttatttctttatacagaatttttttcttttttctttctttttttgagacaaggttttgctgtgtcaccccagctggagtgcagtggtgggatcttggccccctgcggtcttcaactcctgggcttaagcgatcctgtcacctcagcctccctagtagctgggaccacaggcctgcaccactacactcagctaatttttgtattttttgtagagatggggtttcgctctgttgcccagactggtctccaactcctggactcaagtgatccacctgccttggcctcccaaagtgttggaattataggtgtgagtcactgtgcctggcccagaatttctttacttgctcatgtgagagagtttctaataaactcctgatgcttttgcttgacactatagttttactgtcatctcagagtcagattttttccttaatttcttcattaaattgatttcttaatttctcatttgttttgcattagtttacaaaattacttaagatgcctatattctctgaaattttatattttatttcacgataaataagtttaaaaaattagatttgaccatttaattagagttatttccccatcatttttctaatggcaacaataattttagcatttgagcaattctctgtattttggtaactattagtaatcacttttatcagtataaacatgcatttcattttaaaatggttttcaaaatattctcataccaaccattcataaaagatgttccccttctgggaaatatcagtttttgctaacatctgcatttccctttgattttctaggaatttcttattaggtatacactttaagtgatatgtttcatataatattataggattatcaggatttcatgattttttttttttgagatggaatctatctctgtcgcccaagctggagtgccgtggcgcagtcttggctcactacaacctctgcctccccggttcaagtgattctcctacctcagcctcccgagtcactgggattacaggtgcccgccaccacacccggctaatttttgtatttttagtagagaaagtgctgggattacaggtgtgagccactgcacctggccttggatttcgtgatttgactgacatcttttacaccaattattgccatttttttattgggtactaattattagtattgctttctttattcgttaaataagaagtaaaagaacttttaaaaaataaaataactttttttcctagtacaaagcttattttcaattttttttattgcttaaattttgcaggttaattaaggctgtacttctttttcctacttcctgtttaaatatttggcattttttgagggttttctttctatggatttttgtgggggatcccatctcgttggacacttggttcctggagattgccaaattattgaaaagtttcctcatacccaaacattggcaatagactgaataaataacatctctgacattatttttcaattatatagagaatgctttttgtaaaatactgatttatttaaagatattacaatcatagtagttttttgcaatcttttttaaatcagtggatgtcaaggaacaactattgttctttgtacggcatttttcaacattgtgaagagttcttatactcaaaaagtttgggagacacagtgtgacattgtttaacctgagttgaacttgtcattttgtattcttgtttagagcagggattttattttgtctctttatctaactttgtattcctaactatttctttctttctctttggttctttgtttctttgttcattcttctctctctcccttttttatctatcatataaatatgtaaatatatattatatatccattagggaagaggaagttgtctaaagatatctagtatataggagctttgttctgcagaaaagaggatatgaagtcaattatattggaaattaatgcttaatactttttttaaagcatttatctcccaatgataatgaaaacgatacgtcctatgtaattgagagtgatgaagatttagaaatggagatgcttaaggtatgtttacaattataaaaatattacttcaagttctttccaaaggacatttaattaagtaaaatattaactaattctaaactaggttctaccacaatgaaattgctactaattatgtaacattagatttcacattttccaattcatgtttctttcatgtagtctataaataatgggttagaggtaatttactaattttaaatgtgctttccttgttccttcttattttttattttgaagacagggtctcactctatcacccaggctggagtgcagttgctccatctcggctcactgcaaccttcacctcctgggctcaagtgatcctcctgcataagcctcccgagtagctgggattatgggcgtgcaccaccatgcccggctaatttttatagttttagtagagacagggtctcaccatgttgtccttgctggtctcgaactctttacctcaagtaatccacccgccttggcctcccaaagtgctgggattacaggtgtgagccaccacacctggccttggatttcatgatttgactgacatcttttacacaaattattgccatttttttattgggtaccaattattagtattgttttctttattcgttaaataagaagtaaaataacttttttttaaaaaaagaacttttttcctagtaaaaagcttattttcaatttttttattgcttaaattttgcaggttaattaaggctgtgcttccttttcctactttctgtttaaatgtttggcattttttgagggttttctttctatggatttttgtgggggatcccatcttgttggacacttggttcctggagattgccaaattattgaaaagtttcctcatacccaaacattggcagtagactgaataaataacatctctgacactatttttcaattatatagagaatgctatttgtaaaatactgatttatttaaagatattacagtcagtagttttttgcaatctttttaaaatcagtggatgtcaaaaacagctattgttctttgtacagcatttttcaacattgtgaagagttcttatactcaaaaagtttgggagacacagtttgatattgtttaacctgagttgaacttgtcattttgtattcttgtttagagcagggattttattttgtctctttatctaactttgtattcctatttctttctttctctttggttctttgtttctttgttcattcttctctctctcccttttttatctatcatataaatatgtaaatatatattatatatccattagggaagaggaagctgtctaaagatatctagtatataggagctttgttctgcagaaaagaggatatgaagtcaattatattggaaattaatgcttaatacttttttttaaagcatttatctcccaatgataatgaaaacgatacgtcctatgtaattgagagtgatgaagatttagaaatggagatgcttaaggtatgtttacaattataaaaacattacttcaagttctttccaaaggacatttaattaagtaaaatattaactaattctaaaccaggttccaccacaatgaaattgctactaattatgtaacattagatttcacattttccaattcatgtttcttttatgtagtctatgaataatgggttagaggtaatatactaattttaattgtgctttctttgttccttcttttttttttttttattttgagacagggtctcactctgtcacccaggctggggtgtagtggtgccatcttggctcactgcaaccttcacctccagggctgaagtgattctcctgcatgagcctcctgagtagctgggattacaggcgtgtgccaccatacccggcttatttttgtattttttgtagagatggggtttcaccatgttgcccaggatggtcttaaactcctgggctcaagtgatctactggcctcagcctcccagcgtgctggggattgcaggtgtgagccgccgcatccagccctgtgttccttcttgtgttactttcttgtaattttttcctggaatatgggtagtgatttggctctccagtattgaaattgagtttcctttcttccaattcatgtgtatccatttttatttggaagttttgtttttatacattcaataatcatctttactttctttggtattatttactatggatattttatattatataattttcaaatggattaaatggttcagttttactcttattattgagattgaaaatactagtttataatttatatattttctattcctttacctctaatttctttgtcaggtgttactaaccaaagatgtataataagaaaagccaatgtagctaaattaagtaaaaaatgaagaaaaacacagaagttccccattatgcatttttttattcctaatctttaggttgatgagatttttttatttttatgaaatgagattaatttattgacttttttagttttgaggccaagtaatgagtagtgagtaagaatgtatattctagggccaggcatggtggctcactcatgtaatctcagcactttgggaggccgaggcaggaggatcacttcattccaggagtttgagaccaacctgggcaacatggcaaaaccctctctctccagaaaaatacaagaattggctgggtgtggtggcatgtgcctttagtcccagctacttgggaggctgaggtgggaggatcacctggggagcctggggaggttgaggctgcagttagccatgaccatgccactgcactctagcctgggtgacagagtgagaccctgtctcaattaaaaaattaaaaaaaaaaaagtagattgtgaattcagatgtaggtttgtatcccagcttttccagttagtatctgtgtgactttggggaagtttcttagcatctttgatactcggttaacagttgtaattattatttaaggtattgcttgagaagagcttagtatagagcctgacatttagtaagtgtttaatacatattagctaacagtaaaactagaacataaatactgaattgtattttgttattaattatccatttctctgagaagtactgttccaatagtacatttataggaaacttgtggacgtctacaaacgtatacattaaatctcttagaaggcaacctggatgcccatattagagaactctattttaaacatgcattctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgttatagatgaaacaattttgaaatattcttgaaatagataatctttatttaggggagaatgtcagatactgtcaagccaaaataaaaacaaataactttatttcatgtttgtaaaattccttttctaaaatgatttgaatcttttgttgttttgacaattccaaaacacatttattgtttgctcatagtttcagccttattcagaaagaatgcgactgacacatgatatagagaaacttgttccaaaaataacattaaaatccacgtttactacttgagaatcgaaaatattgaggtgcaataaagaataaaatgttttaaattatccaaatttaaaatttatgatagctttccccaggggcagtttattatatgctattaatgagccttgtttatgctggaaatgttccatctttggccttgcgccttagaaaccattcatgagcacatatttaaaccggagcacacatgttcttttgtagtatggcttgcacatctgccagctttcgacaaaattgtaggccctgttaataatagtccttttgtgtttggtgaaaaagatacgacactgtcagtggttttgcttttaagatttcttttaaactttcagtctttagaaaacctcaatagtggcacggtagaaccaactcattctaaatgcttaaaaatggaaagaaatctgggtcttcctactaaagaagaagaagaagatgatgaaaatgaagctaatgaaggggaagaagatgatgataagggtaagcactgaagtatgtttgaaatgactcacctgtgatacctaccactgactttaacttaggatccagttttggatggtttggaggtcagggactttgtggcatatagttaattattggatccttataagcttttgtctccttagtgcttttgtctccataaagcacaatcttactacttagaaaaatagagtaatagcattatgatgataaaaatatctttccctttgtttttttgtatttctccaaatcattatagctctcatttagaattattaaagctgagaactctaacaatgaacttttattgtttagtggttaattatcttgattctttgttttgccctttcttggccactcaggaatctttcaagctcactgtggacagggaaagtgacttgggtagagctaacataacttcattgtgctgtgcagttagaattttgaccaaagatgtgggtaactaacttttcctaactaaatgacatttaggtaactaaactaaacgagattttcgtaactaaattttggtgtaactacatttagctttaggtaactaaaacgaagattttattttatctgtggatttttttagtgcgggactaatgtaatttctgattaccattaattgaaggttggttatattataacatttggattggtatattgcttgccatggtttgttctaaatgttagcctttagaagtattcctgattctaaaacatcagttttttttaatagtcctggcaaagtgtgaatcacaacaaaattctaatacttaaaagtaatccaagtgtcacagatggtacccagaagaccagtttgtattggaattaaaaaatagaaaacattaacccatggtagctgtcactgtattctttcaaagaagccaatgaaataaactgttttctccctctatgtggtgtttttctacttgaacataaatgcacattttattttatttccagactttttgtggccagcacccaatgaagagcaagttacttgcctcaagatgtactttggccattccagttttaaaccgtgagtataatctcatttaatcaaatcacatatttagtattctctttaaaacaagggaaaaggcaaataacctgtctgcttaacagcaacagcacaacttcactatagttatacatgccacactgtattttctgtgtgactacaaaattatttcaaagtgatatttatataaaattcatttctgcaaattgtttttataagtgaggaaaaatggttttcctttaactgagcagttctgagtagaaactagtttaaagatacttataaataaatgttaatttaatactgacttgtttttcattaaacgagtgtctatgtgcctgttttgtgtatattacccagaacatgcagatgtactagaagttcttaatacaacaatttgaggaatagtgataatcttatctattttaatgtactcaaaatttgtttacatctaacaggcacatttttgtgaggattaaatgagatgaataagaatgagatgaacaagtaaatgtgaataaaactaataagcctgtgaaaatctagactggatttttcctattctgagaatttaaaatataatccactgaagtatttctttccttttttcttttgatcttaaacattttttatttatgtcttacatacagaaaagtgcacatgttgtagagatcaatgaattgtcataaactgggcaccctgtggccagcacttagttaagaataggtcagtaacagcatgccagaagaccacctctccaattgatttttcccatgatattttattaagaaaattttctaagatgtagtaaagttgaaagaacttttttctgtgcatgtctgtattcccaccacctaaattcaactatcattactatacttgctttatcacatatccatccattcatatgtctctatccatccattcattcattccagttttaaaatgcatctcagggtcaatcgaggacaccattacacttccacctaagtatttcagcatgtaaattattaacgagttaaatatttacttaacagttttttctttggtgtaaaatttgcacgtaaggaaatataaaactttaagtgtacatttgcaaattttaaatatacatgtgcatacccatgtaacccaaattcttatcaagagatattattatcatcaccacacagagttcccttatttcccttttcagtcagtccttgtccctgagcatttctcttattattttaaagtattgattcttttggatatctagtatgaagcttagaatctgttttttactttagatgtatgtagtgaaatttaatatatataccaaatggtagttgttagttagcttgaatgggacattggtcaaatggcattgtttgttttaaagttccaggtttgtgcatttatgtatgaagtttgaaaataaattctatgagaggaaatgaaaaattgaatggattttaatttgtaccttgggtttcttattaataaaacaaaatagctttttgcttttcaccttcaagagttcagtggaaagtgattcattcagtattagaagaaagaagagataatgttgctgtcatggcaactggtaagttgtacttaagcaaaacctaatcctttaaaaaaataaaacataaagagtttgaaatgcttaatctttcattaaactctcaaaatacaaatgcaactacaaatgatgtaaactatagaagagagtgaacaaagaacagatgctcagatttatgtatcaattagcttttaggaagatagcatactagtattgaccattcatctgtataagtacattgtaaaaagaaatgaaagcatcaaaggtttatttttatttctatatttttttcattttatttttatatttttttcatttcaaggatatggaaagagtttgtgcttccagtatccacctgtttatgtaggcaagattggccttgttatctctccccttatttctctgatggaagaccaagtgctacagcttaagtaagtcatgttatcattgccacaatatcaccctctttttttcttctgtgggtgaaacatctgatccatcatgcatgttaaaatctagttcacaataacacatttctgcaggtattgctttatctttattggtaataaatgaccctttagtggaagagcttaccttctttcttgtgttctctgtaattcaaagctaccaggtggccctgataaaatttttttaaaaaacattattactttatgctggtttacattgaatatctcaaaattcttttctctttttgttacccttgctttttagcttgataagaagtgtatacatggaagtatattttttatctatgaaacacttttcagcttcttcaacctgagcttgcaatctgttttaaattgatacataatatctttacatattcatggggtactgtagtattttgatacactcatatcaaatacacttgatcaaatcagggcatttgttcatcaacttgaacatttatcatttctttgtgctgggaacatttctaatcttttctttgagttattttgaaatacacagtgttgttgttaactatagttaccctactgttggttaatgagtacaaacatacagttagaaggaataggttctagcaacctattcctttaccccctgtcatcccctgctgccctgagcttgcagtctctttcaaagacccaccttaaaaacttgcattctgataaggcccttgaaggaatttgcttatcaagttagtaagtgacaaaaaagaaaattgcaaagaacaggaatataaattattatatttctttattctttctcacttaagagtgaaattgatatgtgtaatgtgtacatggtgccagaatatttgtttttcttcttatagaatgtccaacatcccagcttgcttccttggatcagcacagtcagaaaatgttctaacagatattaaattgtgagtaatttttttccctcaacttttattttggatttatgggggtgcatatgcaagtttgttacgtgggtgaattacatgttgctgaggaagttgtgagtaatttatgtcatttctaatcatgtggtcagatgtctgtggtatatgagagaattttgtatacaaacaaattttactaaatgcatgaaaaaaaaagtccatgattttaaaatgcactttcttttgtacctttgcaggactgttactttttaaatccttcaaacttgaagaaatctgttattctcggttcttgggctataagattagcattgtactcatagaattataaaaattttggttttggaagagaagttggagaatataaagatttgtctcattttatagatgagaaaactgaggctcagagacaagtaatttgcccaaaatcacacaatgactggctgagcagggactggattctaggtctcttgcccaaccaattctatcatgatgtaattcctaaggagaatgtcatctcagatacacatacacacacccattttgtgtgtgtgtgtgtgtgtgtatatgtacacacacacacaaacatatgtacacttatatatacatacacacacatatattaatatatatgcatatatatgcatgttctaattcagaacattttcatcactcccaaaagaacacccctgcccattaagcagttgctttctttacgtatatattagtatatacatacacacgagatacacatatatttactgagttttgataaatgcatacaaagatgtaaaccaaacctctaacaagatacagaatatcactgacactctagaaagtttcttcatgtccctccccagtctgtccttccatcctccatcctaggcaagccactgctccgattttctctaccatagtttggtagaatgccatataaatgcagtcacacaatattaactcttttgtgtaagacttctttcatttgctgtaatgtttctgagattctttcatgctgttgcatgtatcagtagttttttgttttgttttgttttgtttttgttttttcagagtcagggtctccttctgtcacccaggctagagtacagtggcgcaatcatagcttactgcagcctctaactactgggctcaagctatcctcctgcctctcaagtaggctaggctgcaggtatgttccaccatgcctggctaattattaaattttttgtagagacaggatcttgcttggttgcccaggctggtcttgaactcctggcgtcaggattgtttccagttttggattattacaaataaagctgagacacatataagtctttgtatggacatatggtttcattttattgatacatgtcaaggagtgggatgactggatcgtgtggtggatatatgtttaactttcttttttctgagataaaattagaaggcgatcctcctgccttggctttccaaagtgccgggattacaggcgtgaaccaccgcacctgatgcagttgttgttgttgttgttgttttaatatctgattattattttattgtatttcattgaatatagcacagtttgtttttacattttcttattgatagacacctaggctatttttctggttttggactgttactaataaagctgctatacacatccttataaaaatcttttttgtgaacatgttttctttttttctaagcattttaaatcacctttattgaggtgtaattgacttacaataaattttatatgctgagaatgtataatttgataagttttgacacaggtatgcactcatgaaaccatcatcacaatccagataatgaacatattcatcacccacaaagtttacctttttgttttaaccccagtcaccgggtaactgctgagctccttcctgttactgtagactagtttgcattttctaaacttatatacatggagtcattcatattttatgtgctcttttttgtctgatttaaataatgcagtataattattttgagattcattcatgttattacagtgattaatagttcattcctcttattgttaagtggattacattttatggatatccaacaagttgtttatccattcacctgatagacatttggatcgtttccagttttgggttattacaaataaaactgctatgaacattcgtatgtaagtctttgtatggacatatgttttcattttattatatatgacggagcggaatgactggaacatgtgatgcatatatgtttaactttcttttttctaattgagataaaattcacagaacataacttttaccattttaatcattactaaagtccagtgggttttggtatagtaataatatataaccatcataattaattccagaacattttcctaactcccaaaagaaattccatacccattaaggagtcattccctattttcccttttcttttctttctttttttttttttttgagtcagggtctccctctgtctcccgggctggagtgcacttgcatgatcttggttcactgcatccttgatttcctgggctcaattgatcctcccacctcagtctcctgagtagctgggactgtaggcatatgttaccatacctggctaatttgttttattttgagtggagatgagattttgctatgttgcccaggttgctctcaaactcctgggctcaagtaattgtcccacctcagccttccaaaatgctgggattacaggcgtgagccactctgcccggcctattatctctgttctgcccacttccaaccactaatctactttctgtctctatgatttgcctattctggatgtttctataaattaacttatacattatatggccttttgtgtctggcatcttccacttagcatagtgatatcagtacttcattcggtctttttttatgactgaataatattccatagtatgggcatacacattttaaaaattcattcatcagtgatggacatttgggttgtttcctttttggctgttatgaataatgatgctgtgaacatttgtgtaccaatttttttatgaacatacattttcaacgcttttgcatatatgcctaagagtggaattgctgggctatatgctaattttttaagaaactatgaagcttttgagagtgattgtatcatgggatattcccaccagcagtgtatgagaggtccagttcctccccatccttgctatcacttagtctggctgatctttaacttaagccattctaatagtatctcattgtatttttagtttgcttttccctaatgactaattatattgagcatttttcatacacttattggccatctgtatatcttctttgagggagtatctgttcaaatcttttgcctattttttcttagtgagttttgatagtcatttctatattctgaatataaattatttatttgatatatgctttgcaaacattttctcctagtttatggcttttcatactttccacacagttcttttgaagagcagcagtttttcattttgataaagtccagtttgtcgattcgttcttttagggattttgcttttagtgttttgacccaaggtcacaaagatttgcttttatgttttctcctaaaagttttatagttttaagttttacatttagatttacgattcatttttagtaaatgttgtctattgtatgaggtattgattacagtttatgtatttttcacatattgttccagctccattttttaaaaagactatgcttttacactgaattgactttgtacctttgtcaaaaataaattgactacatatatgtgggtctattgctgcactctctattctgtgttctgtggatctatttgtctgtcttgattggtgtcttgattactgtagctttataataaacctggaaatcaggtagcgcaaggcctcttgctttgctcttttctttcaaagttgttctggctattctatgtcctttgtatttctgtgagcatgtcagcatcaccttttcaacccatatgcctgctgggattttgaatgagtttaccttgaatctagatatcgaaacaattagctgtcttgatagttattgtcaccgttttataccgaagaaactaggcatactaaagtaacttggctaacatcacttaccttgtaagaagtagaactgggctgtttgacatcagagcttattctttataccatttcctatgttaattagaatacaatattaatttcataaaggtaaaggcatatctgttttgttcctatttgattccttgtgaaagcacaatgcctagcgcacaatagacacttaaacttatctgttgaatggacaggtgaatgcttttaaagtctttccatatagaaaattaagtttcattacatttgacttgatctaggttttcatttcatagaatggagagcagactctgtaaatattttgccccagacctagctttattacaaacattgtcttaattaggattctgtctacccagaatagaaattaactcaagctagcatgagtgtatattgaaatttatattaaggataaaggaatgtctcatagatcccactcaaaagaaattagccagcccttaggaagagactggaattgggtttggaaaatacaataggtctttctttttatctgtagtctttagtgagtcttcctcatttttctctctgaagagataagcattctctgcatatatatagcattcttttagattttcgtgacataaagtattatttaaactttcataaggtatcttgattttaagttgtaattccttgagatgattgttttctttattgttaatatgtttcccttcctgtttttttttttttcttttttcttttgtttgtttttacagaggtaaataccggattgtatacgtaactccagaatactgttcaggtaacatgggcctgctccagcaacttgaggctgatattggtaagtgataaagaaagatctctgtaaatacttactgagttaatatttaaagttaaacctatggatggacactggatttcacttctgttaaagtttatttcaaacattacttcctccaggaaatctctgactctctaacttgctgtttcacctatcttatcccatgatactctataattccttttgctatagaaattaggctctgttatcataattacctgtttatatatctgttttcttctgctaggctataaacttttcaagggaaaaatatcactttttaaaatttatgtttccccagtgcagtgcttggcatataggcacttaaacatattgttgaatgaatgttgaatcctaggttctgtgaaattttaatttacttgtttttcatgttctgtatctaaattaagtcagtgtagtggttttgtaccctctttgttcataagaatcacttttcaaactttaaaaaaaatgtaggtaaccaacacccaactctgaaaattctgatttaacaggcctgggttggcacctggcattggtggtttctcacaggtgattctgatatatagcccgggttggaaaccacagtacctttgattagttgccactagtgagtatgatttattacaaaaaccaaaaacttagataagtcacagtttatttcctagaacgtgtaaatatagaattagtcaaaagctgatagcactttttttgtacttaaaaatattttaagcctcagtatagtgagacctcatctctacaaataattttttaaaaaattggccgagcctggtggtgcatgcccatagtccaagctacttgggaggctgaggtaggaggattgtttgagcctgggagatgaaggctgcggtgagccaagatcatgctactgcactccatcctgggcaacagagcgagaccatgcctcaaaaaaaatttttttttcttcttggtggttaggcttaactatccaagaattgcaatcatggcttctattgcaaatgcccctatttcccaccttcagttggcctaaccaaatttaatttttcaatatcatatgatctttttgtataattatgtattcaaataattccagataggttaggttttcgaattgcaacgtctcatttaatggttactttcatataactgtaggaaagcatttgataatttttccaacaatgtaatgaaaacaaacttgtatcttttttattatgtgttaaaaccaacaaaagaatgagggcagcaattaacatttcattaaatatattagcaatgagtacatttatgagctcttaaactcccttattgacatactgtattttttgcctttaatggacaatgaatttgatatgtttcctaataggttgtatgaagttattgtgaatatttcactttggattaagaataactaccctatatataaatttcatggttgtattgcaaaagctggggtctatgtccatagtggtttgggtacgtttttactatttgctttgtttctgtgatagtgttaaatgaataataagcttaagtatttaagcaaatacttaatacttctgacaagtagttagaactctctatttttgtttttttgtaatggatgagttatggacactgcaattattagagcagcgtactttgcttatgatggatgaaaatgttctctggttgactcagtgttgaataaaaagggatacatgaaataaaaattatttttgaaatattttcctttgccttttgttgcgggaaattgtacaatgcttgcaaaaatgaatatacgcaggatattatttgtacagcagtctgacatttagctaatcagattcctcatttttaggtaaatgttaaattacttaagtagtctggatttttaacagaaacagcaaacatagttttatagggaggctccttaccaaccagacttttaacttaagtgaatgttggcaaaagcttgtctaaactgatttccagggataaggtttagctccattaaaagctagtttgtcaaacctgtaactaaagctttttaaaaaatgaaagttttaaaagagaccatcattctgttttaacctatttaatttaaaatctgggctgaagtaggagtattgcttgaacccaggagttcgagaccagcctgggcaacacagtgagaccccatctctgaaaaaaaaaaatgagctgagcatggtacctgttacagtgctagttatgaaagaaagaaagagagagagagagaaggaaggaagggagaaaggaaggaaggggctgggagtggtggctcacacctgtaatcccagcactttgggaggccgaggcgggtggatcatgaggtcaggagatcgagaccatcctggcgaacatggtgaaaccctgtctctactaaaaatacaaaaagaaaaaattagccgggcatggtggtgggtgcctgtagtcccagctactggggagggtaaggcaggagaatggcatgaacccgggaggcagagcttgcagtgagccgagattgcgccactgcactttagcctaagaaaaggaaggaaggaaggaaggaaggaaggaaggaaaaatcagtcactcactcaggtttagtttcaaaagccaaaacagtgataatattgaattttttccagccactcagtagtacccagagaattttgatacaaataactgactttgaccccatgtttagtaggttttttttttgtttgtttgtttgttttttttttttgtctttcttctccacactctcttaggactgttgtagcttgtaatgttagtgaattgtaattgtttatttgcatgtctgtctcctcttttagaattgtgaactcctcaggtcatggattgtattttattagtctttttattcctagaaaagtgtttggataataatagatatttattaaccataataggagtagtagcatttttgtgtgtgtgtgccaggccctattttagcattttatgtgaatgatataatttaatttttagagcatctagaaaatgttaggtaccattattatccacattttacttgtgagaggactgagacttggaaagcttaagtaacttgcttaaggtaatacacatggcagatggtggagccaggttctgcatctgggcagtctgactttagagctttttaatcatcctcctcctagtgtccgaacattattaatgctcagagaagtatcaaagaatgatgatactcattgagggaaaaaattattcttaagtatcaatttgttaattgaggacaaaagcactactgttactactgtgaaaaatctgaaaacattgtcacggatgattttacaataacatccttttctgacatgcattacaacacactattgattccgtttcaatgtttgtgtctggtatgggggcggagtagagaggctactacaggaagaaagaacaaataacatttcttcttactactttgtgcatcatgtgatttagctcctcccataccattttacattagaaaatgtggctgtcctcctgtgctctagtactggcatttcagaggactctttgcaatatgatatgtgatcaatcatggatggcgatgcagttaatttcagtagaaatttgctgactctttttatctcttttaatagctaatgcatgagataaaattgaaggtattaccaaggagaaatgcaggtggatagttttggaggcaaagtcacagtaagcaattcatctctccaaggaatagtgatgaaagctgagatccaataaatgtcttgtttggattaatacataaatatttccttttaaaattcttaaggcttttattcatatatctcccctctccctatttccaataatgatttttggtgttaatatgatgatatttatgcttctgtttttataggaaccaaatactttgatttggttatttattctcctttggagatgtagatgagtttattttttcctttcgagctttatcttttcctttatgtgtttttctttttttacaggtatcacgctcattgctgtggatgaggctcactgtatttctgagtgggggcatgattttagggattcattcaggaagttgggctccctaaagacagcactgccaatggtaagctttgccaagtctgatgtcccgaaattacattcttaataaggagagcattcaggattggggagtggtaaagaagctgaagacttcactataaaagagcaaatggataatgtaaaaagagaactatttttttaaaaatgctaaagttggtatataatctattgaggaatataatagaacaaggcttgacaaaccttttctgaaaggaccagataataaatatttcaagctttataggccacatgtagtctgtatcacatattcctctctctgttttttcttttagtaaccctttaaaaatataaagagttacatttttcactggtgggccataacaaaacaggctgtgggccatatttgtccgaatgtcttctcagtgatctttcatccgtatgtccttttactctaggatgctgtgaaatcctggttaccccttcttgtatcacattgaaaacctaaagtttgaactattctatagaaattttattaaagcttttggtattagaatttccctttcttccctaattataaaaaatagcaaattttggccgggcatggtggctcacgcctgtagtcccagcactttgggaggccgaggtgggtggatcacctgaggtcaggagttcgagaccagcctggtcaacatggtgaaaccctgtctctactaaaaatacaacaattagctgggcgtggtggcaggtgcctgtaatcccagctacttgggaggctgaggcaggggaattgcttgaactcgggaggtggaggttgcagtgagccgagattgtgccattccactccagcctgggcaacaagagcgaaactctgtctcaaaaaaaaaaaaaaaaaaaaaaaaagtgaatttttacatgaatattctacatgattggcatatttacatgaatggtttaaaaacccacaataatagcactgttttattttttattttgaaaattgtagattcacaagaagttgtaaaaaaaaaaatacctatatagaggtcctatgtacctttcatccagtttcctgaacagtaacatcttgtgtgactatagtacaatatcaaaactaggaatatgacatttgtacagtatctagagtttattcctatttctctagttttgtaagtactcttttgtatggcatgtgtattgttctatacagtttaatctcatgtacatttgtgtaactaccactgcagtcaggatgccaaatgttcccttaccacaaagctccctggagctgttcttcccacccctggccctagccactggcaaccacaaatctggtctctatctctaaaatattatttcaagaatgttatatacatggaatcatgcaatttgtcaccttttggaattagtttttttcactcaacataactaccttgagatctatccaagttgtttgtggtcatgtgttgcctaacaacagggatatgttctgagaaatgtgttcttaggacattttgtggttgtctgaacatggacttacacaaacctacatgataaagcttactgcacacctaggctatatgatagagcctattgctcctaggctgtaaacctgtacagatgttactgtaatgaatattgcaggcaattgtaatacaatggtaagtatttgtgtatctaaacttatctaatgtagaaaagacacagtaaaaatacagtataaaagataaaagatggtatacctgtatagggtgcttcctgtgaatggagcttgtaggactggaagttgctctgagtgagtgagggagtggcgagtgaatgtaaaggcctaggacattactgtacactactgtagactttatacatattgtacacttaggcgacactaaatttttaaaattttctttaaaaattttctttcttcaataataaattaatctcagtttactgtaactttaattcataaacctaaaacattttttgactttggactcttgtaataattcttagattaaaacatgaacacattgtacagctgtacaaaaattttttcttccttgattaatgcattccataaggctttattttaaaattttattatttttatttttaaaacttttttgttaaaaactaaaatacacacatatcagactagacctacacagggtcaggatcatcaatgttgctgtcttccacctccacgtcttatcccactggaagttctttaggggcagtaacactcatggagctgtcatctgtgataacaatgccttctcctagatacctcctgaaggacctgcctgaggctgtttttcagttaactttaaaaaatgaatacgtaggaggagtatactctaaaataatggaaaagggtataggtaaatacgtaaaccagtaacatacttgtttattattcatcaagttatatactgtatataattgtatgtgctatactttttaatgcctggtagtgcagtaggtttattgacagcagcatcaccacaaacgtgagcagtgccttgtgctaagacattatgctggctatgacatcacttggtgataggaatttttcagctccattataatcttatgggaccactgttccacatgtgctctgtcattgacagaaatgccgttaagtaccacatgactatttttcggtggtctgttcctttttattattacagagtattccacagtatggttgtaccacagtttaactgatcacctgttgaagaacttttgggttgttttccagtttttgactattatgaataaagatgctatgaacatttgttcatatctcaaaggttctttatttttttttatttatttttctttttttgagacagtctggttctgtcaccctggctggaatgcagtggcgcgatctcggctcgctgcaagctccgcctcctgggttcacgccattctcctgcctcagcctcccgagtagctgagactacaggcgcccgccactgtgcccggctaattttttgtatttttagtagaggcagcgtttcaccgtgttagccaggatggtctcgatctcctgacctcgtgatccacctgcctcggcctcccaaagtgctgggattacaggcgtgagccactgcgcccggccttcagagattctttaatgggtgaatggttaaacaacctgaaaatataaaagttttcatttctctgggataaatgtccaggagtgtatttttagtttttaaggaattgtcacaaacctgttttccaaagtggctgtagcattctacattcctgtcagcagtgtgtgaatgatctagttatccttgccaccgtttgttgttgcaactgttttttattttagccatttcgataggtgtcgagtggtatctcacttttaatttgcatttctctcatggctaatgatggtgaacgtcttttcatatactaatttgcctctggtgaaatttcttacataattggagtgcttgtttttttctgttgagttttaagagtttaaaaaatacattgtagatatgagtccttggtcagatacgtggtttcaaatatttctttcactttgtagcttgccttttcattctttttaccgtgtctttcacagagtaaatatttaacattttagtgaaatccagtttatcattttttcttttatggattgtgctcttcacctagccctagatcctgaagattttctcctgtggttctttcctaaaattgttacagttttatgttttaagtctgtgatccattttgagttaaattttgtataaggtgtgaggtttaagtcaaggttcattgttttcccaatagattaaattgcagcagatcctttgttgaataggctgtccttcccctgttaaattgcgtttgcccctttgttgaaagtcatgtgggtgtatttgtgtgggtctatttctgggttctctagcctgttatattaattttgaacgaataaagttggcttatgtttaagttttcttggtagtagcgaggcaatggtgccttctgagcccaggatttcacaattttgtgagtaaactgtgttagaaattgtttgttattcttttggtaggttgtctagttcaatttcattgctcattaatcttgcttatagatagcaaattgagaggcatctcaaaaatagtatcttttgttagcttatctcacagagtttggttggagcagatattaaaacaacaaaccaaaaataaattaaatatactagttagcaagtttatattgagggaaaatcaaaccatgtgaattgagctccaatgatgtggctggccttgggtcagattttagtatcatggttcaacaaggtagctattaaaatcttcatactttttcttgaaataattctttagtagtcacataggacagcacacactcatggatttcttctttccttactgtctctttattctcagcctcctgttccttctcatctccctgaccttttaatgttggccttccagaaactttagtctttggacctacctttgcactcattttcttggtcatttcacccaacatacagttttatgttattttattttttttatttttgagatggagtttcactcttgttgcccaggctggagtgcaatggcgtgaactcaccttactgcaacctctgcctcccgggttcaagtgattcttctgctcagcctccccagtagttaggattataggtacgtgccaccatgcctagctaattttgtatttttagtagagatggggtttcaccatattggccaggctggtctcgaactcctgacctcaggtgatccacctgccttggcttgccaaagtgctgagattacagatgtgagccaccacgtccagcctacagttttaaatatcaagtctatactgaggactcccaaatttttatctccatcatagactgatatcagcagtatatgagtgattcagttgtttttgcctctttgccagcatttggtgttgtcactattagttcattttagccatttaatagaatatatgtacatatatatgtgtgtatacacaggcacacatctatataactactcaacatgcctctggtgagatgaccaacaggtatctcaaacttaacctcttcctaattgacttctgcatagcactccagatctgctctttcctcactctcctccatcttgtttaacagcagctccattggccaaaattttggaattttcctcaatcttttctctttttcttacactccactgtttatttaaacagtaaggaaatctcgtgaggtcttcagaatatatgcagaattaaatcacttctctcttgatccctgccattccccaggtacgggccaccatctccttagggcctcctgctttcactcttcccatccctcattctgtttcaacacagcgtccagagtgatactttaaaaatgaagtctgatagatcatgtcttcggctcagaaccatctagtagcatgccatttcattctaaataaaggcaaaagtccttatgatgagttaccgatcctcatgtaatctggccttccattttccctctgatctcattctctactggtctcctcattcaccggatgcagccacaccaccctccttgtttttcttcggacattccaggcatgcttcagtgcctgggctttgcgcctgctgcttcctctccctgaatacgtttcccccacattgtctataggatgttctcccatacttctctcagatctcttggatttaggcctcctgggccaccatatttgaaatatcagattagttccccctcccccatcattcagcattcctcgtaaatctttgctgttttaaaaatagcactatcactgtctaacttactgtgttatattttgttaattttctgtgagttcttcttcactagaatattctttgtagggaggagtttttgattgtttggtttataaaatctggaacaatacctggcttataggaggtgctcaatttataatggggtgaatgaatgaatgaatgatgatgagaaagctgagaatcagtaaagtgactttccaaaacaggtagtgggcagtatagagttgggccataaatagctgcaccatacaacatcctgctagtttctaaagcaaatgatttgaaagaggcataaaacataatttctgccctcaggtagctcatagttcagtaaaggagtttagattcatacctataacagtagaagtaatagcaccaaatgaaatatggtattatgaagtggtacaaataatataaaaagatgaacagtgttagtagtacatgtttagaagggatttctgtggtgaaagtcactaggcacagtgcacctggaggaccgatttccattaatttagaatggtttaaagtaagcttttggaaactaggaagattactttctgtaatcctttcctaggcctttgattctagaaggattgtgttaaaggagttttaaatattttatacagttcttaaacattgttaagcttgaattaaatcttttattatgtctggccatggacgtcattggatcattttcatttcttgggaggattaataaagcacattccttctgttgggcctccagtgcggggagggtgttggccgagcagtggctgagaaaacgtttttcccctggtgttttcaagaaccctctttattagctaagtggtgagacatgccacctggtggttatagtagtatcatttttctcactgttcttggtgcttttcttctcgttctgattccagttatactaggacaactgctataaacctggaatgtttcacactatattatttcagtaatttcaaaaacagcagaaatcactaagctgtttggcacaaagattcctatttggaaggaatcagacaaagtgagtgttgagaaagaacagccaggcagaaagctttgcatcagtcttaaagttctttacatttcaagtaagaggaattgtgaaatccataagacatgtggggtttttctattactttctccccagtatctattacaaagatcagcacatagtaggtactcagtaactatttagaatgagtgcatgaatgaatgaagtatgtgtgatgttatggagtacaaagttagaattagcaacatgacctgaatttagaagcaggtgggatacttatacttttctcagtctgtgggcaccacaccattgaagtatatgtctaagattaatttatatttggttgtttgatttagcaaaacttgctgcctgttaaaaaagaaattaagacctgtcaacttaaagaatacattttgtgagttaagaactaaatgacagtataatttattacccaaagcagtttgcttctgaaaattaaagagttcaagctattaataattatgctgtgactgcaggcataaactgggaatgtcctggcaaatgaggatgtattgtcacctttctcagcctgcctgtgtgttgtttttaagcttcactctagtttatatattttaaatgtcataaaataccacatacttataagagaaaaggttctattcattgctgaagtggaagcttatcattaatttttatttatttatttttttttccagttttggaattcttattactttgaacccaagaaccactgataactagcacaatccagtgaaacagaggaagcagcagcttaatcaaaggaaaaatacatttaagattataagtctggttataagcttaaaaagtgacccagaaagggatatcattgctaaaaaaaaaaatccccttgtgacctgggtacattttgcaaagccacaggtttgcagtgttacacaagggccaaaggaggccatgagttgtctttggttgtggggccggagggtaactgttcatgaaaatagtgagtgtctgaagattaagaaaatcatgctgcagcagaggagaagggagaggaaggcaggaagggaaaggagatgcctgagggtcaaaagctgagcccaagcctaagcccaagctcaagttcaagccccagcatggcacaattttgtgaattaactcaggctgagttgcctccagtctttggaatgtcatcttatactggtactgctgaggcagagggcagtaattggttctttgggataggagaaggggcagttgctgaaatacaaaattaatagtcagcatcccaagttcctcaattgcagccaaaatacatgtgttcaggcctttcggcagtaccgcccccagaactaccagctgtagtgtggtctattcccagacagcaacatgcaagaataagtttacaatacactcagcccttgtggcttaagatcaggggctcagaggctgtgacaactcatgatgctgaaaatgtatccaatgaaaacgaagtactagcttgtttagtagtaacgaagtactattaatttttaatatagtctgatactttattttctaattgtagaagcaacattcttagctatatctttctagaatgttgaggcaaaagagtaaatttatagtgattttcactgttaccagattgctggaatagggaatttctggtagcaagatgggaatttttaagttggaagggtctaacacatcatatagccgtctccatctcattttttttgctgaaaaaactgagcccttgcaaatgtcagttgcaaatctgggagtagtactcatgtctctgaagttgttatatagaattctttttatttattttaataacaatatttatgatagttgaaactttttgagtgcttactatattttatttcatgcattatgttcagcactttacatgttttatctcacttgatattcacaactttatgagattggcactgttattgtagccattttatagatgaggaaactgaagcttagagagttaaataaagagctcaaaatctcacatctagtaagtggcaaaaacaggatttcagctcaagcaatctgattccaaaacagacttttttcactgtgctgccattcttttgcctggtttttctgttaacttcttaaatatatgtcatgtttcatgcttacttcctcattttcataaatatattacctgctcacttatacattatattgcttagaaacaaacccaaccctgttttcttatggactgtatcctgaaaatcactgtttttaatatgtggttaaacaagtgttttattagtgcatttatataaattatttaaccaaaacacttaaccggtgaaagtgctttactgtgtgagaatgtgcatgttctaagaacctctaatttttaaacctcccttattctcagccttatatttgttaaaacctgtgtgttaacacagatgcacccatgttaggggttaattagagaaaccaacctctttatagattagcttgttcatctttaagttgctaggcaggcactgtaaattcagagaacaatctgattgtaagccacaaatcaatgaaattaattttggggttgccttttaaaatagtgtcacaaaatttaaggataaagaatgcaaaaatgatgccaattatctcatcacattagttttgatttaatttttttaatttgaaaaaacctactcttaaacttaattgatttttttaaatataagtttggagataatttttaattcagtaaagttatagtgattgaaaaagtagtttataatttttaataaattgatcttgttttaattttgagtcatattctagaagtgcttctttgcaaattggtaaattgcacatacatttccacttatatacaagataattgctatggttggtttgtataatagatgcagtgcatctgaagagctattttatgagaatattgtttcttgtatctgtcacgagccaaaaagaatatttttaagaaagttatattcttggtgatagaacagctgataatttagaaacaactgtaagacagtccactttttctgattatgaaataataccatagttaagtgtaatttcctataatagaataaaaacacgagttctagttttaggggaggcatgttgttaccgtaccttagaatttctggaagatgacatattcatgcttttcctgataactgctgagtctcctgctctgtctgccaatccagtcaagaagcctttgctagcaatcaattaataatacgtttcatttatacatatttcctatatatagtatgttattgattatctcagtaccactgaagagaggttatctgggtcattggagctttgcttctagatttgtgaagccataaacctatatatttaaaataggaggccaaaaaaaaacgaccattgctttatatagttagattttcagtgaattgagagtttatcatttgtaattatacattaatcaaatataaggcataatatacccccctgcttatatcagcaccatttcaaatgtaatgttaaaaaataataaatggagaagtagatagctaacaagtaggcttaatttaataagacaaagtaaatggcatttggaaacctcatggatttaatgttttatttaaatgatttctgatttttaaaaagtaaatattgtttccagaaggctgagaaacaagttagtagggagattttttctttgcaaaaaaattttacagttgtgtctttaacattgtaccacaaactgttgtcctaccagtctctttgtaagaaagctatagacatgttgggaatgaatgagctctttcctttttaaaatatcagttttacatcattcaggttccaatcgttgcacttactgctactgcaagttcttcaatccgggaagacattgtacgttgcttaaatctgagaaatcctcagatcacctgtactggttttgatcgaccaaacctgtatttagaagttaggcgaaaaacagggaatatccttcaggatctgcagccatttcttgtcaaaacaaggtaaggatttaatggttgatgaattttggtaatgatttcctttttttttttttaacaacttatgtattttatgttatttacgatttccttctaatgcatatttaacatatttcaaattccacctagttttggttcaagtcaagcatgatgttatataatcaattcagtgattgagactagtgtatttttaaaagcagaaaccaattctcctaatattttaataccccattctgttgcttaaacagggcatatactatttatttttattttttaaaattttacttatttatttatagagacagggtctctctgtcgtccaggctggagtgcagtggtgtgatcacaactcactgcagcctcaaactcctgggttcaagcagtcctcctgcctcagtctcccaagtagctggaactacagtcttgcaccaccatgcctggctaggacatatacttttaatgattgataagtaaacaagcaaacataaaatgactctttcatctgaattctgtctagtttactaattacatgacttcagtcttaaggagcttagaaaaggtcaccttacaaacacagtggagcctgtattgtgttccaaggactattgtaggcgctttctatataaaatgatctaatttaatccctataactgctcagtaagttacgtattattttcattttattgttgaggaaactggcattagtacttttttctgtttattttgtttaaaggcattttaaatatatatgttaagaagttttcaaaagcctatattttactttttataagcctttattttactatttgagacagtgtcttgctctgtcacccaggctggagtgcagtggcgcaatcccggctcactacaacttccacctcctgggttcaagctattctcctgcctcagtctcccaagtagctgaaattacaggtgtgcgccaccatgccaggctaatttttgtattttttagtggagacggggtttcaccatggtggccaggctgatctcgaactcctgacctcaagtgatccacctgtgttggccttccaaagtgctggaattacaggtgttggccactgcgcctggccagtttataattttaaacattaaaataaatgcttcttgtccaatcatggtgtctcacacccagaatcccagcactttgggaggcagacgttggagaatcacttgaggccaggagttcgagaccagcctgggcaacatggtgaatccctgtctctacaaaaaatacaaaaattagctgggcatggtggtgcatgcctgtagtcccagctatttgggaggctgaggtgggaggatcatttgagcccaggatgttggggctgcagtgagctgagatcacaccactgtactccaggctggatgacagagcaaggccccgtttcaaaaaaaaaaaaaaagcttctaccaatacaaacacaaaacaagcatagacaaatagagtttaaagaacatcattggtgttttcctctaaagggaatattgatgctaggccaagaaaatcctggagttattcttgaggaccttaaggaataattgaaatgtaggatttgctcctggctttcttgtcctatattcagaataaaacaagaatggatcgaatatattctgagtgttctggccattctagtgctctctgaagtgagtactcactgtgtttcacttccctttcatcctaaagaggaaaagttcttttgaagaaggctgtttgtcctaggttagagtctccacagtcagatcattatctcctcctaatctttgatcctgttcagtctctatggtactttcccttataataacactctctatggcactttcccttataataacactctcctttttaaagcagtttgccttttttgtgtgtaatattgttctcctggttttctgacgtcctggtcctcttataatcctatgcaaatgtttctttctgtttttcatgttgactctgctaattgaggtctttgttactttttagccgagactattataatttccccaacagatacccctctccccagtgccccttgttgctttctatgcagtttacaaattattgtctgcaaacacatccttaagtctggaatacctttctggaactccttactaggaaataaagaccagactcagtgtaacattcaacagtattgaagatctaggtatttaatatgaatttttttttttaaggagatcaagaaagatttttgtacccatttttaatcctccaagaagacttaggatagcaggaaaccattgagagtcagaatgctttctacagatcttaggtgaacagaaactttcctcttcatgagcagtgaggtagagggtaattaaggcttcagagcattgcccgttatttccatcttcttcccttcctttaattctgctaaattcctttaatttgtttatcagtattcaagtatttttatccattgagctaaggtgtttcttaaactaaccctattttgttaaagtcttaattataatatattcatagtacatttaagtgagatagatgagtctctcatataatttagtggttagattagattagaattttctcccctcagaaaattaagaggaaataaaagtctgtagcaaatcacttggcaaaataatggctccttttgtaataggaatttttactcttttgatttatctgttacataagttcaaatttttacatattttccaccttttttaaaaaagagtgatatgtagtcaatatcaatttgagcaacactgttgcatataaattgaaaaggactccaattttctaattccgtacctcagttgtgatcactgttggtattttggcatttatgtagacttcctttctctgaccctactactgtgcagatatatagttgcagttttttgttgttgttaagttgatacagaaatagttgcatactatatccattatttatgcaaattttttttcatttaaagtatctgctatctttccatatattgcattttcttaaattagagccttaatatataggatattacaatatctaggttttgttgagtagttttttcttctttgaaaacatgtttttaaaataaggtttttttttttttttttttgacatggagtcttgctctgtcgcccaggctgtaatgcagtggcgggatcttggctcgttgcagcctctgcctcctgggttccagcgattctcctgcctcagcctcctgggtagctgggattacaggtgcatgccaccatgccctgctaatttttgtatttttagtagagacggggtttcaccttgttggccaggctggtctcgaacttctgagctcaggtaatccgcccgccttggcatcccaaagtgctgggattacaggcgtgagccactgtgctggccttaaaataagatttttatacactaaaagaaaacttacatttttcactccattaagtagttcactgtgaatttttgatattgaagcccatttggttgctgtcaaaaatagatttgaacagattattcagtatgactcttgtagtgaaattattgccttgtttcctctgcttaagttttcagtggcttttgccacagtccttaaaggttttataatttttttaatgtttaatttttaaatgtttgcttaatatttcttagtatgagtgtagataatgatgaacatttagatgactttttactattataatgttgcagtgaatatttgtttacatttatcttttggccaataagcaaatatttttgtaaattagaatcctaaaattgaaattggatcaaaagttatatgcacttgaaattgattaacttttcctaaatctaaaatagtatagtcttttttatattgtcagcataaatgaatgcacttatgtaaatgaatatttttaggcgttaagtaaaatattctgtggaaattgaacatttaagttgtttatacttctatggaaatcgtttacgcttttaataaagaagcacaagtttctacaaaatacattctaacagatgttttctataacattcagtctcaagattactagtaaatacttctttgaactgtaaaagcaatctttcaatattataagaaagctcttgctttagtaaacatttagaaactcagctttattatcataagcaagaataagaacagtgtaacaagttttatgcacactcctttgtaaaccctcaccagactaattgttaatctggtgccttgcattccccaaagtatttgtatctgtcgtttataagtttttatcaaggtttcagctaaaacaaataaatttgtttctggttttagctttaatttgaactgaaacagtcaaaactgagttttggggacttcacacaattcatttggatatttgattctccataatgttttaaattttcatgcacttaaatatatcattatttttgataggctttcttcctttagtcttttctttagaaggtagaaaggaagaattaaataagataaaaccaaacgggtctgaagcatgtataaagtatatatgtttgctcttttgttcttctttttctttagttcccactgggaatttgaaggtccaacaatcatctactgtccttctagaaaaatgacacaacaagttacaggtgaacttaggaaactgaatctatcctgtggaacataccatgcgggcatgagttttagcacaaggaaagacattcatcataggtttgtaagagatgaaattcaggtatgaggatcaatcatcattgctctccgttgctcatagtggaagtggatatttctcaaatgtttatttaccagatctttattgaatactttctttgtgttgaacataaagcagtccctctgataaatgtgggagaacaaacttgcagattagtataaatagcaatctgtacctagtgcttaggtgcacagaggagggaggaatagctctgtcaaggtagttgtgtaatgggggtggtccatccaggaaaattcaattagagtccaaacatgtaagtagaagtttttcaagtatgccaggccagtaggtgatgaggggaaaggaattggttatagaattccaggaagaaggactagcaggtgcaaagacactttgatatgagaacacatactgggttcaggaaatgtgactggtatggaatggttggagggaaagacaatgtggggtaggaatggcacaaagtatggacaaagaggcagggtggaaccgttagagacttgagagaacagttgaatgggtcggttggccaggttatagatggctttaaaacttgcaaagaagcagtctgggcttggtatcatatacctgttagttttcactgactactttagccttagaatttttagtttagatacaattttctgtaataggtaaaacggattaaagtagaataactctggctgaagttaatgtgagggaaaaggaggtacaagagtctcgtctctagaccttgaagacactccctgttggggtcttataatccttggagtgccgcagaatcatttgaaaaccatcttgatgtactactctgtgtttttaaataagataataggattatagaaacattagactggcagcaataagttggattgatttgaagaagagaaactgaagaagggaaagggtatcgatgcagctattgtgaaattctacagttgagattcctgacctgattggactggctcagtgggtgtcatagaggatttatttgggaggatttaagttcaaggcacatgagtaggtttaagtcaacaacttgacactgtcaacatgaaatccacactgtaactataagtccgaggaagagccctctcctgaagttaggaatttaacttcagctcttgcattttctgtcccaccggtcatccatttcttctctatccatctccttttctgatatctagttgttatcagtgttgttgaaaagcttaagtatgattcatattcactgtctataaagttcactacacatagtcatgctgtaatgcatacccgcctgaaagcatctggtctctcttttccttctttccaaagataagaataccattcacagctgtttagaatagaaattttatccaaattcttcagtgtttatatttttgttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatcttagattaatattagagaatgttaaaatactctgcaatcaggtaaggacgcttgaaacttcattataatgcaaaagttttctttaacacaataaatattttgaaccccttttgtgtcttgtattcataggagttcagatagaccactttatttactattttttatagagagtgaacagaaatcccatttctagtcaccagtccttaatctgtaaatcaggcagataatctgtaaatgattggttgaaatcacattgaattccactttgtgccagggacttaagttaacgaacaaattattcttacaaaaaggtataaatgtaaggttttcattctgctaaatatgtttgtcaaactgtgttgtgatttgttctcagtgtgtcatagctaccatagcttttggaatgggcattaataaagctgacattcgccaagtcattcattacggtgctcctaaggacatggaatcatattatcaggagattggtagagctggtcgtgatggacttcaaagttcttgtcacgtcctctgggctcctgcagacattaacttaaataggtaaaaaaaatttattgtttttactcttgcagatttctttctttctttccatataaacctcaaaagtgtttgaggctatttccagtatcccaagtaatttgtgagtgcatttaaagtaaaaaaaaaaaaaaagaaaaataaaacctccccaaatccagaggacatgtaagaagaacatttgtggtaagagttgccacttggagatgagctaatttcagcatgccttagttagtgtgaggaattaactaaatcaggacaatacttgggcctgtcacagagatcctatggaatactttcctaccattgtgcattaatgaacaggttcttttcctctcctcagatcctgtcaagttgcgatgtcttcagccatagttacttcaactaccactgattttgttactgattctttcttcccatgctacagtggtgattattccagaggatttctctcagtccctatttgactcttgttactatttgttttcttggttagttccatgagaccatgccagttctccttgactgtgtatgaatcattgtgttgcactgtactgacagactgccgtaagtcaatattaagtgttcagtatctaagtgcaggagaacctttctacttaagtactcaacaagtagtttgttggcacttaagttctatgagattttttgttgtaaaggaaaacattatcttgcaaagattttggggcagcatttaccaatactttgttccttcatccgtaggaaaaagaatctcaggagaaaaacctatacatggtaaccaatggggctgccaagctgatgaagtattttcagagtacacctttgtgtagctgaataaattgagatcttgaatggacatattagctcattttagtaaaatgataagagagtgcctcccactacagtttttgtttttatgcatcattaaacaatgtgtttttgattgtccactgtgttccatgaactatgctatgtgtgggagatatagtagtaaagaaaagcaaagtacctgcttccatagaattcagtataatgggaatggtaattctttagagaatcacataactatggatacataggcttcattttactgttctccttttgtgtttgaaaatgtcaacaatcaaaattttgtaaaaaaggaatcatgcaacatatttaaaattataactgtgttaagtgtaatgaagggaaattgcactgagtagtaagaatatataatggtgtgtggtatttcccaagttaaaaaggtcagataaggcttccttgtggaagtgatagttcaaatctgaaagaagaataggaattaattaggtaaaaatgtttgatgcaaattttaagattttccttctgagtagtcagtagcttttccttcttaacatagaagatgacaaaaccatcctttttttgtacataacaattcttgttttcctttagacagttgtatctgtcaagcttcttatgatctaatttaaataattgggatagaacacagctgtacatgttactattaaatatggaatatatcaaacataagttgattcctaccagttctgattttatttgtgtattttgttaaaggtactgaggacattaatatccagttttatattgtgcatttgaaggttcatcaataaatacaattcttgtttctctgggtcttaaaagatattttaaatggttatctcattaagatttaacaggaaataacagtgattcaaatcaaatagtggtgccagaaacccatacttgaattttgggtatagacaggttaccctttgcatcaatcctgaggaaactaaaactataggattaatcaggataaaaaagaattgagcaaggattcaggagggatctgtatcatcctggtgacaaccctcttctagaaaaaactagaaagtctaagaataaatgaagttgctggttctcacctggaaaggtcagttactcacaaaatttttagagtctatcttatgccataattctatcactgagagaagaaacttgtccagtcatcatgtaatcttcatgtaaatttatgtttttaattgcagaattcataccacaggcaaagtcccaatgtctgcatttgctgttaccttaaatagtcaaaccccaaagttattgtaatctttttttaacagagaataatttgcagagtaatctcggtccggtagatctttcagtggatccaaatgattgccatgaatggtttagaatttttttaattttcaagttgtttttattctgtggaatactggacttatttttgtagtcccaaaagaaaaataaatatttatttatttgccgttaagagttgtagttttgttttctcaaatttgtcctgacactgacgagattagttaaatgtaggtcatctgaaccaaatacaaggaaggaaggacccagttctgaagagtgtgggcatttcttttcttgtttttttttttttttttttttttttctataggaggggaacgaggtgaactaaacaaacaaaataaagcaaaaaagaactgatttttatcccttgaggtagaaagaatgagattacagtggacccccttgtctgcattttcactttctatgttttagttactcacaaccacgtccaaaatgttaaatagaaaattccagaaataaacaatttataaattttaaatcagtggtggctttgagtactgtaatgaaattttgtgccatcccactcagtctgcctcgacttcccttagaatcatccctttgtccggtgcattcacgttgtatttactccctgtctgttagtcacttgttgcagtatcacagtgcttgtgttcaagtaacgcttattttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttttttcaaaagcaatttttataaaatcagaaaaatgtttacctcttgttgggggcattgactggaaaggaatacaacagaactttctgagatgctagaaatgtttttttatcttgatggggtgtgggttttgtagataatgaaaaataaacagtaaaaaataagtaaaaaaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaaaagaatcatttcaccaatgtatcagtcagggttcaccagagaaataggacgattgatattatggagatatatatatatatatatatatatatatatatggggagggaaaggaagaacaaatatggggagagagggatgaggcgactgattttgaagaattagctcacgaaattgtgggggttggcaagtctgaaatttgtagagcaggtcaataggctggaaactcaggcaagaggtgatgttgcagtcttgaggcagaatttcttctctagcaaacctagtttttgccctttagtcctgccactgagtggatgaggcccacccacattattgacaataatctcctttacttaaagtcaactgattataaatgttaatcacgtctacaaaatattttacagcaacatctagattagtgtttgaccaaacaactgagcatcataggctagccaagttgatgcataatattaatcatcacaaccaagaagacatcatcctaaatatatatatatatatatatatatatatctacttaacaaaaagactgacagaactgaaaggagaaatagagaaatctacagttacatttggtgacttccagcatctctcaataatcaataaaactgacagaccaaaaaatcagtaagaagacagaagaaatgaacaggattatcagcatgctggatctcattgacctttttagaacattctacccaacaacagtagagtacacattcaagtgcagatgcagtattcatgaacatggatcatattcagagtcataaaacaaaccttaacaaatttaagaatcttgtatttgtatattttttgactagaatggaattaaactagaaaacaataacagaaagataacagaaaagtctctaaaccttagaaattaaataacacacttataaataaatccatgagtcaaagaggaagtctcaaggcaaatcagaaaatgttttgaactgaatgaaatgaaaatacaaaatgtgtgagatgcagctaatgcaatactgagaaggaaatttatagcattaaatacctatgtaataaaagaagaaaggtctcaaatcagtacctaagcttacatcttaagcaacaagcaaataagagcaaaataaatcaaaatgaagtaaacataaggaaataacaaagaacataagtcaatgaatagaaaagctatggtcataccactgctgtccagcctgggtgacagagtgagaccctatgtcaaaaaaatttaaaaacaaagcagcatgcagcattcattgtcagtgaatagaaaatgggaaaacaatagagaaaatcaactcaaaagctcattctgtataaagatcaacaaaattgatataaacttctaacaagactgacggaaagagaaaagacacagaagaccaataccaggaatgaaagagggaatttcactacagacctcccaggtattactagggatgataagggaacactatgaacaactcagaacataactttaataatttagatgaaatggatcaatttcttgataatctcaagctaattaaacttacagtgaattagataacctgcatagtgttacaaccattagagggattgaattctatgttaaaaatctctgaaaataaaatcccctagcccaaagaatttcaatgacaaattctaccaaacatttagaagacaaaataataccaattctatagcatgattccatttatataatagtctttgaaacataaaactatactagagggatgaagaaaagatcagtggttattagagattgggggagggagaaggtatgattccaaaggatagtacaaggcagtattttggagtgatagatttatcgtgccctgattgtgatgggagttagatgaatctatggatatcttaaaatgtgtagaactttacacatacatacaaccaatttgcctatgttaattgaaaaaataaaataaaaacaaattatttacctggtgggttagctacgtacctaagttcaatagctgcgttactgtaagacaaaagaagcattattagggatggagttgttctctgtgtaatgacaaatacttcttcactaagaagacagaattgttttatgcacctttaaaaaaaaacaaaaacaaaaaaaatacaaccaacaaacagtaacttgctggtgcggtggctcacacttgtagtattagcactttgggaggctgaggtgggaggatcacttgagaccaggatttttaagaccagtctgggcaaaaaaccgagactgtgtctctacaaaaataaaaaataaataaaaaaaattagctaggcatagcattatgtgcctctagtcccagctactctggaggctaaggtggaaagatcgcttgagcctggaaggttgagactgcagttgcagtgagccatgatggcaccactacactccaggctgggcatcagagtaagactctgtctcacataaaaaaaataataataatgataaaaactagtctgggcatggtggctcacacctgtagtcccagtcctttggaaggccgaggcaagagaattgcttgaacccaagactttgagaacagcctgggcaacatagcaagaccccatctctatttaaaaaaaaaaacaaacttaaaaatccagcaaatacataaagcacaaagccgacagaagaggtggagaaatcaacaaatccaccatcaaagtgggagaatttgatataattttaagttattggtagggtaaacaatccaaaaattagtacactgtagaaaatttggtcaacatagtaataagtttgcttattactatttatcagtatacatagtatactgatttatcagatacatagtatatggagccctagagcaagcaactatagcagtgtatctcaagtatttttacttcatgacccacatagcaaatgatatgtgtatataacacactgggctaattgtcagagttcagtttctgtccaaaaccctaagatctggagtgattaacctttcagcactcttagaactcacttgtttgtagcacactgattgagaagcactgaaagacttcactcctcaaacatacatggaatatttctaaaaactatgtattgggccgggtgcagtggctcatgcctgtaatcccagcactttgggaggccgaggcgggtggatcccgaggtcaggagatcgagaccatcctggctaacatgatgaaacgccgtctctactaaaaatacaaaaaattagccggatgtggtggcgagtgcctgtagtcccagctactcgggaggctgaggcaggagaatggtgtgaacccaggaggcggagcttgcagtgagccgagatcgcgccactgcactccagcctgggcaacagagcgagactctgtctcaaaaaaaaccaaccaactgaacaaacaaaaaaactaaaaaacaaaaacaaaaaaactatgtattagagcatgggttggcaaactatggcctgtaggccaaatctgcatgctgttttatttttttttatttttttgacatagggtcactacaggctgtcacacaggctggagagcagtggtatgatcatagctcactgtaacctcaaattcctgggctcaagcaattctcttgcctcacctcagcttcccaagtagctacaggcatgcactaccagacccagttaattaaaacaaatttttttttggtagagacagtctcagtatgttgcccaggctggttttcaaactccttgcctcaatcagtcctcctacttcagcctcctaaagtgctgggattataggcatgagccatcacgcttgactaatgtttttgtaaataaagttttctcagaacacagccatgccttttgtttatgtgttatgtagggctgcctgagttaagtagttggctgcaaagcctatcatggcctataaagcctgaaatacttactatctggtcctttatagaaagtgttttctgaccctgtactagactagcttgtctcaaaattcttcaatgaatttggaagttttctcaccacattttctgaccataatgcacttgagttagaagtaaataagcagataaacaacaaaatcctcatgcatttggaaattaaaaataacacttaaataattcatattcaaagaaaaaatcaaactggaaattaaaaaaaattttaaacctacagataactacattaatatgcattaacatttttagaacttagggatagttacaatgatatacattaaaactggtaagaggctgggtgcgttggctcacgcctgtaatcccagcactttgggaggccgaggctgggggatcacgaggtcaagagattgaaaccatcctggccaacatggtgaaaccccgtctctactaaaaatacaaaaatcagctgggcgtggtggcacgcgcctgtagtcccagctacttgggaggctgaggcaggagaatcgcttgaacctgggaggcggaggttgccgtgagccgagattgggccactgcactccagcctggcgacagagcgacactcttgtctcaaaaaaaaaacaaaacaaaacaaaaaaaaaaactagtaagagggcccagtggctcacacctgtcattctagctctttgggagactgaggagagaggatcagttgaggccaggattcaagaccagtctgggcaacataacgagaccgcatctctacaaaattttaataacaacaacaaaaaaaactggtaagaggcaacattgaatagtactttgtgggagtttattagcttgaaatactcataatagaaaagaaaattaatcagctaagcatctcactaaagagattaggagaataaacctaagcatagtttttttcccccaaacattattatatctggaatattgaatgcattcttattgctatttcaaagatacttactctaaggaaagcaattgaattaggtagttgaactctatagtagattttctttaatgagtccttttgttctcaacctacttaaataattctcatttgaatttatgatagtttcagatctacccaaagggtgacttaggaatttaacttctaaatctatttaaatgaaaggtttataatctttttgtcatattttacagtcgttagcgtttaacaatttatagcataggatttgggtttttttttttttttcattttaaagaagaagtttatttaagcaagacacttgactaagggaagactatcttggagttattattactagagtaatttatttctacttaaagacagattgccccacaagtaacagctacataaaaacagttgtaaaattgtccttggttttacaatgataaatgaaaaacattaaaattctctaattgaacaaggtatgcaaggatttttatattgttttttgctaaaactatgacagcaaaataacatcctggagtataaagataagagctgaatgagcaggccactaggggacaaagggagtcttttcacagaaccaatgcttcttttgcccaccccatctccatcgaagtcaatctaaacatattattggccatttagttaaaaaaagaaagaaaagaaaagcaatatgcttgtggacatacaccagttactttatgtgcagtaaaagagtaggaaggggaaggtgaaagaatagagaaaactatgtagtcaggatgtggtggaaccaaattgcaactttctttttttttgagacagagttttgctcttgtcacccaggctggagtgtagtggtggcccaatcttggctcactgcaacctccgcctctcagattcaagccattctcctgcctcagccttctgagtagctgggattacaggtgcatgccaccatgcctggctaatttttgtatttttagtagagatgggttttcaccatgttggccaggctggtcttgaatgcctgacttcaagtgatccacccgcctcagcctcccaaagtgctgggattacaggcgtgagccactgcgcctggccaaattgtagctttctaattgagactgtcttcttggtctggaagagcagagttctgcagtaaaataacaggtcccccttttagtagacatctccatgtctgctgctggaacacatcagttttgtcttaagcctcacttccaaatgtgcagatgtgtctggttcattgattggctgcctgtcaaattgaaacctgatctgcctcattggcaaaccgtgccccttacaataggctttcattggtttactaagcggtgtggtgcgtggctgttcatcttaaactgcaccacagtttaagatgaaccttcaaatgaacattatccttgttctcagtcttgactttccttgggctttttgtggaccctggtgagtgtggcagtctcctcagctgctgcttcacaaaagaggtaccaggtctgccccgaatgagtgagcccctaaacaggaccaggagtggcagaagaaagaggcagcaactgagatgtgttttttctaagctgaaaggctttttttttttttttttttgcaacacacctttaacactaaagtccaatatttatataattggtcaagtaagtggagctgttctagctataaatatggcaactctgcttgctcgtcctattattgacattattcctttctgtggtctgaggtgcctcccatgaaacttgcttctaggacactaggattgagaaccatcagcgtaacatatctgttacgctacaatagtttattttcatattttagctactttacatactcgggtataatgaactttattcatagcttctgaagcagttggcacatttgagatattttttacttggctaattgttatgctaaatcttttgatttctaaagatacatgcctttgctaagctttcttcaaatgttattatttttatttagattggatcattgctattccatggatgactcagaggatacatcctgggactttggtccacaagcatttaagcttttgtctgctgtggacatcttaggcgaaaaatttggaattgggcttccaattttatttctccgaggatctgtaagtatatatctgtgaattcccttcatagatcttcttttacttctattacacttttcttcagaggtttgcagtattatgattgtagctttgacttcagatgggtgactaggaactcatagagtcttactaagttccagttaaacactacattcattactttggataaaacccgtgtgtatggcatcttctgctgttttcatgttcaagccgatgttcagctctgcagctcagtctggaagcattgtgttaatttatcacattgcatttgggtgaatccctagactagtcttgcttaggataattaggaaaagttaactttcattgtatcaagggacaggtagaacaaaattgtccttttgtccaggaaaccattaaattcttcaaggaaaactttagttatagggattattttttaaatgtctaatttcagtaacaatatttgggacatatttatttttccttctgtttcctatcagaagtatttaaagttataagaaaattgtggtttttgcctttactaatgaataaataatcaattaaattcagttacttttttttggagtgattgatgttccagtattcttctaaacaaccacgggtacaaatgtgaataagataggaccgttgcagtccaagagcttgttctgtagtcctttcctttatatgattttttcccctgatttagaagtctataaagcaaagctaagtattacacactgataatggctgaataaatcaagagcaagagataggatactttgcaaatatgcatatttattaaaaatgtactttaaaatagagattaaaattctcgtattgaatgtagaataggtaagcatttatttgtgaaatactcgaatgcttcatgtaaatactttctgagtttgtatttttagaaaggaacattttggaggctgaggcaggagaatggcgtgaacgtgggaggcggagcttgcagtgagctgagattgtgccactgcactccagcctgcgcgacagagcaagattctgtctcaataaaaaaaaaaaaagaaacatatttattaaattagttgtgaaatatttttaatgaaatatattgaaaacttctgttgatttttcatgtactgatgtttttagattctaaatggagtttaaaattttgtttgtaaatcacaagttggattagaaatttaatagtagaagtgttgcctaaggactattttaggtgctgtgagtgaaactgtattttttataacaagaattttagttgtaagggacagcttaaatataattgagatctgtgaaaatgtattctgtctctatcaccttcagaacctgtgtatctcagttgaatgtataatttataaaaattattcttgttttaatttggtgtaatccagccatatccagtatcaacaaataagtctaagtaggctccttgacaaacttgaactggccacaagagagatcagatttcacctattaaaaaaccaaatcagaccacttacactgacagtctcttctgggagtcctcaaattaagaagtctatcctttgtgaaatattacactacccttgctagataaaacttttctaaaagtaccacttaatgaaaatctgtagacactaaatgcaatgaaaataaggcattgtttttttttctccccatttcagtgatcttggtatcctgggatattgtttttaaaattatcgttataattcctttgagaatttagtgaaatgttccctttaaccaacttaggaaaaattaatatctttgtacatgattttgagctgtaaaataaacattttaaactgggaataattggagtttagttaaagagataatgtatataaatatataacatagtagcagcatataattctgtcttacacaagatttttctgaatagtataaacagttatgtagcctatctaggagtttgtgaatagagtttaaaattttgttttgaagctgcaaatttgattagaaattaaacagtgaagttattacttaaggaacttcgttttagctgtctgaacaacttactgtataaaaatctttaaacattctgtataaatatgtgataagatatgcaatgaccttaattttatagattagaaaataaaaacacactcattaatttacataactgacagattaagtgaaacttctcttctgatcacgttagcagaatgccaaatcttgtcgtggcactagaattagacggtagttttgataatacatgatttgactatagacatttgttgaaactattggtagttttaatcactcttgtaattttcaaactatctaacgggagaggattatccatcctgttttctagacaaactgtttcatctgaatgaaatatattcctagagataattatcactacttcatcttttggttttattttgcacatagaattatagttcacaatgactttctgaagctctaaagttgcagctgtgagcttctttggcctgtagggactgggaaaaagcacccccgtcctcccccaagcccccccaccaaaaaaagttaaagtgtttttaacaatagctgtgggctttttgtagtttcagaacttaggagttgcccaggctggaatgcagtggtgtgatcatagcttgatgcagccttgaactcctgggttcaagcaatcctcccacctcagcctccagagtagctgggaccacaggtgccaccccacccagctattttttttattttttaatttttttgtaggtatggggtctccccatgttgccctgcctgtctcaaactccagggctctcaggtgatacccaccacccttggcctcccaaagcaccgagagtcactgtgccaggctgagtttaaaatttcttgagttggagtttatggctattttttccactagttattaaacatgtatttttgtataaggcactgtattacattttgtggggggattcaaagctaaattagatgagacgcatcatctattatggaagatgttacttaagaagaaatgagtgtaatgtagcagagaattagataagggacgtatgaatacatataaatgctgttgaagttctgaagagagagagtgtttagagaaattagaggagtctttgtgaaggtatcactagaacttcctatttttgtggaatatatagtagattttggtgtgatactgtggatttggacattcactcagagaaggaatgagggaagaatggtggagaagaatggcattcacagtacaaaaagcaactgtgacttttaaagaagttaatatggagaagtggcaagtcttttcttctctcttctcttctcttctctcttctttttcttttttctttttttctctgtcagataccgttgtaaagactttgcttttaccggaaactgatacgttgggtcatgtaccctggccagtcagttctctttattctaacacttagccgatcagttagatttccacattccatgatatgtcagttttggtgacccttatttttccacctggtttataaagggaaagaatgtgatatgtcacccaggctctggagtacagtggcatgatcataggtcacagcagcctcaaagtttccagttcaagcgatcctacttccttggcttcctgagtatgtggcactacaggtgcatgccaccatgcccagctaacttttttgtagagacagggtctccctatgtttcccaggctggtcttgaacccctgacctcaagtgatccgcccaccttggcttcccaagatattggcattacaggcatgagccactgtgccggcctgaaaatttctcttttgagatggcatcccacagaagtatacctgcttagagctaacactggtaaaaagactatttaaccctattgccttattttactgtagttgagattgagttaaactgaaagctgaatgacctgtcctaggtcatactgttactttgtgccagagtcaggatgagcaaatggatttcctgcctgctagtctagtgtcttttctatttattgtgctgtaacatacagttttaaatttgtatttttatgcccaatggacatggtagctcacacctgtaatttcagcacttttgggaagccgaggtggggggattgctcgagaccaggagttcaagatgagcctgggcaacatagcgagactccgtctctataaaaaaaaatttaaaaattagctgagtggtgatgtgtgtgcgtgtagtcctccttgtgggaggttgaggtgggaggatcgattgaatctaggaattcaggactgcagtgagccatgattacaccactgcactccagcctgggtgacagagcaataccctgtctcgaatgaatgaatgaatgaatgaatgaatgaatgaatgcccaaatccgtaagctatgttctgtatagcagctttttcatcataggcagtttttactcttatcagtggacaacctacaaaattaactaaacacttaaacaattaacagaggaggccttgttcagagtgagaaatcattaagcatttgttgttgaaatttcttactgtactctgttttaattctgtttttttttttttttaatgttacttgttttagtttggattcctagttgaaaagggaatatgattcctttaaaacaaagatactctgctttaaagcaaaggtatatcatcctcttcatggtgattgccatggaaacaagacaatgtaaatttattcaaatagtacacagtttttatagttattgatcatgaggggaagggacagttaatccctactgatcagataaaacctcattgtttcatactaataaatggtttttttatgcttatgaaaggaaaagccagaagtgtaatttttagtgtttagagagctagtgattctagttagggaacttaatacctttgaagttattagtttgcaagcaatagaatctactactaccaaggtgacccctagcagatgtagagtaccattaacaagtgttccagggaaggaaagccaactagataccaagtcatgctttttactcttagattaagaaattcaggttgagttaaaggatcagctgttaactaataaaaagcagattaatattacagagccaggctctgtcctggttatggacttaatcttcacagcatcctcaagagataaaaatgaatatacctgcatattagatgaggaaatagaagataagtaacttgccagagctatgacgtgaactcaggtaatgtagcttaagagcccccacatgtatgtatattgggtgtgtgtgtggagggggtgcgtgtgagtgcttgtgcatgcgtgtggtataataagaaaaaattagcatttatgcctgtaatcccagcactttgggagaccgaggcacgaggatctctcaaccccaggagttcaagaccagtctaggcaacatagcgagaccctacctctacaaaaaaagttttaaaaatattagcgggcatggtggaatacacctgtagtctcagctgcttgggacgctgaggtgggaggatccttgagtccaggagattgaggctacagtgagctatgatgacacctctgcactccagcttgggtgacaaagagagaccctgtctccaaaaaaaaaaattagaactagttatctggaggcctgtgttctagtcctagctttagtacggctacacagtgacacattaggctaccatttaacatctttgaacctctgataatttgttaacaatatgggtaaaaatgactaagataaatcaaagagctccagcattccctccagctctgaaattctatgatgttttatcttattttacttacaaaaataaattatattatgtatatttaaagtatacaatttgatgttatgggttacctatagtaaaatgattactataatgaaactaattaacatatccatcatcttatattgttaaccatttttttgtttttgtggcaaaagcagctgaaatccactcatttagcaggaatcccaaatacagttcagttgtattaattgtaattctcatgttgtacattcgatctctagacttgtttatgctacatatgtttgacttttaaacattctactcaaatcaaccctaagtcagggttagcacagacaggacttgttaacaaggtagaaggtgccacattgtacctgggtgtttatatttctctaaatcttgttctgatcatattttaataaatataatcatcaggacaccaaaattcattccttagctattaaaaaattctattctattttattgttaagatttaggagagcatggtacagattctcttaactatacctatcagaagcctatgttttaagtccaatgtataggcactgctctgtttgtctctggtgggaacttaccctgctttacctaatttcatcctagcttcctttttgtgaaagatcacccttgcttagcctattttttggcaaatctacaccttggaaatagtagtaaatgacataagcatattaatatttatgatgtgatttatttttgttttcaagtcatatactggggaagattctcaaatattaaaacaatgtatctttacatttatgtatgtcgttcttgttctgttttagaaggcttgtatttgcatttttaacattccaaaaggtaaacctgtaatcataatgttttcatcaattcaataaaaccattacgtttgtaatagagagccctatagttgccttagttaagtttgctgcaactcattttatatattcttttaattttgatccctggatttttaattgattattaaaccttcattaggatatatatgaaatgtaaaaatattgagttataatctaccgttttctaaaattttatactgcatttttatatagaaattcaaattgctcataatcattctagtgaatttaagtagaaaggtatttattactaggtattaaatggcttataatattgttgacaaggttccactgcaaaatagttcaccaagggagctgtggcctcttctgtgatcaagaagccatctgtcaacttgggaagcttccactatagcacctaaccccagactacattgagtaggaagctgtaataatcaggaagcttctacctttgcatgctctgcaaaccaacgtgaacctgctgtaatttgtaaccacaaaatggatgcctgttgatacttacgaagctcatcattgtatgctgggttctttgctaatactttcttataaaaattaaatacctccacaatcatgcatgctagcagaaacagcagaggagtagccttagcctcacttcctgcttatacctgtcatgcaaatatacagaacccagaaccctagctgaaagggagtttgagaactagtatttgtattgtcccagattctgcagtggaagaattcatagtggatggaagttagaatgacccttgaattacaatcggccacattcatcacaaatacattaaataagagtaatttgccataaagctctatgtttgtatacttctttgttttttttttttttttttttttttttttttgagacagggtctcactctgttgctcagtctgtagtgcagtggtgtcatcatagctcactgcagtcttgatctcctgagctcaaacgattctcctgcctcagctcctgcttcagcctcctgagtagcggaacaacaggtacacaccaccacactttgctaattttttattttttattttttgtagagatgtgggtctcactgtgttgcccaggatggtctcgaactcctgggcttaagtgatcctcccaaagtgttgggattacaggcatgaaccactgtgcctggcccatatactacatatatttaaaagtagtatttaaatgtgtaggatgaatgaaagaggcagtaagagaacaaagtgaatgaaaaagtatttctatatgaagtgaaagcaggagagtcctctctgttagagaacaacagaattgcatatgacagactagctttcttaatatttctagaacttgatggctgtgaagagcgtcccgtaggaattctcccttcacttaggaaaacatacctcaaaaccatcagctgtttagcatgcacctgcttttcctggtatatctcagtgaagcagctaaattgtaaatgattaagtaaactttgcagtgtatcatgtgcaaaagcacagtaaaaacaaaaatgcattggaagctgtgagttgttgcactgcactcatggatgaatagctgttggttcgcattgcgtttttttgttttgttttgttttgtttttttgagatggagtcttgctctgttgcccaggctggagtgcagtggcgtgatctcggctcactgcaagctctgcctcccagattcacgccatcctcctgcctcagcctcccgagcagctgggaccacaggtgcccgccacaacacctggctaattttttgtatttttagtagagacggggtttcaccatgttagccatgatggtctcaatctcctgacctcgtgatctgcctgccttggcctcccaaagtgctaggattacaggcatgccgcattgcgttttatataattctcatggttctagtctcgagctgtaggattttgatcactgtttcaaacaataatgtgagtttgctaagaggtctaaataacaaaagctaagtgttccaaacacatatccaaacctatacactgggcaatgcatctgaattatatgtgaaatttcctgccattatttaagacacaaaaggaacattattttgataatgtatttatttgtgagtggagtgttcagaatgagcacgatgggtataacatttttgtaggtttttaaagttgaaatttagtgtaaatccaaagaatcaatagacaagtctgtgttttacttaacctatatgtttaaattagcatttttagatactgattttattcctaatttcagaattctcagcgtcttgccgatcaatatcgcaggcacagtttatttggcactggcaaggatcaaacagagagttggtggaaggctttttcccgtcagctgatcactgagggattcttggtagaagtttctcggtataacaaatttatgaagatttgcgcccttacgaaaaaggtaaacggtgtaggagtctgcctgtttgacttaattttgtttcccactccacattaaaagatcctttttgcttttaatagggtagaaattggcttcataaagctaatacagaatctcagagcctcatccttcaagctaatgaagaattgtgtccaaagaagttgcttctgcctaggttcatttttcagtttttttcttgtaacttctgcattttttgttgctatttatgtgattcaaattataccagtttataggcctctcacaagtaaaatgaattacctgtttgtttttgtatgcctattttagtcagtttgggggaagggatctgtgaggaaaggataagtcatagagcacttttcttttttaagagacagagtctctctgtgttgctcaagctggagtgcagtggtgcgatcatagcttactgcagcctcgatctcgtgggcccaagtaatcctcagccacctgagtagatgggactacagacatgcactactatgcccagctaatatattttaattttttgtatagagacagggtcttctagtgcttcctaggctggtcttgaactcctgagctcaagtgatcctcctgcctcagcctcccaaactactgggattacaggcatgatccaccgctcccagccagaacattttcttggttgatgggaagtagctgaccatggtatttagaaaacttctttctcatcgattaaagaagcagtactgaaatcaatgcggaggaatccatatatcatatttacttctggtgtgtagaagtggaaagggaatacatttgttgcttacttttttgtacctttacatgtgattgatcacttgtgagttttttctttcaaacatcttaaagcttccagagctttttctagaaaaaaaaatcagttttaagaatcaccagttctaaaagggtaatatcttattcatctttctgagaatggagtatcatgattcatgaattagatacttgcatcttaacatttgaaataatttaattttattattttttagttcgaaaactgtatcttcgggcaccaaagagcattgttataatcaagtaccagttgaattaagtacagagaagaaggtttgttttaaagaaattgttctgatttatttcattctttattgattcaaattctgtttaaaattttatattttaattcctttccaattaaagagaaaatggcatatataacaaagcataaaattcggccagggaagtgatgtgaacagactaaaatttattgtatataatttctggggctaataaagaattggaggtatttgagaaaggaattaatttgggttcttttaaacctatctgctaactcatttggcttagagtagtcacatgttataatacttatagttgatcaaaaaattgattcctaagtgttcttattaaagacacacacacacacacacacacacacacacattctctctctctctctctcacacacacacacatgcacacacacttatgtactttcttgctttttttgacctaagatcttagataactattacagattaaatactaatccactggcagacttcagctaattagaacactggaataataggcaagcatagtgaattacattttctggtgaactttttctgctttattgaagtatgcagaatgtaaatgaattgtttttataactttggcacttgctgtatcttagaacattcttttgatgatttattttctgtagttttgggagagataagacattggaatgcgtttctaactacctttagaactttagaaactgataatttaggaggttattttcaggtgattaatttgacagcttgattaggcaaagaaaaaattgtgattttgagatttttgtttcttattttcttcacatttaaaagttttttgaaactttttttaatggacctttatatgtttaaatgcagtctaacttggagaagttatattcttataaaccatgtgataagatttcttctgggagtaacatttctaaaaaaaggtacagagttccatatttctatgttctatacttgctttatgagtacttttttttctaaagagaaagaactgtcagatgttgggctatttcattggcaaaaggaagttaaatttaaaacataagcttttcagtattagaatgatcaaagtgagctataaaagaataatgttaatttaatagctaacacttcttggatattactgtttgtcaggcattatgttaaatgctaagaactttatatgtgatatctcatttaattcttacaagagtctaacagctgttactatttatcgccattttatagttgaagataccaagggttaagaagttgacaaacttgttcaagagcatacagctaatggccgagctggctttcaagtctatatttgtctacctctagcatcaagacactatttatttttctttgtatgaaatatatacaggcatactttgttttattgtgcctggctttattgtgacttgcagatattgcatttcttataaattgaaggtttgtggcaaccctgcgtcaaacaggtcatattagccccattttccaatagcatgttctgttgtcatgtctttgtgttatattttggtagttcttgactggccattcaccatttctctccctctcctcgggtctccctgttccctgagatacaacaaaattgaaattaggccaattaataactctataatagtctctaagtgtgtttttttttttttcgagactgagtctcactctgttgttcaggctggagtgcagtagcacaatctcggctcactgcaatcttcgcctcccgggttcaagcgattctcctgtcttagcctcctgagtagctgggactacaggcgccccccgatcatgtctggctaatttttgtatttttagtagagatgggtttttgccgtgttggtcaggtggatcttgaactcctgaactcaggtgatccgcctgccttggcctcccaaagtgctgggattacaggtgtgagccgctgtgcctggcccatctctaagtgtttaagagaaaggaagattcacatgtctctcaatttaaatcaaaagctaaaagtgattaggcttagtgaggaagccatgtcgaaagctgagataggccaaaagctaggccccttgcaccaaacagttagtttgcaaaggcaaaagttcctgaaggaaattaaaaatgctaccccagtgaataaaacaatgataagaaagcaaagcaggctttttgctgatatggagaaagttttagtggtctttataggagattaaaccagccacaacattcccttgagccaaagcctaatccagagcaaagccctaactctcttcaattctctgaaagctgagagaggtgaggaagctgcagaataaaagtttgaggccagcagaggttggttcatgaggtttaaggaaagaagccatctccataacataaaagtgcaaagtgaaacagcaagtgctggtatagaagctgtagcaagttatccagaagatctagctaagatcatcgatgaaggtgcctgcactaacagactttgaatgtagaccaaatgctttctaccagaagaagaagctgtctagtactttcatagctagagagaagtcaatgcctggcttcaaagcttcaaaggacaagctgactctcttgttagaagctgatgcagctggtgactttaagttgaagccagtgctcaattagcattctgaaaatcctagggcccttaagaattatgctatatctactctgcctttgctacatacatgtaacaacaaagtcttgatgatacctgtttacagcatggtttcctgaatactttaagcccattgttgaaacctgcttagacaaaagattcctttcaaaatgttattgctcattgacaacacttagtcaccaagagccgtaatggagacatacaaggagactaacgttgttttcatgcctgctcgcttaacatccattctgtagctcatggatcaagaagtaaattaaccttttaagtattattatttaagaaatacagtttgtaatgctttagcttctgtagatagtgattatcagagatgggtttttaagaggttttccagaaaaccttctggaaaatattcactattctagaagtcatgaagaatatttgtgattcaggagagtaggtcagaatatcaatattaataggaatttggaagaagtcgattcttattaaaatcaagagtttagtgatagacatactgagtttgggatacctgtggagtagtccagaagttaatttaaatatatgggcttagtgtacagaagtgagcagggtgcttatatatgaataaatattattttaagatatatttaaattttccttaaaataatacctatacttgatataaaaagttaattggaaattagtggcttatgacaagcataccagcccacactcttcccaaacccactttgctcttattcatagaagctgtcatcttcaaatcttccagctgatttccctggcgtgtgccttcttatttctgaatgacacgcttagagtactatttttttgacttagcaattttagaaattttctactcatctcctattatggtagatttcccctccttcattcctcctccaatataattatatttcgtcatattaataatttgtttatatatatttttaatataatatgataatattgtatttatattattaaaactacacaaatattatatacacactactaacccaaccgtgttattatggccaccactacctttatttttttccttgtgttagtgattgtctttgttttattttcttggttttgagtattccttttactaattttcttttttcctatttcaatctctcattatttgtttactcatttggagtgttccttgacttttatcccctcttacctagtgacattttaattttagttatcaaatttttaatttctaagaatgcttcttgttctcttcttgtttcttcttccccaccagccaaaaatctatgatgttatagcaaggatcatacattgtttcccagtaggttaagaaaccttggttaaaacctgttgtatcccagtaagttaaaagacgttaacgtgtcatcttcagtatggatgaaagaatattttctttcaaaagcagttggttgaggaagagaatgggacaaatgctctttttaaaacaccaattttgtgatgaactcaaattgcaattttaactttaccattataatgaatgtatttgatccaaaatgtttaaaatctaggctgttgtcatttaaataacaaattaccttactggtatcatgaagaataaatgtttgtactgatttggaaagacattctcatttaggggatgaaatagaaagtcaatgaggagaaagaaaagcttttattatttattttcttttaaatattttagtatcatggtacagtcaccagaaaaagcttacagttcctcacagcctgttatttcggcacaagagcaggagactcaggtaaggcttttgtaaaaaggtaattagtttatgataggatagttatgattctatgtatgcttaaaattctgtattttgccagcattttaaaaattgttcttaagctaagagtctgagtttatatttcagtttatattcattctaaggaaaaatgtggtatctgaagctctaaaaataaaggactagatcttttaagtacactttaaaaagtgttgtttctttgttttttgttcagattgtgttatatggcaaattggtagaagctaggcagaaacatgccaataaaatggatgttcccccagctattctggcaacaaacaagatactggtggatatggccaaaatgaggtaaactatcttttgcatgtgttctatttatttccttctaacaaaatagatttggaaaatatatctaagttgataatatgaccatagcttccactgtcacatctgggaggtgactcagattccccctgctgcgatgcttatctctttgccaagctttagtaccgtgtttctgtatgaataaaaaccagttacgttttcagcaatcatattcaatatttataaaatctaactcattatttacccaccctgcattttatccaaatgccgaaactcctctttttggattctttatttttgattatcttaccatcacatttgtagtcagaggttcctaatgcttaaaacctctgatctgaattttctctcctccaatataaaaccccttcgtcttcctcttcttcttcttcatttttttttttttttttgtctgaagacttgtctcactgtgttgcccaggctggagtgtagtggtgcgatcactgctcactgcagccttgaccccctggactcaagctatcctcgcacctcagcctcccgagtagctgggactacagaacatgccaccatgctcagctaatttttgtattttttgtagagacagggttttgccatattgcctaggctggtcttgaactcctaagctcaagcaatcttcccgcctcagtctccaaagttctggcactacaggtgtgagccactgtgcctggcctctttttctcatttaaatacttttcataccttttgtaaaacgggttccttgttgcctgtctatgccttcctcctccttcttaatgacaccacgttaattctgactgttttcccttggcctgttgcagaagcctcttaactattaacccttcattctctctctctgtttcatctgatatatgagtaccaaactaaatcttcctttatcatatcttacttctgcttaaatgttttttttctagcttagaattcaaggccctctatttatgaacttaaacttacttttccctctaagttacagaatttgaaatggtttatcttacctggattgtttatcacttgttgaagatccattttcaacttccatatatttatttacagtgttgcttctccttgtagtttccttgattcctcaaaactccttttaagaattcttgaagatctcgctttattactatttctcgctttattactgtaaagactatgagaaggtctttcatgatcttatcagcaaagtaattcctctctcttgaattcatagaggactttcagatgaattctaaagatgcttctgtagcacttaccacacaatgctatattttatttttttgtaattagtggtaaacaagtattattatatcttctagattttaaactccaaataaagatactagctccttacctttttgtgtgtctcctgtagcacctagcacaatgcctcataaacaggaggtgatcattaaatatttagaagaaattatttcccaagaatagttgcttggtaattgtatttgtcttttacttccttttaaaaaattgtttctgtcactaaattgcatccaatagatgttacttgagtgcagaattttctaatgacattacacagtgctacatctgacactaattcttttgttaaaaaataaatattctggccgggcgctgtggctcacgcttgtaaatcccaggactttgggaggccgaggcgggcggatcacgaggttaggagatcgaggccatcctggctaacacggtgaaaccccgtttctactaaaaatacaaaaaattagccgggcgtggtggcgggtgcctgtagtcccagttactctggcggctgaggcaggagaatggcgtgaacccgggaggcggagcttgcagtgagcggagatcgcgccactgcactccagcctgggtgacagagcgagactccgtctaaaaaaaaaataaaaaataaaaataaataaatattctaagaccatactttaatagaggtgttttttttttttttttttttttttttttttttttttggtgatagagtctcactctgtcacctaggctagagtgcagtggcgcgatctcggctcactgcaacctccgcctcctgggttcaagcaattctcctgcctcagcctccggaatagctgggactacaggtgcgcgctgccacccccggctaattttttgtattttagtagagatgaggtttcactgtgttgtccaggctggtgttgaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtgatattatttaataatgaatgagtgatctctcctaactccccttcagaagaggaaaatgaagtaggggaaaaggtaaattccccaagggataggtatgaaacctttatgaaccttctggatagagaagatgactgctgatttctgtgattagaaattatacttgggttattctgcaaattgaaatgaattatttaaaaaaaaacaactttaatgtttattaagcaagttttgttattcatgagtttcattagccttttattttttttttaaattttgaagtaaaatttcttgctgtcacaatacacattaaaaattacaaatatgacacatattaaacacattaagatggccgaataggaaaaatatgctaaaatatttttatataaatacattttttgagaattttgagaatttctggaacaaagtaatgatataatccataaatgtacaattaaagagtttaaggatatccaaaatacttggcaaagtaatctgaaataatactcttaggaaggtagggcaagaatgtgattctagtaagcaaaaatgtgatcaaatcgtattctagtcccagctactcgggaggctgaggcaggagaatggcgtgaacctgggaggcggagcttggagtaagccgagatcgtgccactgcactccagcctgggcgacagagcgagactccatctcaaaaaaaaaaaaagactatatgaacatgtatggcataaatatgtacaaatattatttattttaaaaaaattcaggggtagggacagggtagttagaaaatatctaaggatgttcatgaaataatactggctatgaatgacagttgatgaaaccgggtggtgcccatcttattccctcgactcgtgtatatgtttgatatatcccacaataaaccttaaaaaaaaaaagatgagtggtcaattataggaagatataaatagaaaaggcaataaggacaaaagttggcaaagcttacctaagcactcttcagataaaaagacatttttgctaactagatttgaatattatagtttaattgtcaaggaaaatgcctcaacttaatctttgttaagagactacttaaggcactatcagaagttccctcatggcaaggtgcaatccctcatgcctgtaatcccagcactttgggaggccaaggcaggcaggttacctgaggccaggagttagaaaacaacctgggaaacatagtgagacccgacctctacaaaaacaatttcttaaaattagccaggcatggtggtgctagcctgtaatcccagctatttaggatgcttaggcaggaggattgcttgagcccggggatttgaggctgcagtgagccatcattgtgccacaatactccagcctgagtgatagaaaaaaaaaaaaaaagtgtctttgttatattccaaacttgttctcaactttcaggtgagctggcttcctgtataactcttgtataggacagaacatactggttggggcaagtgaaactgtctagttgtatgcctcataaattaatgaatttcctttctaatatatacactgatatttatacacacatacacataaaaccaagctcaatagatgggtagtgcagctctattccccaaaacccaactaccctgtaacaagacacattagacttttgagattgcaaggatgaggactgaaatgctggcctagaccatggtgttgccatagtggggtgaccagtctgaatagccaacaatgcttcctcagtaaatacccattttgtcttggtgggatttctataaattgcaaaatgcagctattatgaagctgtaaaagagaaacagaaacatgtaacacctgggactgttttattaggcccaccgtatgctcagaacatgaaatctccactgctagggttatttgattgaaattatcttttgtgttgatgtgagagtttagctctgagattcttccacatgtaaaatgtaatcccccaaagtatttggcaagcacattttattgccttgggtcagataattgaaacattaggcatcatatatatagcatgtaaaaagtaaaacagaaacatttatgtttctcaccaagcagtaaattagtactcaactaataaatttcttaaactccctaataacagaatatggaaacaaaaaataaatctttccaaaagaagagctcatggacacatttcctcatatatgtatacataatatagtagaacacatgataaataacctataaaaatgataccaatatcattcatcaagagacgaggctcttctttaaattattaatttcatctgttacaggttttattatgactgtagtatgctgttttcatctaccttttatgtgtagttaaaaaaatagttttctatctctttacctttatttcagcctttaaaaagattccattattttttcattaatcttgtttttcagtttttcccattttttcttttaaacatttcttaaggaaccatatttaagattttatagaatacttagatttctagttgggatgtatcatttaaaattagatatgtagagagagtgttatgatatatttccttacgatatattagtggttatagtacctaaatttgaatagtgattctgttcattcattcattcattcattcaatattcacttccaggagattggggacttatttaaagacagagtagttcacattatagttcctttttttagtccttcttattcgttaaagaaaagactaggaaatgtttgttattacaaatattttattaaaattttgtgtgctctagcattattttaccttttaaaatcaatatgttaaaaatccaacttctttttgagctccccataaaaagggaattatttgttgcttatgggtttaacttgtgttatttttttcttaatggctaattatcatacatatattctattattgtattgatattactgatcatttgtgctacattaaaaattctgtagacagacctcttttcaagtacaaaacctcaagaagaacagaagacgagtctggtagcaaaaaataaaatatgcacactttcacagtctatggccatcacatactctttattccaagaaaagaagatgcctttggtaagtgtgactttcatgttacagggaatttttttagtttacttaaacttgtgttttatcagctttttagtattaaagttctgacttgggatcaatttcctccaaccctacaataaatctcagtttatctttaattttaaaagagaatgttgttttctttttctgttaagcctccctgttaagtaatagcagcaagtttagtttggccatgaatatcttctagagattgtatcggggtactgataaacacatttgtagctcagggatactgcatcagccatattttaaaatgggactaacagtttaaaaactataaatattcacagtgttaagaaacaatctcaagatgcattaagaaaaaggaaggtgcaaaacagaaaaacaaacgtaaacgtgtgtgcatatgcatgcttatatagtcacatattcttgtatgtgtacaaaaaatacacactggatctctgcaagcatagccaagcaactggaaatatgtttttaaaaacttgcttttcattctatctcttctagtactgttttgatgctctttgaaaacaatctaattgctgtaacaaatgaccatacgtaggccgggtgtggtggctcatgcctgtaatcccagcacttcgggaggctgaggcaggcagatcatttgaggccagggatttgagaccagttggacaacatagggagaccctgtctttactaaaaatacaaaaattagctgggcgtagtgacgcatgcctgtaatcccagatacttgggaggcggagacatgggacttgcatgaacccaggaggcagaggttgcagtgagctgagattgcgacactgcattccaacctgggcgaccgagcaagactcggtctccaaaaaaaaaaaaaaaaaagaccatatgtaatgtttcttcattgttctaagataaatctttaaggctgttgaggttttttgtatacaaaatggagagtaagttttaatgggatgggacaaaatgaggcttacagttgagtttaatttgagttcacatcctgttgacattaagttgatttggaacaagtgatatggtccaatgcctgcttttctattgtctgtggttccatccactagtgcctgtgttacacacctcttgttcaggttttatcatttaaaataaataagaataaacagtccatagcttatcttacttactgaataaatgctctaatttgacagtcatgtttcttaaagttccttacaaaggccattgcccaagaaaccaaataattccattatactatttttgaaatagaacacataataaatgggaattttaagttcagtttcttatgtaaacaataacttctatgtacatgttaaatatgcctgtatatacctaatttgaccatgtatgtatagtagaaatgaaaacagttactaagaaaatttgttattggctccaaattttctgaattaagtgtattctaatgctcagccataatatggggtttcatgtgttagtttatgtattcatggttaaaaatgtgaagactgttatatcttcatttgtgtcttttggtattatttggttgtattttattgtgtgatatggtggtataattatccttacctcccaggagtttgagagggtcttgccagttaaccgcagaattaaacatgcttaggactaattaatcaggagcaatactacaattagttggaggtaatttgaaacctggtttcaaataaccctgatattatgcacacatggtgcacacttttctagtagacatttaatgaaagtaatttaaaacctacctttgaaggatgaaaaacattgccttaaatgctctattctgtgaaagtatcaacatttatgcaaatacagtctaaattcagactttgaaaatgtattgaaagagaggatcatgaaataagttagagctgagtgacaaagctttctgagtgtttaaaagaatgttttacctaataaatatctgaaatgtatttggagccacatttgtttaaagaactgtataaatatgtagcactgttcatgtgaagttcaatagtaggaaaatgctgacagcccttgtggaactgtggttattattattttatgaatagagccaatttcaaacacctattagagtcttctcaggaacattttatagaatgcatctggagccttatgttatctctaagcattttaggatttgtcttcttggaaattcatgtaaccaaaccaccatgtgttatttcaagtgtatatagtattgggttacagtttactatgttttcagaaggttgtgacaactattagacttacagagaatgacttctctgccactaacggctttctaaagtgaatagagaggggcgaggattgaattcttcggtaaagctgggtgattttgttttattcaatacagtataataagtataaaaagtagaacctatagagagctataatgggggtagttttaaagaaattctgaaaatgaaaaacttaagtaaaggtttagttcattgtttatttcacactgagcatttactacctgaatgttttggacattttatttccatgactggagtggacacttttacaactcactgggttctttgctgatctttctctagaagagcatagctgagagcaggattctgcctctcatgacaattggcatgcacttatcccaagcggtgaaagctggctgcccccttgatttggagcgagcaggcctgactccagaggttcagaagattattgctgatgttatccgaaaccctcccgtcaactcaggtgagaggcatggcctagctctgcacccttaatgacttgatgaagtaaacaagcaatccactatatttttcactgttaacagcattaatcctttatgctattatgaaaaccttacttttgtgattctttttcttgttttaggaaaacaatctttcttcccattatcactcagaggaaagtatactgagaaatttttttgttttgttttgttttttgagacagagtcttgctctcttgtctaggctggagtgcagtggcgtgatcttggctcgctgcaacctctatctcccaggttcaagtgattctcttgcctcagcttcctgagtagctgggactacaggcgtgtgccaccatgcccagctattttttgtattttttgatagagacagggttttccatgttggctaggcaggtctcgaactcctgacctctgatgatccgcccacctcagcctcccaaagtgctgcgattacaggtgtgagccatggcacctggccaatacactgagaaatttttattttccttttcagcttaaggttacaacttccccaccatccaaaacgtgcactttcattttttttctaatttctatctcatcacttgcaaaaaccatatttttctccacattcattcccagtagcttcctgactcctagttcttccctaaatccttctgagtccttgtcattggtttcgcttgagtagcctttctaatcaacacagtcattggtatcagttactgtgacatggaagggacagaccaagttctgtgggccgctacgtagaaggatttcctgtcactttgctgcagaacctcagctcgcggagagcaagcccctttgcttgccctgtagaaatattttaaattattatcctttttttttttaacagaagtaaataggagatacgttagaggattttctctcctagatgtgtaaatacaaacttggggtcttataactcaataaatctgataaatttcttttgactgttaggatagagcagtggccataccaatagcctcatctccaaagctgcagtgaagatactttttactaccttaaagtctttcccatttgtgaacaacttgtgaacaattccccccaagaatttggaagatcactctctgaaagcacagtcaatactgtacttaaatggatctgagcaaaaataagtcacttagaagacaggattatttctagacttgagtgtgacttgactgaaggtctaaagaacaaacagctccttcacttccattgatcacggtggaagcacagggaaaggacagacacggaggcaagttggagtagtgctcatctaagttccagggatgcgggggagtggccaggggacttcaggtatagtaaataaataacctatttataagttatgtcaatgtcatgtttgaaatagaaaaccaaatactgcatgttcttacttacaagcaggagctaaagttggtgcatatggatataaaaatgagaacaggccgggcgtggtggcttgtgtctgtaatcccagcactttgggagacctagatggaaggattgcttgagctcaggagttcaagaccagcctgagcaacatagtgtgacccccatctctacaaaaaataagaaaattagccagacgtggtggcatatacctatagtctcagctacttgggagtctgagtcaggaggagtgcttgagctcaggagtttggggttataataagctgtgatcatgccactgtgctccagcctgagtgacacccagagtgagaacctgtctcaaaaggagaaaaaaaaaaaagtaacagtagacgctggggactactgaggggagggaaggaacaatggttgaaaaggtgggaagggacagtggttgaaaaactacgtgttgggtactatgctcactatctgggtgatgggatcaattgtacctcaaacctcagcatcctgcaatatactaatgttacaaacctgcccatgtactacctgaatctaaagtaaaagttataatttaaaaaaattataataaaatcagaaaataaaggtctgagatggaaaattaaaagaccaaagccacccataagcacaataaatccctccccccaaaaaattatatctattaaaaaaaggtgttgcgccaggcactgtggctcatgcctataatcctagcactttgggaggccaagacgggcagatgacttgacttgaggtcaggagttcaagaccagcctggccaacatggtgaaaccctgtctctactgaaaatacaaaaattagccagcagtggtggcatgcgcctgtaatcccagctactcaggagactgaggcaggagaatcgcttgaactggggaggcggaggttgcagtgagccgagatcatgccactgcacttcagcctgggtgacagagtgagactctgtctcaaaaaaaaaaaaaaaaaaagaccttgtaccctgacaagttttagtttgtgcaggaatgctagaatgactcaagattggaaaaatctttaaatgttaattacacaataagggtaaaaggagaaaaattacctaatgtcatctgagcaacaagaagaagaaatgaaaggcattaaaaattgggaaaaatttatatttgacagtatcttaacaacgaattctgcttctatatcacttcctagctttctgatgataacttcccgtgcagatctgtatgtaaggaatggacgtagtagtcatgctaatctgagtatttatctgtgtgatacttacgaattaacgatgtaagttaataagttagcatttcgtgaacctggttaataccatttgctaaggttaaattagccaaatcctgaagtaagctgtaaaacatccaaggtagggtagagaggcatcttatgagaaagctggccaactctcctggtcaccttctaatcttcctaacttcagaaatcaaggcagagagaggaaaatagtaattactttgtaggattagatttatggttgtcgaaacctttgtttctccagtgcagaatgagatagcgttttagggaaagccaaagactcagatgtcttcttcatgctcatcgtgtggaatttttcttcctttagaaatgtattgtctctcagggcttaaagcaatttgcatctttcgatgagacattgagtaataggcaatattctctgaaataatttgtgcaggctgggcacagtggctcacacctgtaatcccagcactttgggaggccgaggcgggcaggtcactgaggtcaggtgttggagacgagcctgaccaacatggtgaaaccccgtctctactaaaaataccaaaattagctgggcttggtggcacacacctgtaatcccagctacttgggaggctgaggcaggagaattgcttgaacccccatgggaggtggaggttgtggtgagccaagattgtgtcattgtactacagtctggacaacagagtgagactctgtctcaaaaaaaaaaaaatagaatttgtgcagttccccccacccccttttttttttctgttggcatttttgctatcatttagctgccttctttatatcctgaaacttacaggtggtgttggtctagtcagtaagagcaaaggctttgggaatagatagatctgtatttagaccttggctctagcatctcattgttatgtgacctccatcaagtgacctaatttccctaatattcaatttcctcatctctaagacagggagttaatattgcctctcttatagaattgtgagaaatatagtcatgtgtcgcttgatgatggggatgaattctgagaaatgtgttgttgggcgatttcattttgtgggaacctcacagggtggacttaaacaaacctagatggtatggcctactacacacctaggctgtacggtatagctcctgtcttcaaacctgtacagcatgtgactttactgaacactgtaggcaattataacacagtggtatttgtatatataaacatagtgaaacatagaaaaggcccagtagaaatacagtgtaaaagattttttaaaaaagctgggcatggtggctcacgcctgtaatcccagcactttgggaggccgaggcaggcagatcacttgaggtcaggagttcaagaccagcctggccaacatgatgaaactccgtttctactaaaagtacaaaaattagctgggcgtggtgttgggtgcctgtaatcccagctactcaggaggctgaggcaggagaattgcttgaacccaggaggtggaggttgcagtgagtcaagattgtgccactgcacttcagcctgggagacagagcgagactctgtctcaaaaaaaaaaaaaaaaaagagataaaaaggtacatctgtacagggcacttaccacgaatggagcttgcaccctgggagttgctctgggtaagtcagtgagtgagcggtgagtgaatgtgaagacctaggactgtgcactgctgtagactttataaaccctgtgcacttaggccacactcacccctgtgatacgagtctacctactgtataacgtacctgcatatgtacccttgaaactaaaacaaaagttaaaaaatttatcttcttttgccaataataaattaaccttagcttactgtaatgattcttctttatgaattaaaatctttttactcttttgtaataacacttggcttaaaacacaaacatattgtacagctatacaaatatattttctttatatccttcttctctaagattttttctgtttttgattttgttaaatttgtttttactttttacattttttttgttaaaaaccaagacaaaaacccacacatcagcctaggcctacatgggctcaggatcatcagtctcactatcttccacctccacatcttgtcccaccaggtcttcaggggcagtcatatgcatggggctgtcatctcctgtgataacaatgccttcttctggacacctccagaagggcctgcgtgttttacagtgaacttctaaaaaataataaaatgtatagtatagcaaacacataaacatagtaacatagtcatttattatcattttcaagtattatatactgtacataattgtacatgctagacttttacacagctggcagcaaggtgagtttgtttacaccattaccaccacaaacacatgggtgatgctttgcattgtgatgttacgatggcatgatgtcactaggtggtaggaacttttcagctccatgataatctaatggatacttgttcctgttggctgcccgtcgttgactgcaacatcattatgtggtgcatgactgtaaattagatactgttcagaaagctttggcacactggtaatagcaaatggtggtggcaaatatgatgatgatgatgatgatgattgaagacatagatggtaaaattttatggtgtcttaaaagtaccctctaaatatgattatttttatagtctgtccttttgaataggcacttaagaatgtatgaacttaataagtatataagaaagaatgttccccaaaatatatcttacagaggcatacaatttaagaattcaaacaggttgtaatggggtgtgtgtgtgtgtgcacacgcgcacgcatgcgtgctcattcacactaaagaattcttgggcatatgttcctgaatgtcctaaatggacattctaacatcacttcattatgggcagagggaaatggtaaagaaaaatttcatattatattattcagccacatattgacagcatctgttttatttgcctatggtaaagaattgaagcactgttaatttgctttttaaatcatgtaggcacaaagttatcgaactttagatttagaaatgaaactggaaatcattacactttccctttcctatccccaccctgttttggagagaaagagtgtgaggcttagagagttataaaactgttttaataccatgtctaagattaataactgaacaagtttctctttttactcgtgttaaagttgtactgccaattaacttaaaagaaagaaatatgcaatttctaatcctgatataggatatgggtatataaactctaacttgatgagtgaaacaaattaacttatttataatcagtttcatatctttatttattgagtgtctttaaataccccttacctttaaagtaagaaatattaaaatcaagcagaatataataatgaaaaattcttaagatatacttactaaaaacttatccttcggttaatacactgtatgtaggttgtacatacaatatgaaaaagtatatttttgtagcctacttttaaatccagaatagaggaggttaagaaggttgtgataaccatgagctcttttttttttttttttgagacaaggtcttactctgtttcccaggctggagtgccgtggcacaatcatagcttactgcagccttgaactcttgggctcaagcaagccttccacttcagccttccaagtagctgggaccacacctggctaatttttaagtatttttgtagagatgagttctcactacattgcccaggctagtcttgaacccctagccttaagcgatcctcccacctcagcctgcctaagtgctgggattacaggtgtgagccactgagcccagccctcttttatttcttttgatagtacactcataatcattaaactatcatttctggatgtgagattgtgcttttggattcttattttttctttataaaatactttttgttctcttactggagaaaacattgttggattataaatgatataacaaggaatgaggatatacatactataataacgattcagatatgttattttcatattttatttaactgtagccatgccacaataatttagagttttaaagaacaagtttgattgaaatctaaactttgtacaatcctgaattgagaagtttcctgtattttattatgacacaatatttacctaaaaatagagtaattatgaattgagaaaacatagctattaatttcatactcttatttgttaagtagattttgtctggaaaactgttcatatttaaaggagctttgtacctttgtattctttttgtttttccttgtttatataattttaaactctgtttatggatttgggattctaactatgctaaataataaattaaggcattgaatgaagtacctagacagtattttgattaattttattcccccattcttaatgtgcatgtaactggaaaattaagagtggcttccaagggatctactacaaaagtaaggttaatatgatctcttttaaaacactgaaggcgtgtagccagtgttgtcattaattctgcagtagatattttcagcacttatttacatgggaagttagagcagagtaagatgcacctgtaaagctaaatgccacttatttgcatatatataaaacgcaggatgaatttaccatagaaatataaagggtacttatagaaatgtattagaaaaatatatgaatttttaacttatatctagaagttaactttatacatttaactttaaatcattaatagtggtttaacaccataagcggatgtttatgcatcatcattttatgaacaaaagacattctaattttagaaataaagtgattcaaaagagaataaaatatcttactttttcttttaaaattaatttgtttagcgcattacatgataatagctcaagcttgtgtgatttttccctaaaaaattggtttataaatattacatttatagtatgaagaaattaatcatacatagtttatttatctaatttctaaatacccatggaagaaaatgaatttaatggaatgtagttgtgtattacttggtttcgagtgtgggaaaatttatatggtctttctaaaacagcactgtcagtagaaatacaatgtgagctacatatgcaattttaaattttctagtagccacattttaaaaagtaaatggatgcaatttattttgataatataatttaattagtctactatatttaaaattttatcatttcaacatgtaatcaatatgaaaattattaatgagatattttacatacttttttctgtaataagcctttgtaatcaggtatgtactttatatatacaacaaatcttctgatgctaaattttaactggaaatacttgatctgtgtttagcttttgtaaaatttactgttgaacaacgtggactaatgtgcctaagtggttccaaacatattttaaaatttgaagacaaataaaagggaactcaaagtaaattgggatacatacatacaacagaatactgagccattaaaaaatgatgaaatagtaaaattgggggaattttgatgatactaggatgatataatgaccaagagacaaatacaattttagtttggttgagagatgtgatcatcacgttgctgattttactatgtatagaggttatcttttcctttctaagattttgaaactttaattagttaacccacttacctagtttctattagctgtgtaactttctcttcctgttttttgttttgttttgttttgttttttgctttttaactgcagtattttgaggagtcttggagtagcaagctaatctttggaagaaaggaaaatataaacctgaaaactaacaatttaaagaacgtcttttcaggttgtcatttgaaaaatacttgatttctgatcactgatttgaattgagtgtcaaatatttgatatgttttgtaaattaggtgaagatgagtgagtaggttctaaactgcttgggtttaccgcactctggagcattgcagaagaatgtgatgttggaaggaagtgctgaaacataattattggcttgcctataggagggtgctacataattttagaaggtgtcaagaaattgacacagtctgaattagttctgttgagttgcaaaaaatgtaaagtttcttgattctgaaaataagaaatatgttcccagaaatctcatctagttaatgtgcttttaaaatcattgatgtctcttgttattacaataatagccattgaaagaatcttttttattagaatgttatttacaggtacgattagcttctatttaaataaattatttttatacttgatcttaggcaaaaggccaacaagtgatcagaataaattattttaagagaaaactaattataattgatatttggaattggaagcacaatttcctttagaacaattccacgaatggttgttttgattctcaaggcagcccacaaaagacagtttgaaacacaatttatgcagtgtcaatagtactgacctgactttggatcttggaggcaggggcttcaggtgatacccgagtggagtttttactccatttccattccgtaaggctataggcatttgaaagaggaaacttttctttggcaaccttccaccttcctttctacagaatatttcagtatttctagctcataggttttctaaaatattctctgtaatttattttgaaatggagtttttttatcgtttacagatatgagtaaaattagcctaatcagaatgttagttcctgaaaacattgacacgtaccttatccacatggcaattgagatccttaaacatggtcctgacagcggacttcaaccttcatgtgatgtcaacaaaaggagatgttttcccggttctgaagagatctgttcaagttctaagagaagcaaggaagaagtaggcatcaatactgaggtattaattatatatagaattttcataaagtgtcagtttgttcaatttgcatatcctagtactagaatgctgtatttttttgaactgttatgaattctgatatgattactttctctatgtgctacatttcctttgcttttcataaatatgatctgagaaaagtgattaaaaaaaagacagtaaaagggaggtttagtccatctgtttagcttattatgtagaatgtcagcttaaattttacctgtacctcatattgaccgtatagcctggaaaatctttcggaggtatagttaatggatttaagcatatggcagtttatgtagttaatgaaagtgaaaacaaattgtattataaatacctcccaaactggtttattatcattctatcattcttcatgctctgttagtatgatattgaatatctgaggtaccaggattattgttgcttgtggctctgagcatttcgtagtgcttttgcatgatgagagaaagattacaaatttagtattatgttagatggtacgttttattaaaatcaaatgcttcaaaaataattgctctgtgtatggcatgagataaatagcaatcagatatattgtttaataatatgactctattaaatgatggcataaatttgaaaatttgaccttcggtatcttccgggtctaaaattatatgactccattataaatattttggaaatgattaactaaaaaattgtttcaattcttagttggtaaattcaatgtggtagtaggtggtggtgattattttgtattagagaattaggaattacacttagttctaaggtaatctttataggatgtccagcaattaaacccctacttttttgaattgcttaaaaataagggaactgatctttttaaattctgtacttgagttacgtctgtatatatagtcatgtcctagataatctaatggaacttaattagttggaaatctttatattgtttataactgaactagctataagaggaacattaaagaaaacatattttgagtggaggtaatgaaatttagcttctaatgctcagccttttatttctgtaatctataccagatacctaagaccctcttattgtttcccagcttcaacctgtcagtatagaaaacggtgtaacttactattttttctcaatattgaagcacatttgtagtgaaatattattttaactatatattgccatttttgctttttccctatttcagtaacatttttcgctatttcagtaacattacatgtcaacaagagaatggtgggtattttggggggggttgggtggggagaaattttactaagcttgctagattctaaaaggtataccttatttggccccttttccccatttaggggaacaagggtgttggggctgggaagtagataagaggtgagtaagtcatccaaagcatatgtcttcattagcctccctgtatgaaaagctgatttctgtagagtgttggaggcctactttcagaatctgtcatatgttaacattcatcttctctactgacctgatttatatcccttagtctatttcattttataattatgacaaaggataaagtcattagaacaaattctttttattagttgacgtattgttgtgtttatatctcttgtgtttgttattaagatggaagctcaatcatgtccttgtttaacagaaaggtgatgtcttggcattgataattctgattcaatatccataggtacatggtggattctttaaatatttagtattcttttatttctggaaagttttcttaaatgatagtttttttaaaatttcatttctataaagttttcttaaatcatactttttagtgttttattccattacttcatatttcttcttcaggaactcctgctatacatgtatgttggatcttcattacccagcttcaatatttttcacttttcatgcattctttttatttcttcatttctctttaaatttttttcttccttttcaccttctatttctcttttaacataattgtatttatttctgtattccacatagcttagtattcacttattttaaaattattttaaaacgttttttagatttaaaaattctttttttatttatatatacatattttatttttaccaaaggagcaacactattaactgaagacttctataatttttttcttttatttctgattctttcttcggttttccccctcagttttgaacttttctaattttgatttgtgatgtccttttgtattttagataattttcctaatgttttccagctcatttggaaaggctacagttttattctgtacctaagcaagtctttctggtgtcaaagatttgaccttgatacttttcttttgctcattttcgtatgagattagttttcctgtactttcaaaagaaggcgtggttcaagatggctttcccaatttcacatctgtctctaatgtttttgtgtaatgtctaaaatatggaaacttggtttatgagatctactctgccatttttatctgggctttctcttccttttgtctctgttgtacctgtcctgcttggttttgatttaaccccagtggtttctcctgaatgtggagccttctcctagaaggcagcctcggctagtcccagggttcagagtagccagctgctctcttcacctaagagaccactgtggattccttgtactcacttgctattggcttggacaaaagccctcccattttcagatgctattatcagattaatctctcattaatctgtctttccagtgtatgcctgtgggctatcttggggttctcttgttatcagacacctccctgctggcctctgctttctcccgtacagatgtcagtactgtgcaggtcttaattgctgttggtggtttgcccctacattcttacagttttagtttcccaaggatacctttaaacttggttttattgtaaatgtcgacaatggattttgggttttactatctagttctgtcttaattctggaattcagaaagattaaaagctctgttgttgcagctgctgccacctcttcccagtaccctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatcaggctcggtaactaaatatatggattgatcttgtttataaatgaaattaaatgtgaatgtaacttacatatttctgtatttgcttacatccgtatgtacacatataatcagcaaatgagttgatgtttcctattcgtaacttaatggtaatagcttggtaacagagttgggagtattaaaaagatgtaaagagccccttaaaattttgttgctgggaattttagtgttctactgatgaaggaaatagacactggaaggcgttgtttctattaggtaacttagatatcatactgaagacttcaaatacttattgttgacactcaaaagacacacttagtgtaagtaagcatttccccgcttttcccaatgaaataagatcattattataattccattataaatgctgatgatcatatttatagaaatatagaagataagacttgaaatgatattcgctaccaattaatgagtttgaagaagaaatcaggatgtgttttgctattttacatttattcttatttaactccaaagaattcagtgatgttatgtactattatttccatttctctgtgaagacgttgaagcttaagtaacacgcataataaggtcatacatttagcaagtggctcaattaaagttcaaacctggttctgcctggtttcaaagtctgtgctactccatggtattaggctacaacatgacttagggtttcttcctctgctctattgctgttcagatgtactcctcttttggcagagtgggagaaaatttttgcaatctatgcatctgacaaaggcccaatatccagaatctacaaggaacctaaacaaatttacaagaaaaaaaaaaaaacattaaaaagtgggcaaaggacttgatcagacacatctcaaaagaagacatttatgtagccaacaaacatatgaagaaaagctcaacatcactgatcattagaaagatgcaaaatgccttttctgtatgccaccttatatccccagtatttattatttctaagtcatagtatcttacagtgtatataagtctcatccgttcttttgattttctcttccctgcttgcaattgggtacctaggaacaaagttgcaatcttagccagttttttctttagcctttgctgatgtgtgaaaagcccttttttctaccctggatttctgtacttaagctggaacagctaagtttttaccttttttaaatataaagtttcagagtcttctgccaaggatcttttgctgttttcctactgttaaatatttcaaagccttttttaaacatagggaatataatcaaacatagcaagcagctgatgaacaatatctagatagtcttcattattgaaatggaataaatggtatttttgtattttaggctaacagacaccttgtaccttagataaggccaaccttctcataaaatccctcagttacttttattaataataaccaaattaactctggattccagggtgtactcatgatggaatgatttctctgtcatgttatcctgaggatctagtactctgagataacataagtgtatgacactttaggcttatgaaacacttagctacttaaattatttaattttttttcatgtgcagatggtattgtacccaaacactacctttgtgtgtgtgtgtgtgtgtgcctgtgtgtgtgtttttgagacagggtcttactctgctcaggctggagtgcagtggcgtgattatagctcactacagccttgacctcctgggctccagtgatcctgccaaagtgttgggattgcaggcgtgagccacctcacccagccttaaattatttttttttcaaggatgtttaacctgagggttagaggctctttggcacgtgagctgctgaaatgtgtgtgaaagtgttgtgcacgtgtatgtttctctttttttctgggaagtggatctgtagtgattcttagatgagtctatgagacaagaaacttttatttttttcatttatttagcgaatgtttgttaagcgtactatgccttggccactctacagggtgctgattggaccagtctgtctacctaccgttgtagatgttagaagctatattcttttcacatgcctaatataactctttgtgtatgtatacatgcccaggcatgttccttcctcagaacattaaattcaccattttggtcaactcaaagcaagtacaccatgggacacagatctgaaataatgtccagatttttacttactgaatgaggtgtgttgagtgtataagactacatgatgagatggcaagtaattgcctgaagaaatgatgtagtgattttgtgtgtcttatatttatttactttttgatccagaaataaattatatagataccactattttgtttggatgggggagaaaggatgggtgtgtattcaggaacttatgttacttttttgcaactaataccccttctcagtagtacaaagatttgatttctttttctttctatttcctacagacttcatctgcagagagaaagagacgattacctgtgtggtttgccaaaggaagtgataccagcaagaaattaatggacaaaacgaaaaggggaggtctttttagttaagctggcaattaccagaacaattatgtttcttgctgtattataagaggatagctatattttatttctgaagagtaaggagtagtattttggcttaaaaatcattctaattacaaagttcactgtttattgaagaactggcatcttaaatcagccttccgcaattcatgtagtttctgggtcttctgggagcctacgtgagtacatcacctaacagaatattaaattagacttcctgtaagattgctttaagaaactgttactgtcctgttttctaatctctttattaaaacagtgtatttggaaaatgttatgtgctctgatttgatatagataacagattagtagttacatggtaattatgtgatataaaatattcatatattatcaaaattctgttttgtaaatgtaagaaagcatagttattttacaaattgtttttactgtcttttgaagaagttcttaaatacgttgttaaatggtattagttgaccagggcagtgaaaatgaaaccgcattttgggtgccattaaatagggaaaaaacatgtaaaaaatgtaaaatggagaccaattgcactaggcaagtgtatattttgtattttatatacaatttctattatttttcaagtaataaaacaatgtttttcatactgaatattatatatatattttttagctttcatttacttaattattttaagtacctttatttttccaggatgtcagaatttgattctaatctctcttatgtagcacatgtgacttaatttaaaacctatactgtgacacagagttgggtaaacgatgattatttaactttaagcagttcaccatccatttcaaagcctttgattggcttttttgtaaataaaaataacttgttaagaaacaaatatatctgtcatagaagaactagaaaatccagggaagtgagaaaaatgaaaataaaaatcattcatagttttactagtagctaatcacagtcaacctcttttgtgtatcccaccagacttttttatattcatttgtttttagttaaaatataaaagtctcgtatattcccatttttctgcattgcattaccagaaggtagtggcgcctattaaatatgtgatatgttgttgtccagccatggcttctgcatttgcatgcttttgtgtgtgcatctgcaataccctgtgaatatcctgtgtgatggagtggcaagtacgcacagacacgtctgctgcatgcctaggtacgaggctgtctccaggagaagcacttgtttgattatttgagttgccaattgaatttgctgctttttttcatggcttgccattttcactgaaaagaatgactaatgaaaaacgatgattggttattagatttggatgtttggcagacattttctcaaaattgaactaagttggcctcttcacggaaaacaactggtatttgttgtgccaatgataaaattggagatttctagcaaaatgtataattttggaaaagttgtgttcctccactggaagcttgacagctttccttaacataaagacttctctttctcttcgctttcactactactactactaattcttcttctgattcttcttcttctccttcttccttcttccttccttcctcctcctcctccttcttcttcctcttcctcttcttctttctctctttccttccttcccttcccttccccttccttccttccttccttccttcctccctccctccctccctccctccctccctcctttctttttctttctctttctttctttctttctctctctctctctctttctttctttttctttctctttttctttctttcaagcagtcctcccgcctcagtcccccaaaatagtgggattacaggtgtgagccaccatgcacagccttacataaagccttttctaatgagatggatagtaattaacaaatgtgagtttttgatattatataaagattttttctgtgtttcgaagatccgtataactcagtgaatcagtatgttctggatgactaatatgtgatgttaagaaatcatgactgaggccgggcgcggtggctcacgcctgtaatcccagcactttgggaggccgaggcgggcggatcacgagatcaggagatcgagaccaccctggccaacatggtgaaaccccgtctctactaaaaatacaaaaattagctgggtgtgttggtgcgtgcctataatcccagctactcgggaggctgaggcaggagaatcgcttgaactcaggaggcggagattgcagtgagctgagactgcgccactgcaccccagcctggcgacagagcaagactccgtctcaaaaataaaaaaagaaatcatgactgggtaaaagatctgttcagagtacaagatggaccaatggatttgatatatttgaatataacagagtatgaaaaagtttattgatatagtttcagattacacactgcaactaatctttaagaaactattacttgtccactttttggtaaaatttcagagaacaatgtccaccattatctgaacaggctattaaaatactcttctcttttccaactacgtgcctgtgcaaagtcagatttttttcatatacttcagccaaaacagcatatcaaaatggattgaatgcagaagtagatctgagaatacagccacttttgttaagccagacaatgagatttgcaaaatgtaaacaatgctgctgttctcagtttttaaaaatatgttttttaaaagtatttatgttaatgtgtacttggtttactactgctatttttaaataaaacaagaaacatttttaaatgtctgttttaatttctaaagtggtagtgatagatataacccatattaataaaagctctttggggtcctcagtgatttttttttaagagtatggaagggttctcagacctaagagattgagaaatgctgatgtaatgttttattataaaggtgtaccatgaattatgtaccttacttcatattgttggacattaaagttgctttcagtttttttgttttaaacagcactgctttgaccttttttaaaaaatgagtcagggtcttgctgtgttgcccaggttggagtgcagtggctattcacagacatgatcatagcatgctatagccttgaattcctgggctcatgtgatacttctgcttcagcctcctgagtagctgggactataggcgtgcaccactatgcccagctgctttgaacattcttgaaatgaaatatggtatagtctcataccatatcatagccagagggggagagagagaattttgttgttgttgttatgttatctgtagtggactttatgccttcccagcataaattctctctttccccatttttcgtgactcttgatttttgttggggttcgttccaaggagaataatttccatctggatattggattggcacctgtgacctcttctgagctagaccctagtaacagcgtttggatctggggtaggtgtgtggccaactgagctgctggttcatgcctttcctgaaatgagccctacctctgaatatttcagaaacatgggacattaacttccctttacttacgttaaacccctttgaatgaggagttgtttttcacttccagttgtgttcagttgtcacagaagcacagcgatgtgattggtggaaggacccgtcaacagacccagaagatgtaaagtgtttttaatctcaaaggatgtggaatctcagagatagttacaccgagtagaggatgaagcggctcctggatggaggcagaggcttcctggatcttcaagttctgtatgggttgttgtatgaggttggtgcaaaagtgaggcaggagaatagggtctggaggcaaggaaactaaggccgattcacactgacttcctagaactaaatcaaaaggaaaaccccaattttccagacctaaataacaaaagtaccagatggctcctccctttcaactgcccctcccccacacctttctgcgtggcacatggaaaattgaaagtatctctggttgcttctgcgtaggaatgtaactttgtaaccaatcagacggatcgcaggccaagtcgcctgcatagaaatgtaactttgtaacttcactttagcctctgattggttgctttccacaaccaatcagatgcttgcatagggtgtacctgttgtgacttcacaaagtggtggaagtggtggaagtggtggaagggtggaagggctatttaaatttttattcatcctctgattggttgtttcacttaagcctctaattggttcttgagtcctggagcctgtgaagggtactttattttcagtaaatgcatgctttttttgcttcattctttccttgctttgtgcattttgttcagttcttagttcaagacaccaagagcctggacaccctccactggtaacaaaagtaactggtgtttttgccattagaagtaatggcacagaacaagtacatgagagcgatttcttatggaaaattaaatggcgcataagtcgtgtgctcaggtaagggagctgggaaccggtagaggaaggtctccaacccacacccgtgggatctctgagtctttgaaagtccgtcctcaccctttgtgaagaatgggagcacggctggactcgtcaccgggggttttggggggctgaacttgtcatttgagggtgtagggaggttggatgaatcgcaggggtgcagggagggggcccactggagctccaccaggaccccagcaccctagatccaaacctggtcatgcttcccatgctcagaggcaaatctccctccccttggggggcggagtcagacgagaccccctctccatccttttccaggtccggcgggggcgggactttaaaggtaaaaacagcaattacttttgcaccaacttatcttctaagtttcgctccctaccacctgagtgtgtttggaggctctggctcattgtacctgcctgatcaccaggtgcaagtagctgggccagaaggacctcggcacgttacggaatatttactacaggaacaggtgagctgaaggcgaattccccaggtgtagcctgtgaccatagattcagacaaagccctgactgttgcctggaattcaaaaaagctgtagccctaccagatagaataagaaaagaatataggattcttcctattcaaataggttgcatataattaagagcatgaacgatccaatggaatgaactcaaagtagtttttgagtgtaatagacttgaagtgtcttatggaaaagaattgcaaaaccacagaaacagtgaagaaggttagttatagccttgatggggtagctgacttcagcagtctcagctatctgaaaagttatttaccagattttggttgggaacataatccctaaatcatttgagataatgtacttgtttccttactgggtaaatgtgtttaaaccttgagaaaatgtagacataagtagaatatagaataaattaaacctttggtagttatgttttaggattaaggactaataagtacatatttgatatttaagcatttgtaatgcttgagataatttatcctactcaagtaacagattactcttgtgactccaatgtaaaatatatcattgaaaaattagtatctgcttgtgatttttaagtagaaaccctgccatttgaaaggtatttgcctttattattggagatatttcatatgaatgtttaactttgttattgcatagaagtatttaaacagatttcacttgcaagagaaagatatctaataggttactcttaatcagtactaaattactacaattactatattctattaatatcgattcattaaaacccagagctttaattatgtctcagaaaattaattaaactttagcctcataatcagctttattttctaactcaatgtttaaaaattgacaagtatgtattatacttatttatgtcttcattcagtaaacatttgcatttgtagcatgcaagacaacatgctagacacacgaaagatggaataaatggaagaaaatgcaacacagatctcatgcttaagagggacagatttactctgaagattcaatgaaaaaacatccacaaacaacttttctacaagaaacaaaacattttaaagaaaacatttacttcagccgggcgcggtggcttacgcctgtaatcccagcactttgggagggcgaggcgggtgcatcacgaggtcagaagttcgaaaccagactggccagtatggtgaaactgtgtctctactaaaaatacaaaaattagcctggcgtggtggtgtgtgcctgtgatcccagctactcaggaggctgaggcaggagaatcgcttgaacctgggaggcagaggttgcagtgagctgagatcaggccattgtgctccagcctgggcaacagagcgagactccgactcaaaaaaaaaaaaaagaaaaaagaaaaaaagaaaacatttacttcacataataagatatgagaaaaaatggactctctgaatgaaaaaaagaggagatcatgtgaaagatttgcgctttttttttttttaaagttatggactgaaacactcctaatcattaacatttgttattttaggggagtggaattggaaaggtggaaagggctatttacatttttataatctccatgtcttttaaatcaatatatattgcatttattcttttagttaaaattttaagaactctataaaaaatagagacagggactccctttgttacccaggctggtctcaaactcctgggattaagtgatcctcccacctcaattagaagggtggaagggccagctgtttaagtttctataatctctgttaaatcaaatgtatattgcatttattattttaaattttaaaaacttttttaaaaatagagatgggatcttcctatgttgtccaggctggttgtgagctcctaggatcaagtgattctcccgccttgacctttcaaagagctgggattacaggcatgagccaccatgcccagcctatttatttgtttatttatttttagaggcagggtctcactctcactagactgaagtgcagtggtgtgatcatagctcactgcagtctcaaactcctggactcaagcaatcaactagcctcagcctctgagtactgagatgacaggcatgtgccttcatacccagctaatatttttgtagagatggggtcttcctgtgttgcccggaagagtctcaaactcttggcctcagcctcccaaagcactgggattgcaggcatgagccacaacacatggccctgcttttaaaaaatatatagtgggccaggctttctgggatgatgggcaaccattacatttgctttctctccattctgaatgtcagcctccatacacctctcttgagccatctcttgatgcccaggactggcaggcaagcaggatgttagggtgctggctggagggctggaaagccccagggcaaggatatgaacgtgaaggattttaaggagattcttggacctcaagggaacttttggtcctggtttcctagagtatgttagatcttcttggcccccaaagaatcaaggaaaagctgaataggtggaccgaatcctttccagcactgaggctgggagaactctatgacaccagtgggtgctcatcctggtgctgccatggacctgactacctacgtccgctaaactctccagcagctgagccttcaagagaagacgtcctccaccttttccatgagatgaagaatccttggggccaggggatgtgctcactagctcacacctgtctccatcctctagaccatgcttgcagtacacaggaccccagaatgcctggcccaaacactcgtgagcctccaggggctgcaggggcttctggccttgtttccccatctgatgagttcgtttcttggtctgaaagattgtgacagttactacgagactgaatgaagggggatgaatgcagaaatgaaaacttaagacaaaagtaacttttaatgagaggggccgagggaagaagaagagggctccctgcttctaatgagcaaaggcagccaccctgagcttctacagcccttcgtatttattgagtagaaagagcagggaggaggaggtaatgattggtcagctgctggattgatcacaggttcatattattgctaacaggcttcagatgtgcctgatcacaagaaacacttgcgcctgggcatgactgccctcagcattccttctgggcggcagatgcagtttgtcagtttgctaacaacctgctttcatgagaacagtttgctgcttacttacacagccaccagtgatttactgagttgatcacgaccctcactctttcggcctccaacaaaagacgatcaaagaatggttgtttgcagaggttatggacaagacttgatgtccaggccgagtgtccgtatgcacaggagcctcttggtggtgcagagtgaagccagaggaggaggagtgggttgtgtccatgggctgattctccctgcaccaacaggacagaatcctaaggaatccgagcatttgaaattcaaatctggtcttacaggttgttatgtatttgtctaggtaggaggctagaatgtattgaaatggggttagcctgacatatttatatatttcatatttaggcttccatttgttcctttgtcttgggtcccaaaaatatattagaggtgggcctgtctgttctcttggacacgaggacctcaacgagtttccactgttctctgaatgtttccttcctggttttctgtgtatacaataattcctagttttctgttatttacaattttacttccactttttaaagacaaaaatgtatgtttttttagtcaatattgatatagtggaccaatatattttaccgttatttttgcttactgtttttgtttttttgccttcctcatcttctcactaagtttgtctgactacagccacacaccattcattcaataccaactcttttttatttttattttttggagagagggtctcactctgtcacccaggctggagtgcagtggcatgatcttggttcactgcagtctcaaactcttggactcaaatgttcttcctgcctcagcctcctgagtagctgggaccacaggtgcacacgaccatgcctggctaattaaaaacaaaacaatttttttttttttagagacggggtctcactatgttgcctaggctggtttcaaactcctggggtcaagtgatccaataccaactcaacaggtggtgagacccagtggtctagacaaacagccacatagcaatatgtttttctccatgattcatatccatgttcgtttgttacaaaataacaggcatgaacattttcttcagagagggagatccccacttatccattaatgactcatttggtgtccattccaaactattaaactgcaaaagcagacatgagaaaagaaacttaagtcaatgtttttatcacatgttggtgccagcgtcccatagtggtgctaaatttatgaaattgcaacaaaacaaaaacccaaacaacccaacaacgaaaagctatttagtgaacaccgtgactaacaagcttattagaactgcttatcagagctatgtgtggattttgtagggggaaagattttcttccctcgtagacattttgcaaaataaaagtaaaatattacctttatgtacgtggtagatagaattccacaagcttcaaattcaacgactcaaaaatgttgcttttactttccatatctcagaagtcacttttattttatttattttttagagatagggtctcgctctgttgcccaagctggagttgcagtggcacaatcatagctcactgcagccttgaactcctgggctcaagcagtcctcttatctcagcatcctgagtagctgggactacaggcgcataccaccactcctagctgatttttaaattctgtgtagacataggatcttgctgtactgc

SEQ ID NO: 1279 - DNA, 20984 bp, Homo sapiens
aactgccttctgcttgctttgatggttatcaggcattcacccaacaatgcaacagagatggcactctcagacaatgcttttgtaacaaaaggttaatagtctacccagggagcccaaagtgactttacacccaagagaactgtcaggtatgtgctatgtagaccactgctacccaggaacatggctttcataggcaataaataagcaaagctcactgttcactcaagcaggctgagcccttgaaaggcaggctctgctgctcactcttggctaactgcaaagatggcaaatcttcatcctctgatgggaggcatgatttctgcaggtagtccgaaatcatttagcaaagcgtctaatgatggatcaaaatgaatttttgatgagactataaagtaacaaaactgacgtactgagaactggctcaaagtaatccaataaaaatcagtattactttttaattttttaatttttattttttaagacagagtctcattctgttgccaaggcaggaatgcagtgtcacgatctcagctcactgcaacctccacctcgtgggctcaaatgatcctccaaactcagctgggactataggcatgcaccatcatgcctggctaatttttatattttttttttatagagatgggctttgccatgttgcccaggctggtctcaaactcctggcctcaagggatctgcccacctcagcctcctaaagtcctcctaaagtgttggaattacaggcgttagccactgcacccagccaaaaatcagcattccattttaaactaatatattaataacaaggcattatttttatctatgatgtgcttgatataaaaaaatatgcaaagaaaatcaactctgatcccatcatgctgtatgagcaatttggtgtctttcacagctttgtcaaggcatcactgcaacaggcaggcagttacccaagcacacagcttcagaggtcaattctcactaacagtttggtatgtttctctagggggttaaaaaaaagtcaggggatcctgctcatcgtgtgagtcacactatgcaggggtatgaagggacagagaacaaggtatgtgtggaggtgtccgggagactggcagggggtggtgcagacagaacggtaacaagacattttgtctgggggctggtcgggcagggagtaattacagagtgccacaaaagccaggcctaaaccaacgagtcagggacagagacaacaaaggaactcctccttttccctcgtgtacagaatgaattcatggaggagagggactagattcaagaatagacggaggctgtggctgggcttggactgggcctagagagctttgttatttttattttttgagacagagtctcactctgttgcccaggctggagtgcagtggcacaatctctgctcactgcaacctctgcctcccagcttcaagcgattctcatgtctcagactcccaagtagctgggactacaggcgtgcaccaccatgcccggccaatttttgtacttttagtagagatagggtttcaccatgttggctagactggtctccaactcctgacctcaagtgatccacacacctcagcttcccaaagtgctgggattacaggtgtgagccactgcacctggcccggagtgtttttagacaggggttttcaaaccagtcccatctgatgagcgccacaggaattacggagggacgggccgaagggagggtaaatgagataaaacctgcagagtcgggtgggttgctgggtccccagccctacttcacctccagcagctcttttatgtttgacatactgagatttccagattttacttaacaggaactccactgttaaagtcagtagaattatagtaaataattccaaagttcatgagaaattagtcaccatggacactaccacaaacacccctgagagccactcttaaaatctggatcttaatttcttcaaaggtccagagagttgcaggggggaagaaacctcagggctcgaagtgtctcattcttctgatgcaattccatctgctcccaaaagtggggtgaggcagcgggcaggttagaattatgtcatgcatggattgttctcgtgcgtgacagggaatccaataggcttctacagctctcagaataagctcttccataaacaggaaagcccctgggcctgggagacgctctggtggcattagacacattagttatcaggaggcaggtcctaccttgctaaccagggcaggcgcaatagttttattgatgtgctcaacagcctttgagacacctggaaggaacaatcaaatcaaattactgacattaactttaaaacaggcttgagcagcattgttagagagaaccactgttgaggccgacgcggaagcccaccaagggaccttctgtgggacctcttccccctctcccctttccccccagaatcggaggactttccggcccagtctgagtgctcctacctaggaccccagagggttagagccacacaaaacagcagctggctcagaacgatctgactggaggttagtttgcaagaccatgcactggaaacgccaactgcagactaaaggctgttcaatcagttacctgagtgcacagggctggtgccaggaactcattaatatacttaatgggtctggagacgcctgcccagcagaggatgaagaaggaaaaatgagagagactcagaagagaaccggtgattaaggactgcgagtgagagacagtgagggggcaggaaagcagaggagagcatttcaggggccatgcgttcaatcttccacaaatgcttacttactgagcactcattaccatcaaggcacagcatcatcctgctccggctaagtccccacgtacgccattaaacaacggtcaaatggtaacatgttcgtgtgtgtagagtgcttcttacagcattaaagcgggactgaacacccagcaccaccactgcgacaccagcccagtgtttcacaacctgatttcatcattgtcccctccctgcagcctttttggagttttccgggtgccccactgagaatgcgtgatctagccctatgtgcttttctgtaatttggccacatgttctatctctagaaaggtcaatgttgcacacacactaagtcaatttgaatacagccagaggctagctctgccacagagcagggctcctatgagtcagtcaacaggaaaatcacactaaatgacacacctgcagctcaccattcagggcaggtcattggttagaccttccctggatcctttctagcccgtgaagaggctgatgatctctggagggcccacagaaccctcctgggagatggggaaacttttctttagttaacaggccctgttctcatgcttgggttcctgtcctaaccgtgaaggagtatttcgcagattgggaacaaactgcaatagaagcaagcattggaactctcgacccagagcatgcaggctcgggaaccccggaatccacacaccaactttcctgtccacaaggtggtgcactgcttccatcaacatcatgggtcacagcaggtttacctgccataaacctgcaagtgcaagtgccacccagagaggacaggactgggcaaggccaggaatggggctggaagcagggaggccatgggctgtgggttctaaggcttacccttccccatatagcgagtcttatcattgtcccggagctctagggcctcatagataccagttgaagcaccactgggcacagcagctctgaagagacctggatgagaggaaaaaagatgtagtagcaattcagaaatccagttccagcacaatcccaagtcccctcccgcccacagatgcatttgtcattagggagctgtttcttcctcctaccagctgtgtgaattaaacgctctgggctgttcttcatgcctttcacatgtttatgatcctgtactgcagaacttactgcaaagatgactaattcctctagcagaaagaaagtgttctacagcagagcctacatgccacctggaggtcttgttaaaatgtagattctgacccaggcaaatatgcatccctcacaagctcgcattggtgccctgtggattactccagcagcactgcccaagagaaatccaatgcgagccacacagggcattgaagacgttctggtactttttttttcttttgagacagaatctcgctctatcccccaggctagagtgtatggcgtgatcttggctcactgcaatctccacctcctgggttcaagcgattctcctgcatcaggctccccagcaactgggactacagcagcctgccaccacgcccggctagtttttttatttttagtaaagatggggtttcaccatgttggccaggctggtcttgaactcctgatctcaggtgatctgcccacctcggcctcccaaaatgctgggattacaggcatgagccaccatgcccagacaggtactatattgatgttaagcataaaattagggtaatttaactggctcaggaggagtatctagctcatttgtttcagtttggacaatgctaaatgctattttaggggttctatgcccaactggaaactggcaaacaggatggatgtggggggaaggaataaagataataaaatgcgcagtttaataaatgtaagaactgaaccaagtaatcttgcagatactgaaaccagccatctggtgaaacctatacctgtaacaagggcaatctttggtggaggcaaaagaacagatggtgtcaaggaagatgttgcagagaaaccaacaagatatttctagcaaaggacccagcagtgttccctgctgcactgcagtgtgcgctatcaacaggtcatacttccttcttgaaagctgccctggctccctacatatccaccctacactggatcaggcaaagacaagatgaaaacaagaggcttggagtctacagacttttggtgatgataacgtgttcacgcatgttgaccactctagtggggatgctgacaatgggggggctgcgcatgtgcagaggcagtgggtactcatgggtttatgtacctctgcaccttccgcctgcttctgctgtgaacctaaaactgctctaaaaaagttgatgagacagggagagagagagatgaaaggttctgagcaagtccatcatttcatgttttttgaaaaggattaagacacacaagagaaagttccattcatttcaatttcaaaatgtccaactcccaacaatcttctagcatctggggtcttttgttgcttaaagttcattaatatccaagtagaaagttccacccattgactaagcaaaccactcttactggatgaagggaattcttggcatcctgtgagaaccctcagggttccccataaagccagtgagaaaccccacagtgcttgagagcccacacagcaagcagccaactcaggcattcttttgcccaacgaagtcaggcctcaaggatcctttcttcctgagggggaggggaggtgcaaggggaagggaagggctggggttccactgctaggcctgtgactcacagatggtgactcagctccgactggcagttctctgtgagtttagcaccgctgagtgattctgcctgaagctcctttgccaacctcacccactctgtccatcgcgccatgtgctggaggtaacacagagctacaaaggcactggattttcttcttaaaggaaggagtttcacaattctctaatttttcataagaaaactcctcctatagggattgacagccaggtaaaaatgagagcctccagactattccaaagcctacaggtaaaaactgtccttgatccttgctgaagactgatttctagtcacagagataaaggtgctatattcacacctgctatccctccccttatcaagagataccatcctatcacactgtatcctgcatttggtcacagcaagctgtcagccaacaactagtgatgggcccctttagggacaaggtcttgtggtatcaccttacttccttacttcactgacttaggagccaacttatgtggttttaagccaaggagctggcaggatcaggcggggtggctcacacctataatgccggcactttgggaggcagaggcgggcagatcacctgagtgaggtcaggagttcgagaccagcctgaccaatatggtgaaacccccgtctctcccaaaaatgcaaaaattagccaggtgtggtggtgcacacctgtagtcccagctacttgggaggctgagacagaagaattgcttgaacctgggaggcagaggttgcagtaagctgaaatcatgccactgcactccagcctgggtgacagagcaagactccatctcaaaaaaaaaaaaaaaaaaaaaaagaaaaagaaaaagaaaaaaataagccgagaaacagcaagacactggctccatgcctaaaaattccccaaccctcacagtcaggaatcacaacctactagcatgtgcagacagaaagaaaagctttaacagattttttttttcctaaggctccagcatttgtagaaaatttttaaaatgaagcacggtggaaggaaccatggaaaccaaggaggtggcacataccttttgaggtgaagagatcaacctcaacagtgggattcccgcgagagtcaaagatctccctggcatggatcttgagaatagacatggtgaacttctgtagaagaaacacacagttcatgttttccataagccataatgctgcatttcctcactcattcaaggaatcacttccgaggttcgtggactagagagaatcagcactggactaaatactggatgtaggaaagctggctagggtggggggaaaagcctgctggaaagcagtgagaattctcctaattaagtagttagggcctagctgcggaaggccttaacctttttatgcctagtattccattactggaacgctaagggcgtgggagttacttttatccgactgctcaagtcattgccaaggtctgatttttcacaaaaaaagatttgcaacctctggcataaatgggttaaaccctagcaattgaggtcttgttctgtaagaaaaaagaaaaaaaaaaaaagagagagaaaaagcccacaaacgtgtgtgcccagggagaatcaaatccaaatagaaagatgaatgtgttgctcgacgcagagtggcccaggagctgtctgaaactggctattgtcatgagtgaacaatgagggctggcatgggaatggaaaggaaccaagaacagacatgaaggtcacaagcaaaaccacctagggccaaaaagagggtggcgggaccaggggaaaaccttgcttgtagcagaattaaaacaaaatagtgaatgaagtttggacataattcttcagattaatattcacttagtaggtatttgatcagaaattctgagtttggaagtcaggaacaatgaagtccttggaccgtgtgatcttggctactgccacttcctgggactttccaatttcacagtacttgggtcttcagtgttgttatgtcattaatgataacatctttattttattttagttacttttttaagagatggcggtctcactatgctgcccaggctgctctcaaactcctgggctcaagcgatcctcccctgccttggcctcccaaagcatgctaggatgattataggggtaagccaccaggaccagccaataatgacatctaattatttcttcccaacggggttttataatttgtaaatagaggaaagattctttgaacaccaggatacttcaagggaaggggcttcctttaacaccaccttaaaaaaaaaaatacaagaatttccagcaatgaacaacaaataccaattcctcaaagaaaaacccattcttacttttttccttggcgctctccaaagaaactaactgaacaacttatagaactgaggtgggtgagaggaacttagtgtttaaagccattatctacctgggctcccctccaacatcttctctggaatgtcctgaggtggcaagtggcaggtttttaactttcaaaattatttactgaagtcacttctgtggctttgttgtctatgtaacaatggagttttattcattagccaaaaaaaggtacttactttttactaggttccaaaaaggcaaatttgtttaaacatatttttagatttaattttgcgttttggcaaattatatacccgagtaacatttccatcactgcaaaaagttatctcaggccatttccagtcaatatccccctgccccatctccaggccaccactgtggtatactttgagtatttcagtcatacttttaaaggcaattttattagggtgcctcagtacttttgttttcattttagtgacttaagacgaaagaaagtcttggccgggcgcggtggctcacgcctgtaatcccagcactttgggaggccgaggagggtggatcacgaggtcaggagaggaggctgaggcagaagaatggtgtgaacccgggaggtggagcttgcagtgagtcgagatcgcgccactacactccagcctgggcgacagagagactccgtctcagaaaaaaaaaaaaagacaaacgtcttaggatgtgaaaataaagtgtgattttttttttattttttgagacggagtttcgctgttgtcgcccagactggagtgcaatggcgccattttggctcactgcaacctcagcctcctgtctcagcctcccgagtaggtgggattacaggcgcctgccattacgcccaggtgatttttttttttttttgagacggagtcgcgctctttcgcccaggctagagtgcagtgacacgatctcgactcactgcaggctccgcctccagagtagctgggactacaggcgcccaccaccacacccggctaattttttgtatttttagtagagatggggtttagtagagtaggatggtctcgatctcctgacctcgtgagccacccacctcggcctcccaaagtgctaggattacaggcgtgagccaccgcgcctggtcgatttttgtattttcagtagagacggggtttcaccacgttggtcaggctggtctctaactcccgacctcaggtgatcctgaggaggcccacctcggcatcccaaagtgctcggattacaggcgtgagccaccgcgcccggaccattcacagcttttttagctgcctggatggaaccccgaattagggacacggtaaatgaatggagcagtcagggcccgggtgggcctgaaaggcaagtgaagcaatggaccctaccgcccagagaagcgcacagagcaggggaacattgaacaggaagctttcttaaaatacatccttcttggcctagcgcggtggctcacgcctgtaatcccagcactttgggaggccgaggcgggcggatcacctgaggtcgggagctcaagaccagcctggccaacatggtgaaacaccgcctctactaaaacaacaacaacaacaaaaaaaaaacaaaattagccgggcgtggtggcgcatgcctgtaatcccagctactcgggaggctgaggtaggagaatcgcttgaacccaggaggccgaggttgcggtgaaccgagatccgagatcgcgcaattgcactccagcctgggcaacaatagcaaaactcaaaaaaaaaaaaaaaccaaatcagatcaggcccgatttttggtggccagccggggagccgctcttgcccaacttgggcgaggtcgcctggaggacttgccaatgatctaacggctctgctgtaggttcctcaagaggtgccttctcggagttaaatgagtcaccgcttactaggcagaagcgcgggccgcgagcgcgggcgagaggcgggggctaccggtgggggagggggccgcagcctcgtggccatctccactatcgccgccctcctccattttaggaagggcctggcctgagtggccaccgccgctaagtctgcgtctatcccaaaaaccttacacttggctacgatggaaaagcaacttccactcccaactcccgctgtgctaagcagctcgcgtgtgcagctcccgaccttccctgacagtgactcggccccgcagtcggtaatcacgtgttgatctgcactttcccctccaaagaaatcgggggcccagcacgtgcgcctggcattgcgcccccgccccgggcctcggggtgagcgggggcgccagttcccacccagggaggcggcttgcacgtgcccccgaccccgccacgctgggcctgcgggcgcgccgcctccctcggagggaaaagagccccacaagcccagaaaagccctgcgccgcctgcccgttgctcagcccttccccaatcattacctagccactgggtctcgtcgcctaggagaggaagcggagggtgctgcagacaccgaggtgaacgtaaagccggcgagatctccgtgctccgggtacccacagatactgtccgcgccgcccgcgccgacttcctgcctagctaaggcgagccccacccacttcccgcctccggggcacgccccctcagctccgcctcgccattcgtcgggagagccgtcactcattccctcacctcccggaaaggggtgggactgcgacggctgcagtagcgtggaaaggggggtgacgtcccgcggacttgaggcgggcagatctggggggccccgactccccagcggccctgtagtggtgcgggcgaaactctggccccagataggaccggtgagccgaactggggtgtgcggagccggggctccgggggatggcccggggcggcgtggcgggcatgagagctcggggctccgtcacgtactccgagtcccgcacgcactcagcgtcgctctggggccccacgtccggccctcgaccttgctgacaactttggcggcccgggcctgccgcggccctcctgccccgcccctcctgcctcgcgccgcgatccgagagaccccgttggcgtcgagtcgttgagaggctgcgcgcctcggccccactccggggttggggcgctggccccgccgcagcgctgcgtgtccggggccacgtgcgccgcctgcgcctgcgcgctgccctccagccgcgcccgtctggccgggctccgcctggcacccgccaaggtgaccctgtccctttctccttgctgcggtgagaatcaggccgagacagccaaaggaaggttcactttcctttaattctacctcatactttttgagtgccttctaggtgtccggcgcgcccccacgtgcttccccagtgttaattcattctctctctagtccatgtcatgttgcctctcaaattttacatccctctcattcccatctagggaactagatcaaacctacctggattcttgtgaaccattcatgtgaattatttggaactggaatttcacacagacccggggaatttctcaaagttcaagacgggtcatattccgtggaatacggaaggagttggagtgatttcacttttctgatcaagaactgatagccattaaaactcagctccgcaatatatccccccactccaagggagggctgagatgatcacttcgttttctgttacggctacttttatatttttcaacattactgctggtctgtaagagaactaaaacatctgattttcctcatttccttgtaaagaggtgttcaaatatgtacttgaatttaattatttcttctggtcagctgcaaaacctgcttttcttccttaacccctagcatttttatcctcttagctacagacaggtttccatggcgttggttaaaaattaaggcctattgagaccatagtatttgctttccagtgagtaagaagcaagaactttaggattaaattcagcaaaaagaaaaaaaaaaagagtaaaattttgcaagcagagtttgtgatttcaccagcaacacactaacgtttttggctactgaaaaccactatccccagccccatgactcagcagctaaatcaacagccaacatctcctactggtaaggactctaagaaatcaggcacttggtactctcagagcaattctaaggcgtggccctgaaagggctccaaacaatcttattttacataaaaatggttagagagataaagatactctgctgtggccagaaccagtaaatctagcaggaaatcagaggccgaacatgatcccggactgctgccgttgcaagattcttggaggctgcagcgccacattctgagccagcacttcgacctcacattgtagctaaaatgttaatgattactagagatgtcctgaaatctttttcaaaattcacaggctgccaaatgccctccctgtttccatagctccttaggctttgttagcaggctgtggggttcacatttgcttgtagtcagcacaacggcattgcatttagttattatttctcacttgctgtaagcttgttgagaagttttattggtggtgggcaggtggggaataactgtccaaagctatcagaataccacaccttgaagcactgtaggtaacacatgcatggtgtctgcaggtggccgggatcaagggagagtgaatctgctacgacctgtaactcgcttggattactgattctccctgtgatacgtgtgtaaaaatcactggtcagcttgagaaagggatctttgtgaaagagggtctccagccagatagggaacttcagggttggataaggagctctggggaggtaagataccagatgagtgcagaaggggatgtagctggatggtccctcctcataacagatcatgaggttttggtattcatcactcagtatttcacgtacaccagagactacataaagcgtatataaatctctgtgtacccacatcccgcttaagaaatggaacaccatgctgggcgcggtggctcacgcctgtcatcccagcactttgggaggccgaggcgggcggatgacgaggtcaggagttccaagactagcctgaccaacatggtgaaaccccgtctctactaaaaatataaaaatcagctgggcttggtggcaggcgcctgtagtcccagttactcaggaggctgaggcaggagaaccacttgaacccgggaggcggagcttgcagtgagccgagatcacgccactgcactccagcctggatgacagagcgagacaccgtctccaaaaaaaaaaaaaaaaaaaaagaaagaaagaaagaaatggaaccctagagtccaggcttagtggctcacatcagtactcccagcacttagggaggctgaggcaggaggattgcttgagcccaggagttccagaacagcagaacagcctgggcaacatggaggagaccccagtctctgtaaaaactaaaaaattaggcagatgtggcacatgcctgtagtcctatcccagctgcttgggagactcgggtgggagtgtcacttgagcccaggaggttaagattacaatgagctatgattgtaccagtgcactccagcctgggagataaagacctgtctcaaaggaagaaatggggccggacatggtggctcacccctataatcccatcactttgggaggctgaggggggtggatcacctgaggtcaggagtttgagaccagcctggccaacatggtgaaaccccatctcgactaaaaatacaaaaaattagccaggtgtggtggcacatgcctgtaatcccagctactcaggaggctaaggcaagagaattgcttgaacccaagaggcagaggttgcagtgagccaagatcatgccattgcactccagcctgggcaacaagagttaaaaaaagaaaagaaatggaaagttaaaaaaaaaaaagaaaaaagaaatggaggccgggtgcggtggctcatgcctgtaatcccagcactttgggaggttaaggcgggtggatgacctgaggtcaggagttcaagaccagcctggccaacatggtgaaaccccatctctaccaaaaatacaaagattagccgggtgtggtggtacatgcctgtactcccagctgctcgggaggctgaggcaggagaatcatttgaacccgggaggcggaggttgcaatgagccaagagtgtgccattacactccagccgggcgacagagcaagattccttctcaaaaaaataaaaaaaagaaatggaacattagtaatgtcatttaggtcccctgtatgttctttgaccccagaggtagccactattctaaattttgtgttttattattcccttgcttttttttttttttttttttttttttgagacggagtctcactctgtcgcacaggctggagtgcagtggctgatctcagctcactttaagttccgcctctccggttcacaccattctcttgcctcagcctcccgagtagctgggactagaggtgcccgccaccacacccagctaattttttgtatttttggtagagatggggtttcaccatgttagccagaatggtctcgatctcctgacctcgtgatccacctgcttcagcctcccaaagtgctgggattacaagtgtgagccaccgcacctggtctattcccttgctttttaaaatgatttttttttttttatttttagaaggagtctcatttttttttgcccaggctggagtgcactgatgcgatctcgactcactgcaacctctgcctcctggattcaagcgatcctcctgcctcagcctcctgagtagctgggattacaggcacccactaccacgcccagccaattttttttgtatttttagtagaggcagggttttaccatgttggccaggctggtctcaaactcctgacctcgtgatccacctgcctcggcctcccaaagtgatgagattacaggcatgagccacctcgcccagcctattttatattattttattttatttttgatacagagtctctctctgtcacccaggctggagtgtaggggcacagtcttggctcactgcaacctttgcctcccgggttcaagcgattctcctgcctcagcctccggattagctgggattacagccgcatgccaccacgcccggctaagcttttgtatttttagtagagatggggtctcaccgtattagctatgatggtcttgatctcctgacctcttgatcctcccgcctcagcctcccaaagtgctgagattataggtgtgagccaccgtgcccagccgtattttatttttaaatatatataaaaaaattataagtacagaacacttcacagatttgcatgacgtcctcgcgcggggcccatgctgatcttctctgtatcattccaatttttttttagtatatgtgctggcaagtcatgctaggttggcattcctcagggtgtccaaatgagaggagtaaaggggaggtgattaagcaagaaggcccaggggagctggggaagctgggagcagagttcccctgggcagaggtcatgaaggggcacccaagtgacagccgagggagaacaacttctggaaagtctgtctcagcaggcatcagaggaaagcatctctatttggcatcaaagagctcagcatggcctccctcagggccccagcgcctttatctttgggatggatgtgataatagtctcagggggaggtcggcagtctgggaattactgtttcaagctagaatggacacctagaaggcactaatatccctaaatagtatctgcaggaagttatccagccagttttcttttcacgtgtctctgttccctccctctttttcacaaaattcttaaggttgttgccgaggttctttttttttttttttgagatggagtttcactcttgttgcccaggctggagtgcagtggcgccatctcggttcaccgcagcctccacccaccaggttcaagcgattctcctgcctcaccctccctcgtagctgggattacaggcatgtgccaccacgcccagctaattttgtatttttagtagagacagggtttctccatgttggtcaggctggtcttgaactcctgacctcaggcgatccgccctccttggccttccaaagtgctgggattacaggcatgagccatcgcgcccggccgctgagtttcttaaggttgtcacagcatcacttggaggcaggagtgccggcccctgggaaggcccttgtcttgagaggaggagaggtcaggtaacaattgctgagttccagatggaaaatgaggagccacgttcttcagaaggtagtgatctggcgtgattcaggcgtggggagcagggtttcaccacgccttcaggcacaccacaagataatgagaaaattctccctgcatctatcgcagaccaataaagttgctgggccgggcacagtggctcatgcctgtaatcccagcactttgggagggcgaggcaggcagatcacctgaggtcagtagtttgagaccagcctggccaacatggcaaaaccccatctctacaaaaatacaaaaattagctgggcgtggtggcacatgtgtgtaatctcagctgctcgggaggctgaggcaggaaaattgcttgagtccaggaggcagaggttgcagtgagctgagattgtgccacactgcactccagcctgggcgacacagtgagactctgtgtcaaaataaataaataaaaaaaataatgttgctgaggcctcgttacttgccagacaccaggatgcttgtatatgtaactcatttaatcttgtaagcacgtccatgagcacactccatctgatcgtctccactttccaaggggcagggaggcagcagctgctggctgaggtgccagaggaccaactaacgcagcctggtccccagtcctcgcccccaacctcagcattgtgctcctccaagatgaagattgttcattcccctagtcctcggattccagtaaaatgctacaacaccaccgttagtccaaggaaccttgtcttgatttgcttatctataccacaactacctagaatttagctgtagcagcttcaggatttgcgaaacatcactcaggaagcttttgtgtctgccggattctgtgttctctctagaacaggtttgcagtcaggagaggcagcttgcagtcagaaatgccagttacactgtgtcagcattggagttccaatgataaaatgtccccaaccccatactcaggttgatgttttctggcatttcctaagcagaggggtagaaactttctgattttcggctgggcccggtggctcaagcctgtaatcccacactttgggaggccgaggagggcagatcacttgaggttgggagttcgagaccagcctggccaacatggtgaaacgctgtctctactgaaaatacaaaaattagctgggtgtgatggtgggtgtctgtaatcccagctactcgggaggctgaggcaggagaattgcttgaacccaagaggtggagggtgcagtgagctgagatagcgccactgcactccagcctgggtgacgagagaaactctgtttcaaaaacaagagactttctgatttcacacaaacacgttacagttcccatgaagtgaagtccttggaagtaaagtccccacacctcctgcactggaattctctgactaaatggggtttttgtttgcttgtcttgtttcctggtggtcagggaaatgctgagaagagaatggatttcagcacagcatttctcagagcctcttaggtaattcttggggctaggagagaaatgaagatttctcttacgcattttgaacagaaaagcaagtgggtagatttctaactggctgaatgagtctccttaaggtactgatatcaaaagcaaaggtaggagactggatgaaactgacaggctgagcatggaggctcacacctataattccagcactttgggaggctgaggcgggcagatcacctgagatcgggagttcgagagcagccttaccaccaacatggtgaaaccccatctctacgaaaaatataaaaattagccgggcgcggtggcaggtgcctgtaattccagctactcaggaggctgaggcaggaccacttgaacccaggtggtggagtttgtagtgagctgagatcatgccagtgcactccagcctgggtgacagagcgagactctgtctcaaaacaaacaaacaaaaaaaggtggggcctttggtaggtgattgagccctgccttcatgaatgggattaaggttctcataaaagaggttggagggagctgcctttctcttctgccatgtgagggcacagcatctatggagcaggggcagaaagcaggcctttacttgataccaaatctgtggacgccttgatcttgtgtttcccagcctccagacctgtgagaaataaatgtctactatttgtaaattgcccagtctaaggagctgtgttttggcagccgaagtcatagtcacaggctgcggataaacatgaagttttgtgggaggacattattcaacctactagagcctctgactctgcagggtctctccacatggcttctcatcattcagtagtctgtctagcccagggattgacaagctatggcctagggtccaaattctgtttttataaataaagttttgtgggaacacagacacactcatttcctttcttttttgagacaggtcttgctctgttggccaggctggagtgcagtgctgccagtcatggctcactgcagcctcaacctcccaggctcaagtgatcctcccatctcagcctcccaagtggctgggaccacaggtgtgtaccaccatggccagctaaattttttttttaacttttttgtaaacacggagtctcctatgttgcccaggctccgtttctttacatattgtatatggcagctctcaagctgcaatggcaaaatccagtcgtttcaacagagactgcaaggcccacaaggctgaaaatacttactatccagccctttatagagaaagtgtgctcacctgtggtccagcctagcttctcacatggaagctgtagcccaaaaacaaatgatccaagagggccagtcccagtgtgcaagtgcagatggcctctgcttgctgctgtctcattggccaaaacaggtcccatggtcaagcccagagtcggtggtaggggctacccacgggcctggatagtaggaccccccacaacccaagacagtctaccacgggggtgtgggaggtgctgaaacagggaggctcaataaggagactttctttctttctttctttttcttttttttttgagatgaagtcttgctctgttgcccgggctggagtgcagtggcttgatcttggctcattgcaacctctggcacccaggtttaagtgattctcctgcttcagcctccgaagtagctgggattacaggtgcgtgccaccaagcccagctaatttttgtatacttactagagacggaatttcagcatcttggccaggctggtcttgaactcctgacttcgtgatccagctgcctcggcctcccaaagtactgggattacaggcgtgagccaccgcgcccagcctttctttttttaagacagggtcttgctctgtcactgaggctggagtgcagtggcatgatcacagctcattgcagcttcagcctccagggttcaagtgatcctcccatcttagcctcctgagtagctgggactacaggcatgtaccaccacgcctggctaattatttattttttttggtagagagaagtctcactttgttgtccaagctgatctagaactcttgggttcaagcgattcaccagcttggcctcccaaagtgccaggattatgggcatgagccactgcccagccgatgaggagactcttgccttgtcccagggagagaccacggtggccctgtaggtcttgtaggttgtggcagtggatgtgtgagaagtgattggattccagatacatttgcaagcaaagctgatagttttggctgggcacagtggctcatgcctgtaaatcccagcactttgggaaaccaaggtgtgaggattgcttgagcccaggcatttgagaccagcctaggcaacacagcaagaccttgtctcaacaacagcaacaaaaattagctaggagcggtggcgtgtgcctgtggtcccagctattcaaacagctgagggtgagtatcccttgagcccaggagttagaggctgcaatgtgttatgatcgtgccactgcactacggcttgggtgacagagcgagaccctgtctcttagaagacaaaacgaggctgggcgcggtggctcatgcctgtaatcccagcactttgggaggccgaggcaggtggatcacgaggtcaggagttcaagaccagcctgaccaatatggtgaaaccccgtctctactaaaaataaaaactagccaggtgtggtggtgggcacctgtaatcccagctactcgggaggctgaggcaggagaattgcttgaacctgggaggcggaggttgcagtgagccgagatcacgccattgcactccaggctgggcaacaagagtgaaactccatctcaaaaaataaaaaaataggctgggcatggtggctcacgcctgtaatcccagcactttgggaggtcgaggtgggcagatcacaaggtcaggagatcgagaccatcctggctaacacagggaaaccccgtctctactaaaaacacaaaaaattagccgggcgtggtggcgtgtgcctgtagtcccagctactcgggaggctgaggcaggagaatggcgtgaacccgggaggcggagcttgtagtgagccgagttcgcaccactgcactccagcctgggtgacagagcgagactgtctcaaaaaaaaaaaaaataataataataaaaagtaaaacaaaacaaacaaatgaataaaaggatcactcagagtgtggttgctcacacatgtaatctcagcactttgggaagctgagggaggatcctttgagtccaggagtttgagaccagcctaggcaacatagtgagaccccatcttgtgtctacaagagtttaaaatgttagccggg

SEQ ID NO: 1280 - DNA, 58529 bp, Homo sapiens
cgtgtgtgtgtaaaaaccggcccggtctagcttacactctccctcctcaaggaggcagatgcagggggagcacagctgctgctctgctccgcgctcaccggagtctcccttcctggcggcccagccacccaccacatccccaggcactggcttcagtctgctctgctccctggccatccaccacccaaccaatacggtggtgccctattctgtgcgttcaatcgtaatggagcattataatgacaaacaaatcaatatataaagatatctcaggtggtgacacacactgcgaagcagaataatccaggtcaaggaacacagcgtcagagggtcacttttacatggtagtgtctgtcacaatcaggtctggggaagtccacttacaatgtgttttgttttaaagaaaaaacaacatgagactggaaaccatcagagggtactgcactaagcgaggataagaactgctctgtgaaactgatttcaccgaagtgctcacacacggatgcacccacgtgcaagtgcacatgctggcataatataaagcgtccttccaccgcaggtcagggtcaaagaagccagcatgagccagagctgttggtgatgtctcctcacattccatagagacttaaggctgtgggggatggagcctgtggccatctgggaggacattccagtcagaggggacaagaaagccaggcactgaggcggacgaagaccctggctcctgcaggggctgcaggccaagctggctgcctggggaccacgaggcggccagaggccaggccacagggcctacatgcatgggggactttggcgcttactcctggaaagttgggatgcatttaagcagatccctctggctgcagggtgaagaggctctaggaagccagagtgagaggaggaggaagcagcagctcctataggggggtgaagcaacagggaagggaagaccagcattcggaagacactgcggaagaaagagcccacacggtctgtgatggtttagagaaagagaagcaggaacaacttctacatgttaaacaattttacttacacacacacacacacacacacacacacacacacacacacagtcactcagacacagagaaaagaacacacgcctttttaaacaccaatcaaatatgaacaattactgtgtattaaaccacagtgaaaatcctgataattaaaaaacccacatagccatattctctcatcagaatgccataggactaaaaattaacgatgaaaatgacagggagctaaaagctaaccacttagaaactaaagcatatcctttcaaataattcctgagttaaaaaaataaagacatattagagattatttagaaatcagagaaaagcggtactcaaaatgatacagaatagcagtgcacagaaagacacggatggtcttaaatatacttactaggaaacaagaaagtaagtaaatgacctgaacattccactcaagctagagaaaggttaagggctcaccagcctccagcccgaccgtgtacagggcttagtgcgagggtaccgtgcgaggagcagaagcaggcaggcactgagcctctaagctgccacatgtgtggaggaaaagaaagtattttctgttaaaagtgcaaacatttatatcttttgcccttgctttttcattacttcaggaatttatgccacagaaatattcttataagtgtggagagatattggttaaaaatgttcactggaaggttgtttgaaacagcgaaaaaccgaaaaaatccaaaggctcactgataggaaaatactaaaatataatgcagtccttttaagagtgagtgtgcccaaaatataatgtcaactgagaagataccattttttttttttttagactgagtcttgctctgtcgcccaggctggagtgcagtggtgtgatctcagctcaccacagcctctgtctcctgggttcaagtgattttcctgcctcagcctcccaagtagctgggactacaggcgtgtgccaccatgcccagctaattttttgtatttttagtagagacggggttttaccatgttagccaggatggtctcgatctcctgacctcatgatccgcctgcctcagcctcccaaagtgctgggattacaggtgtgagccactgcgcctggccgagaagacaccatttttatgaaaaggtaaatcacaataacacacatagaataggtaccaaactcctggtcactgtcatctctgggaaacaggatctggggacttacactttttttttttttttgagacagagtctcgctcagtcacccaggctggagtgcagtggcgccatctcactgcaggctccgcctcccgggttcacgcattctcctgcctcagcctcccaagtagctgggactacaggcgcccaccaccacgcccaactaatttttttgtatttttagtagagatggggtttcactgagttggccaggatggtcttgatctcctgatctcgtgatccgcccatcttggcctcccaaagtgctgggattacaggcatgagccatcacgcccggcaggacttacacatttgccattataattttctgtactatacgaatgttgtgtaactttgtattatgtttgtaatcacaaaaaaacaactattatatttaaatcatcagaccaaatgcacattttggagatcaggcagagaaaagaccaatcatttgtttataccaataacaagttaaactgaatattttatagagagaacaaaaggcattgttttaagcctgcagcagtaattgattttaaacttactttatgaacaacactcttaattatatatgacccctatacaaatccaaactctatcaccctcttaaggtgcctgtattgtgctgcagaaatctatttaacccactttcatttccaggaacacagcacgattcaacaacctaggaataaggtcaatctatagctaagaaagttttaaaaattaagttttaaaaactaaatcctaactgcattttgattactcagatatctttgttaacggagcaaagtgactgaaaattttagacaccacaaatgactaaaaattaaatatcaaatttaaaaggaaatatgactgtgattaagatgcagatacgacacatttcaacttacatgctttgaaagcaaaactgtacgacaaggagctttacaaatcaagcattcattctttttacctataaaataaaaataggctttattatattagactgactactacttttaaatatgtatacatgcagactttacaatgtttctccaagaaataggcaggattgtatcacttacaggttttcatgttctgacaggatgaggctgtgggtactggtacagttggaaggatttatagaactaacattcttttcccctcttttgcaaatatgtacaaaaacagtgaccataaagatcaacaacacttaaggctaagtctatcccaggtatttattacaattaggcttttttaaaattaaaattaaaaattttttttgagacaaggtcttgttctgttgcccaggctgatctgcaagtggcatgatcacagctcactgcagccttgacacccccgggctcaacagtcttcccctctcagcctccctgagtagctaggaccacagacgtgtgccgccacagccagataatttttaaatttttttgtagagacagggtctcactatgttgcccacactgggctcgaactcctgggctcaaacaatcctcccacctcagcctcccaaagtgctgggattgtaggcgtgagccactgtgcctggccataattagcctttttttttttttttgagacagagtttcactctgtcacccaggcgggagtgtaatgacgcgatcttggctcactgcaacctccacctcctgggttcaagtgattctcatgcctcaggctcccaagtgactgggcgtacaggtgcctgccaccacaccaggctaatttttgtatttttagtagagacagggttttgccatgttggccaggctggtcttgaactcctgacctcaggtgatcagcccacatcggtctctcaaagtgctgggattataggcatgagccaccatgcccagcctatgattaggctttatagtgatatcttaatctaaaatttttaactattcaaaatgaacctcaagcttgattttctcactagtcaacttggagcccagggctgaccaggcactatgagccttcacactcctgtcattccagggaggacatcaggtccaaacctgaacaagcccggtggctttgtcccctcctctgggccagtgcagctaagaactaggaaaaaaacatcccttaagtgagaggtggattcacagacttgaggattccaacgctgctgagtcagcaacactgctgggcaatcctgcttttcctgggtattttctgccccattccccatggggctgctcaaaccagggccctcatatcatctactcagaagcagccctggctcatgacctacctcaatttctctgccctctcctctagactgacccaccacagaacaacccacttcacgctacctccttcctttctgccttggaggcagcatctcttccagcccaagcccaggctttcacttgtgtatccatactcgcctcagtgtccgcagctcccagcacacagaatggtgtcctactgtggggtgagggggtccccttctaacagcctccagaattgtctcctttcctctcttcttcaagttgccctcatgctaaaaacatctacccttgacagtaggtcccctcccttctagctctttaagtgcaaattctgcagcaagaaaattcctcttatgcaccatcacagctaggagtcatgcagtaaaagattaacagagccgactcataaaaatcgaaaagttcttacaagggaggaggattaacagacatgacagagaggaaatcacgtgcggccaaaagacaaagggattgatgcctgatctataaatagtgctcactagtcaattagaaagaaacacctcaataaaaggctatgaggagacctgaataggcataggaaaaaatgcaaacagccaataaacacacaaaatgaaggtcaaggtcactagtaagagacaccaaagaggagaaaacaacaggtgctcacgtgtcactacagggaatagaaacaggcacttcctttgtgcctgtttgggtcgcatttgggtcagttttcatgtgcacatccgcagcctagccactccaccccgaagaatatattccaaggaaaaaaatcaagtaagagaacaagtggtgtctcatagcaaaacggcagaaactatgttatggtatgatagccaaaagatgtatcatgcaaccttaagaatgatgatacagacttattttaacacggaaggaggtctatgtttgagtaagtaataaaagcagattactgaatggtagacacactattgcttttgttttaaaaatctgcatctataggaaatgcttggaaggatatacaccagagctaaacaagggcttccctctgagtgacacaccactggacagctacagagctacagtcaaggctctgcccagagcctccaccccttttcaccacttttttgtgtgtctttggatttggtgtggtcccgacatgcagcatctgtggctttttggaggaatgcactcagactactggaatctgtgttgacctcaggctttaagagctaggcaaacctgtgaatctatacctgccccaggcccttaaccagtcacctgccaacgcagagtatgctgacctcaaaagctatgacgctctgagccctgtcttcacacttcccagcaccacgaaggcacacgcgtctccatcattcctaacaatgttatcttcggggaacattatcttgggtcaccagtgccctcctcactggtccaatggacactttcaaacaccaattccttgacttcactgggatgtccagttcatcaacatctcttttttacctgacatcttctttacctccttcaacaaatgctctttccaacaagatagtctcttctagtttccttcacctttggggctctccacactccaatatctaggattataggattattatcccgtattaatcgctccccaaatgtgttcctggctgtcttgagttccagacccacatgtgcaactgcctcttgtcttcccctggatggctctcacaggatacaggccgtgtccagacatgagctcaggggccctgcaccccaccctgctgtgccccaccctgctgggttccctcccgctgggctcctctccagtgttttgtctagcagtgaaaccctgtccagttctctagcccttgtctccgactcatgtctgctgaatctacctaacttctcctgaacctatcacttctccccatcacctctcatgtgctcagctgcagtctctcccacagtttctatctccctccaatctacttttcacctcgctgcccgagacacttttgtttttaaatacacacctgaaatcaacaactccactcccaggttacacacccaacagaaatgtgtacctaagatcaccgaagacaggagcaagaagattcacagtagcattatttctgcagccaaatctgcaaacaacccaaagggccatggacagtggaaacgatgagtaacttggggtgtatccatacaatggaacaccacacaacaatgaaagtagatgaactacagttacatacaaatacaatgataaactttgctaatcccacatttcgggaggccaaggccggtgattgttagaggacaggaattggagaccatcctgggcaacaaagggaccccatctctgtgaaaaattaaaaaaatcaggggtgcgtggctgcacatgcctgtagccccgctaccctggaggctgaggtaggagaatcacttgagcctgggaggcggaggctgcagtaaaccgagatcccgccaccgaactccagcctgggcgacaaagctgagctctgccttgaaagaggcaaagagaaggaagggagaaaaaggaagaaagatggggagccacagaaagcggctttgctgtagggctggttgtagggctgcattcactaaggctccatgggtctaaggccaactccgaggatggaggtcagcacagctggcgtcccctggggctggagggctgtgagccaccggcacccagctggctgctttcacggggaagttcgcttggtaaaagctcactgtgtttttgcttttgttcttgcataaacatcagttcaacacaaaattttcacagaaagaaaaacgcctccctgacaatgcgactgtccacttgacaccagggccccgcgctgcccatggaatagggccagagtcctccactggcgttaaggttgccgcctgcccgcttctcccccaggtcctccaggcggacccgcagcctgcaagccagagcccccgactgacaggactcgtggcccgacccctgtgtccccctcatcttgcatcccgctccccccggcggcccctcccctccacggccccttcctgcctgcggaccctcccccacgccctcctcccctggcgtctcccctccccccatctcctcggtatcccccttcccccccaagccttgaccccccacatcccccaccttgcccccctcctctggcgtccccttcctccctgcagccccccaccacctccggcgtcccctctttccccaccctcccgcagcccctcactcccccgctccctccccaccgcttctccagtgtccccctctccccacgggcccctcatcacgcccgcggcccccactccccggtggcccctcctccgaatacccctacctccgcggcctctcacccccccatgccccccccgctccatgcgccgtttctccccctcggccccccacgcgcccccgcggcccctccaccccaggtccccctcccctcagagttcccctgctcctcgcggcctctcccctggcatccccctccccctgccccctcccccttctccacgcgccctctctcctccgcagccccccacgtgcccccatggccctcccacccaagtcccccatcccccggagttccctgacccccttgccgctcccctcccctctccagcctgcgttcgggaagccctgacctttgccgaggcaggcgtcgcagtacacgtgcccgcagttggtgaggctgaagcacgacgtcctgtggggcggctggaagcagcgattacagaacacccagttggccatgccaggcgggcgaccgcagcggcgaggccgggcccacgcgaagcccacgcaaggttgggaccagcctccccgcgcagggcccgaaggcgggcagctctgcgcctgcgcaaagtcgacggcagccctgcgcccgcgcactggagctcgcgccctcccgccaacctcgcgggttctcccgcagcacctgggagggcgcgtgtgactcgtctcccaggtcgtttgggctggagtaggcggaggaacgcaccgcgagcaccaacgtcccgcccctgtcttggcggtcctcaggtgttttgtggaagccgggcctgggtggcgggcgcggggaatggcggctgcgctgaggaggcgtcgcggcgcgacagcagtgggggagggggagggggagcgccgagggcgggggatgcgggccaggcccaccttgagggccgggagctgggccggaggccagggcggccagggtagtgcgctgggcgaggcaggggaggagtaggggagagtgggcgtgggggccctgggggcccggggagcgggataggagggagggagggataagtgggtgtgggagttggggtgggagcgggagtggggatgtgggagttggggtgggtgtgggggcgtgaggcggtgggggtggggtgtgatgaggcggtgggggtggggggggcagttgggggtgggggccaggccgcgctgcacgctttgggactagtgtccaggtggccgctggcgcagagacctcagcacgggaggcctgagcctgcttccctctgaaacggaaggcgtagctcgggaaggacctctgctgcttccaggttccagcatggggaagtgactttttataaaattgtcctctgcgtggttttgagagtttccacccgctgggacgctgcaaagctcggatcgagaggctcaggcaagtgcttgtgccgggagagcgcagggtgagcgctcccggtagctacgggccaagtgacccctgcgccccgaaagatgtgagtaaaatacagctgtttccagggcctcgtatgaaaaccttcttagtaattttatattgattacatgttaacatgatatttttgatatattaggttaaatatatatcagtagcgttgattttaccctttcaaaaaatccttttcaatgtggagactagaaaacttagaattacgtatgggctgggtgcggtagctcacgcctgtaatcccagctactccggaggctgaggcaggagaatcgcttgaacgaggcggaggttgcagtgagccgaaatcacaccactgcactccagcctgggcaacagagtgagacttcgtctcaacaacaacaacagcaaattagaattatgtatgtagcccacttttatttctgttagacagtgctgatctctaccaagtttaaaatagcaagaccagcaacgtggcaaaaccccgtctctacaaaaaatacaaaaattagctgggtgtggtggtgggcccctggggtcccagctactcgggaggctgaggtgggaggattgcttgggccctggagatcgagcctgtggtgagcctgacggcacctgtgcagcagagcgagactcagtctcaaaaataagtttaagaataggatgaggtgcctaatctatcaaattcagaagctgcattataaaagcattctctcaatgttataatgatataacgttaatctcaatctctggtatctttgaaatcataaaaataatacacatatatgcaggtattttgatttattaactcaaacattatgcagattatttgtccttattgataatattttaaacaatcttcttagctataaagaagtctttcaggtacttcatttggaaaattccgactgagataaagattaatatttgtgcaaaagcccaccataaaacattgctatttgtatcttcactggtcgttcgaaaattttcttcacggtcctatgcggaaaagaagtaggtttagtgtcataaagtacttaactcacgattttgaggggagggttgttgtgggcattcaaggtatttaatattacccaattaatatcttacaccaacgtatccgtgcagtctgcttttctaaaccagaatctgttgcttagccaagtataagagagtaaaaatcaaccttataaaagatggttttgtattttggtgtaaaatatcaggaatttgacctattcgtatattttatttgctaccatcaggcaaagcgaatattacccaatagtggtagatttcatcatttgagtccagcctttatgccaggcattaggccaagcacttgcatgccttatttgcttgtcacacctgtccttatcttcctgttaaggaaactgaagcttagagatgacacagattactgacaggtagttgagatttaagcccatatctgaccaatatccacttagtgtagtgactcaaaaagcacctaatgtcataagaataaaattgtgatttggaaagtgagcatacgtgagcctctacaaatacatgggatgcatttggaagcatttattcattctgcaagctcacaccctgtgctactggggacttcgttaggcacagggcataaaaagatgaatgaactgaaattctgtttcctagaggagttcatagtccagccgacagagtgaagaaaaattgctctctctagtccctgtgaatccacaccgttctacctcagagagaaagtgaggaacaggcagttcactctttccttggtccaggggctttgtgttgagaaatgcgttgctggtagcaagagataaaataagttgaataggcagactgaccctttgatagttttgttctttgactatttgctcaatttgttcaattagatgttcaagcttgaaggtaagttcattaactttgtcctttgcttgagcaatggccgcatcaaggtcgtgttctccaactcgaatatctaagtggatccgctgtacaaacagtaaaaaggaaaaaacggcatgtttttaaaaacagctccactctttttccttactttctcactcttgtatcctcgtccttcctttttctcccttcccccttttcataagcagggcgttgcttcactcttcagctcccttttttccctcactgccactctttcttattctacttggtagtctttcttgtaataataatgcattaaatggtaaattactgaccttatagtatatttataccttcctgaacatgaaattaactattaggtaaatgactttggtgtggagaaaatttgattaatgttctgagggaaattttctttacatataactaaatttcttaagctaaagtacaaattgtttccatcagttccgaacacatttagaaaatagccagtcaccatctaccgtgtaagagttttatttattagaattccattattaattcacccttcagccttcacttgttttcaagcctcaataatcacagctcttttaaccttccctcacagctcttatttttcaaaccctttaatcaacttcatggctctcctttgaaccccttccaagctctccagctccctctttggttgctgcgctgagatctgggcataggactttaataagtttctagccagtttgagtgtaatggttctgcataccaatgtcatgcttgaatagtgctgatgctgtgttcatcaacaaggacatgggaagcatatactcaccagcctactccctccaaattacacaagccttgtagaattagattctaagcaaatggtgtgttcaccaggtgaatgtgaagtaaaatagaatgtcccttgcgggccgtataacttcgacaatattacctaggattaaggatttccataaattgagtttattattttctagtttccattcttaaaaataaatctctacaaattatctagcaaaaaattgtgccattcctaaaacaagaaatcaaatggctaataaacatgaaaaatattcagccttgctagtaattaaaaaattcaaactacagtaagatagcccttgttcattgtcagattgacaaagatttaaaagtatccagggatagtatggacaacttttgtcccacagaatatccaagaactgtgggacaactacaaaaggtgtaactggacacataatgggagtaccagatggaggagaaacagagaaaagaagaaatatttgaagcaataattattgagaatttttccccaaattaatgtcagataccaagccatagattcaggaagctcagagtataccaaggaggattaatcccttcaccccctcaaccccaaaatgaaaccaaaaagctacacctaggaatatcattaaaactgcagagaagcaaacacaaataagaaaatcttgagcagccagaggggggaaaaccttacttacagagtagcaaacgtaaaagttgcatctgacctgtcctcagaagctatgcaagcaagaagagagtagagtgaaatatttaatgtattgggaataaaaaaatgaccaacctagactttggtatcctgcaaaattatcctgcaagagataagggaataaagcctttctcaaacaagtaaaaactgaaggaattttttggtggtagatctgccttgtaagaagtgttaaaagaagttcttcagaaagaaggaaaatgatgtaggtcagaaactcaaatctgcataaaggatgagcattagaaaagtggaggtaaaattaaaactttctattttcttattcttaactgacctaagaaatatcactttattcaagataatagcaacaatgtatcgaatggtcatattttacctgtaagtgaaattaatgaaagccatgataaaatcaggggcagcagggaagaattaggaatattttgttaataaaaggcacttgcggctgggcatggtggctcacacctataatcccagcactttgagaggctgaggcgggtggatcacctgaggtcaggagttcaagaccagcctggccagcatggtgaaaccctgtctctactaacaaatgcaaaaaataattagccaggcgtggtggtgggtgcctgtaattccagctactcagaaggctgaggcagggagaattgcttgaacctgggaggcagaggttatagtgagctgagttcacggcagcctgggtgacagagtaagactccgtctcaaaaaaaaaaaaaaggcacttcctgtgaagtggtagtgtatagtgttatttgaaattcgacttggactagttgtgaatgtatatggcaaactctagggaaacttcatatgctaacagagagcacggaatcacagaaaatgctcaattaaaaccacaaaaggcatgaaaaagaggagaagaaaaaaataatgagggcaatgaatagaaaatggtaacaaatatggcagatactaatccagctatataaatcatcactttaaatgttaatggtctgtgtccttggcctgggtagagtggcacctagttggtggtgcccatattagccagggacaaagcaaccctttgttcatcccagcttggcttttgatctgtacctatacctggttcatgccttagacacatggaaaaaaaatgtcaatggtctaaatacaccagttaaaaaatagagtggatcaaaaaaatgagacccaattatatgttgtctataagaaaatcatttgaaatgtaaagacacatagattaaaagtgaagggatagggaaagatacatcatggtaaccttaatcaaaagaaggctggagtagctgtattaatttcaggcaaagtagacttcagaagcaatggaaattatcagggataattacataatggagcaatacataatgataggagggtgaattctctaaggagacaacaatccttaacatgtatgcacctgacaatagagcatgaaaatatgtgaagtaaagcctgatagaactgcaaggaaaaaatagatgaacactttattatagttggagttttcagccccttctgtcagaaatggacagatcctgcaggccaaaattagtaaggacatcgttgaactcagtggcaccatcagttgactggagataattgacacctatgattactttatccagtgatagcagaggacacgtttttctcaagttcacatggaacattcgtcaagatagaccacattctgggccatatatcacaccttaaagaatttaaaataatagaaatcatacactgtatgttttcaggcctcaatggaattaaactggaaatcagtaacagagagatagctggaaaatcgcaaaatacttggagattaaacaacacacttctaattaacacatgggtcaaagaagaaatctcaagacaaaatgaaactacaacttaccaaaatttgtgggatgcaataaaagcagtgactagagggaaattgaaagcattgaatccatatacagttggctgtctataatgccaggtttcacatccatggattaaaccagccatggattgaaaatatttgaaaaaaatatatgtgacagaaataatacaagtgaaaaactacagcataacaacgatgcagcatttacattgtattagatataagtaatctagaggtgatttaaattaatgggaggatgtgtactagttacctgcaaactacaccatttcatataagggacttgagcatcttcagaattttgtatctttggagagtcttggaaccaatgccccacaaataccaagggatgactgtattaaaaaacgagatctaaaattaataatctaagcttccaccttaggaaacgagaaaaagaagagaaaattaaatgcaaagtaagcagcagaagaaaaataataaaaactatagcagaaatcaattaaaaacaagaaatagaaaaaaatcaacaaaaccaaaagctgattcttagaaaagatttaaaagcttctagccaggctaagaaaaaaatgaagatgacacaaactacaaatattagaaacagaagaaggggcattacaaatcccatggacattaaaagaataataaaggaatactgtgaacaagtccatgcccacaaatttgataacctaggtgaaactgaccaattccttgaaatacgcaatctaataaaatacaagaagtaggcagtctgaataggcctatatctagtaagaggttgaatcaatagaaactttccaaagcagaaagcaccaggcccagatgggttcactggtgaattctaacaaacatttaaggaagaaattgtgccagttctctacaatctcttccagaagatagacacagaaggaatacttcctgattcattttatgaggccagcattaccctaataccaaaaccagacaaagacattataagaaaactactgatcattatatctcatgaagatagatgcaaaaacccttaacaaaatattagcaaatgaaaatccaacaatatgtaaaaagaattatataccacaaccaaatgggtcttattacagatatgcaagactggtttaacatcagaaatcaattagtgtaattcatcacatcaataggtgaaagaaggaaaaatcataccatcatatcaatagatgcagaaaaaacatttaacaacagccaacacccatttatgataaaaatgcatcaaactaggaatacaggggaacttaatttgatgaagaacatctacaaaaaacctatagctaatacacttactggtcagaaactagaaaccttttcttggtggactggaagtcctagctaatgcagtagaaggaaataaagagtttgggaaggaagaaataagctgtctttgttcacaggtgacatgactgtttatgtataaacccaaaagaattgacaaactgccagaactagtaagtgattatagtaaggttgcaggatacaagatgaatataagaaagtgaatcactttcctatatactaacaatgaacaagtggaatgtgaaataaaaagcacagtatcatttacattagcacgctccctcaaattacttatttataaacctaacaatatgtgcaagacctatatgaggaaaacaaaactggtgaaagaaatggagagaagtccatgttcatagataagaagacttattattgtcaaaatctcagttcttcccaacttgttctatagattcaacagaatcccaatacaattctagcaaactattttgtgaatattgacaagctgattctaatatttatatggagaaacagaagacccacaatagccaacacaatattgagggagaagaataaaagaggactgagactaaccaaccttaagatttactgtgaagctacagtaatcaagacagtgtgatattggtgaaagaatagacaaatagatcaatggaacagaatagagagttcagatgttgtttcaggcaatttcgattttcaaagaatgagtcttctatgtgttttaaaaaaaacagtgaatgggttttaatgtgatagtttttggcccaactaaaatttggctctgggtttaatgtgctttggagacattttcagatggtcattaaggattattgggaaagtatagaattggggtttgatataacaaggaacagaaagtatgggctagaagcatagatgtgggtgtgtagggaggagagggtagctgtcttgacaagtggctggagctaggaaaacagtcccagtggaattattgtcagtgaggtgccaaatgtgccgagagataactattgaacaggtgaaaatcaagtgtccaaaaatccaactggattggagtcttcagcacagctctctgtctccacataagtgggggtgtcacagtgtcttcctgagcttgggccaaccagttatccagtttcatgagaatgggagtcctgtcctgcctacttcaagcacccttttcttgccagccagaaagaggcctattctattctacaagtctttggtccaccaccattctgctaccccatgagcacagctccaggactagatttgagttagtgggctgagaaattcattgtcttgagcttacatggtgggggatggatatctctgttatatccattgtatatatgagaaaacagcatcaaagcagtcaaataacccgtccaaggttttagcttatatgtgacaatccatgcttgagtttgattctgactccaaaatccatattctttccacatttcctggtgacttttgtactcctctgctaactcctggtgagtaagaggtatgtaagaccagacagtcccagaggctgctgcattattagagaacgcctatgccaaaatgggaggagggaggagttggcttatctgacccttgtgcttgggtggggctgcagcaccagcaaagtagatggggcctggttggtgtaaaaccacaggatgctttggccttaaggtcccttttgcctagcaagatcggcaaacctgaagatgacaaatctgggaatcctcatttcattttttaaaagctttttgtattatgaagcctgtctctgcttctcaactaaactataggctcattgagggcaggcactttctatgtttttatgtcatgctatcattcagtgctatatgcattaaaaattgttaattctggttagtgagtgcttctgtagagattttaaaactgggctacatgatgcctgaatttctggcaaatgaaaaattttagtaacaaagtataaaagaatgttttacctcatcattgtaagttgtaatagtcacaaacattcccaaaccaggagcagattcaaggaacgtatgtctgcctatgtcccattgctgtatcttgaaagtccctgtttcaaaaatgtaagacattacaacatgtaagaaacagtaataatgtttattagatgttactgttaaattaaatgaatttatctttctcagtttacctaaatcgtaaaacactcttagtctgaacagctatagcttggtgattaggtatctaacagagtagaggactctggagtatagaggaagacttgagttcttcatttctcactctcgtttactaggtaacttgacaaattatttcaccactccaagcctccatttcctattcagaaaaataggggtaatatagatccctctcagatctcagttgtgagaactgccgaaaataagcctatgaaaggtttccacctagaatgtaaactccatgtgagctgccactaagagatggaactcttggaccttttccgaaacctccccagtagttctccctgctttaacttctttctcctgtaacttgatcccatacacttccagcagaattccttgctaaaatatcagtgtagtcatgtcaaatctttcgtttcattgtctccagaggtttctgctgaaggttggatctgaaggagtctctggctatctcccattagtatgtgttagctatcatatgacttaacttccctcatgtgcccttgaaaggtacagtgggaatgaaaaccaggtaacatttgttggacccatattatgcgccaggcactgtgctaaacacttaacatgcatcactcttgtatagatttatgtaactataatatgtgcttataaagtacaaatattataaaattttataaaagtgggagaaaaggcactacactgtctgggtttgaatcctgactctactgcttgctagctatgtgggcaaattaatttttctatactttagtttcattatatctaaaatcgttataaaagtagtatttaccagctgagcacggcggctcatgcctgtaatcccagcacttggggaggctgaggcaggcagatcacttgaggccaggagtttgagaccagcttggccaacatcgcgaaacctcatctctactaaatatacaaaaactagccgggcgtggtggcgcatgcctgtaatctcagctactcaggaggctgaggcatgagaaccgcttgaagtgggaggcagaggctgcagtgagctaagatcgtgccactgcactccagcctgggtgacagaggaagactctgtctcaaaaagaaaaaaaaagtagtatttacctatgtagggttattgtcatgaagagtcagatgtttgtaaattgctccattagaatggtgcttgacatagcactgaataaatgtgttatatgtaaatatatatagataacacgtataaattatacatatatacagttgtgcctcagtatccatgagggattggttccaggatgtcctcaggacaccaaaatccacagatgcgcaagttccttatactaaatggcatagtatttgcatataacctatgcacatcctcccatatactttaaataatcactagattacttataatgcctagtacttaaatgctgtgtaaatagttgttatactgtattgggtttttatttgtatttttatttttgtattgttatttcttattattttttcccaaatattttccatttgcatttggctgaatctgccaatgcagaatttgtggatatggagggcccgctgtatacactcacacactttttagtaaccgaggtgatttttcccttactaccacattatgttatctccatctggagaaaggaaattccgtgcagggacatatgcaaaagtcctgagggcaggaggatgcttggaatattcaaggagcagcagaatggctggagtgaggttagcagggaaagaatggtaggaggtggggttgaaaagatagcaggggccagatcatagagagtcccgatgtccattgtaaggatttggggaagcaattgggtagagaagtgacatgatgtgactttccttttaagtttcttattgtttctgttatgtggagaaaaggatgaagaagggtcaagggtggaagcagtgacactattgtaatctaagtggcttagactatgtgattatagtagaggttgtaaaaagttgttggtttctgtactattgtatttttttaattttattattatactttaagttttagggtacatgtgcacaacgtgcaggtttgttacatatgtatacatgtgccatgttggtgtgctgcacccattaattcgtcatttagcattaggtatatctcctaatgctatccctcccccctccccccacaccacaacagtccctggtgtgtgatgttccccttcctgtgtccatgtgttctcattgttcaattcccacctatgagtgagaatatgcggtgtttggttttttttccttgcgatagtttgctgagaatgatggtttccagtttcatccatgtccctacaaaggacatgaactcatccttttttatggctgcatagtattccatggtgtatatgtgccacattttcttaatccggtctatcgttgttggatatttgggttggttccaagtctttgctattgtgaatagtgctgcaataaacatgtgtgcatgtgtctttatagcagcatgttttataatcctttgggtatatacccagtaatgggatggctgggtcaaatggtattgctagttttagatccctgaggaatagccacactgacttccacaatggttgaactagtttacagtcccaccaacagtgtaaaagtgttcttatttctccacgtcctctccagcacctgttgtttcctgactttttaatgattgccattctaactggtgtgagatggtatctcattgtggttttgatttgcatttctctgatggccagtggtgatgagcattctttcatgtgttttttggctgcataaatatcttcttttgagaagtgtctgttcatatcctttgcccactttttgatggggttgtttttttcttgtaaatttgtttgagttaattgtagattctggatattagccctttgtcagatgagtaggttgcaaaaattttctcccattctgtatgttgcctgttcactctgatggtagtttcttttgctgtgcagaagctctttagtttaattagatcccatttgtcaattttggcttttgttgccattgcttttggtgttttagacatgaagtccttggtttctgtattatgtccccatcgtacaggttggaaactggttctcagataaagtcacataaccaagaagttgtagaggcagaattagaactaaggcagtctgattccaaagcctggagctactagctccattatcacagtgcctccctggaaggcaagagagagacaattccctgatagggcttgagaagggaatgtgaggctggatattggccacaagggcatcccatggaatatgtactctctgggagacaactagagggaacacttccagggataagaaagctgcaactaactttcaagctctgcctgcactgtagagtgacctcagtcttaaggcatctttcaaatagttctggcccatctctcccgctcttcccatcccaaagtttgttaactatatgtgtaatgtgtattcagtactttttagtatgatccattttaagaaggttttaaaaaaggtatcactgatggttctggacaagatgggataggtccattctgtcctatttctcctgctgatttcaactaaaaatcctgggcaaaatttataaagcaactaccagacgactctgaaagaagatagagtggccaaggacctcaggactcatagcacaactcagcagtgggttatctgtttgttttcttcctcctgtatatcctggtctgggtgctatggcagtctgcaacctacaattgcagaccaaaattttgaaaagaacctaatgtctccagccaaaagatctggaataggatgccctgcaagatgaagcttctttgagtatacctccctgtattaggctgttcttgcattgctgtaaagaaatatctgagactgggtaatttacagagaaaaaaggtttaattggctcatggttctgcaggctttacaggaggcatggtgctggcatctgcttggcttctagggaggcctcaggaagctgacaagcatggtggaaggtgaaggaggagcaggccataacatagcaaaaggaggagcatcaagaccaatgaaagtttcaataagaaataaaaaaagcaggagcaagcaagagagagagtggggggagatgccacttacttttaagtgatcagatgttttgtgaactcagagtaagagctcacttatcaccaaggagatggcccaagccattcgtgaggaatccacccccatgatccaaatacctttcaccaggctccacctccagcactggggattaaaattcaacatgagatttgggtggggacaaatacccaaactatattactgccctactccagatgaacaccttaaagaaattgcacccctcccactggatgcttcagcatggagactgtggggtggcgccctgtcaacatgcccaccgagcactaagtgaaggacaataaagagtcagtgtctctacactagagacttggggaggatttcagagaagagagaactggagagaaaaatctttaactctgtgtatgaagtcctgagcacacctctgagcagctcatgcttgaaactgaccagaatcaataaagcagaaactttgagaattcaactatggtgtggaatactgcctaggtttcagattaacctctaggtagcacacaaacagggtggatggaatactactcggccataaacagaatgaattaatggcatttgcagcaacctggatgagattggagacttattctaagtgaagtaactcaagaatggaaaaccaaacgctgtatgttcttactcataagtggaagctaagctatgaggatgcaaaggcataagaatgacataatggactttggggactcgggggaaagggtgagaaggaggtgagggataaaagactacaaattgagtgcagtatacactgcttgggtgatgggtgcaccaaaatctcacaaatcaccactaaagaagctactcgtaaccagacaccacctgttccccagtaacctatggaaaaaaatttttaaataaattataacaatgcctgatacgcttttcattgtatgcagaggtaatatttaagacaactatgttataaagaatgggagagcaaagggacttaaatggtggtaaggtttctgtatttctcttgaaatggtaaaatattgatattactagactgataaggatgtgtatgataatcccaagggtaaccacaagtaaaaattatagaaaaagataaagcgaacaacactataggtaaatcaaaataaagtagtacaaaatgttcaaatagcccacaggaaggcaggaaatggaaaacgggaataaaaaacaggggaagaataaaaataaaataataaaacggcagacctaaatcttgacatctgtaattacattacatgtaagtggtctaaacagacaaagattatcaaaatagattttttaaatgacccaattataatgcagtgtacaagaaaatcactttgaatatagtgctacaggcaggttaaaagtaaaaatatgaaaaaagatataccactttgacatgggtttttaaaaatcttgagtgcctatataaatatcagacaaagtaggcttcagagggctgggtgtggtggctcatacctataatctcagtgctttgggaggccgaggcaggaggattacttgaggctagggtttaagaccagcctgggcaacatagcaaaaccctgtctctacaaaaaaaaattaaaagttggccaggtgtggtggcatgcaccagtagttctagctgctcaggaggctgaggtgggacgagcccttgaacctaggagttcaaggttaacagtgagctatgactgaaccactgtactccagcctgggcaacagagtgaggccctacttaaaaaaaaaaaaagtacacttcagagcaaagaaaattaccaagaataaagagagacattacacaataataaaggtatcaattcaccaagaagacaaccaccctaaatgcaccaaacaagagagcttcaaaacgtggagtaaaactgacaactgaaaggaggagtagacacatccctgtttatacttggtacttctgtactcctctcttggtacttgatagaactagacaaaatcagcaaggatgtggaacaactaattagcatcatcaaccaacaggacctacttgccatttatagaacattctcctatacagtagaatacacatttcttttaaagtgcatttgaggcattcagcaacacaggcaacaaagccctaaaggtgatgaggcacctttgctgaagtagctgaatgttcctggagagaagcgcacagtgaggctttccaagtcactttccaaatatatcaccacctaaaaatcacagttatgtgtgctcactattctctaaaacaactggttcatgtgtgtcttttctccttagcctctttcagtactttcctgcccctactcccacttctcagatggttaccttgtgtcttatggaaatggtaagagtctccacctgctgtggcttgaatggctcccctgagctcatgttgctatttaattgctattttaccagtattcggggtggagtcttcaagaagtgattgggtcatgaagccttcactctcatgaaggggttaaagccattgtgggagtggggttctcatcaaaaagataagtttggcctacttctctctctgtctcatgcactgacttgaccttccaccgtgggctgacccttgccagatgctggtgtcatgctcttggactctcctgcctccagaactgtgagccaaataaactttataaattgccaaggctgtggtactctgtcagagcagcagaaaacagaataagacaccatgttttcaccagcaaatgtcctaacccccccacgtttaccctttctggctcccgcttgttgggatgggtggggttccctattctgtcagtggccaccccctcttattttataggattttgctcttgttgctgcccccacttgcccatatggagctaatcttgtcagcatacccgcatgttctggtggccccccttgtctgtattccgtaaggtactagagggcaggaaatgtattttattcctgtttctttggctgtctagagcctggcagtaaacctagggtggtgtttggctccttggtaggggctcaatacatctttgtggaacgaatgaaagtgtgtcctacagtacatgctcagcaaatgattttgaatgagtgagtgccagttgccccccctcctcccattaaaatgccagtattcctggcatactactttgagttatcagaatggaggaagagaatttctgcttgattttgccaagatcctccagccttaagcacacgccccctcaggtgtcatgcgccatggctgccactagatggcagaagagaagcattgctcctggggagagtaagcctgggggagcactcagtgcagtgtagatgaaataatcgtgtaacaggaggtgtctgtacagaacgcagatatccacggatgagatgctgtgtcttgcttctcactgcgtggtgagagaggctgctaggaactgggatggagcttactagctgtgccgtcttggacaagataccgagctgctcagtgtgtttccccaccagtaaagcaagtataatcatggcatctctcttagggtatgaagaatatgtggcttaatagttgtgtgctatttaacacagagattagcaccttgtaaatgaagctccgtgtaagtacttgatacataattctttacattattattaggcttttaactcacaaagtttttctagcgacattcccatttaaccccacaaccctgttaagcaggtctaacagtacccaattttagagaggaggggcctgaggcctgaagaggctgagatgacttatctaaaatccagataatacgtggcagctccaagattgaaatttagcagggctgattcccaaattcagggcattggccactaaaagcaacaccactactccctacagacttggatgtggggtgtgtgtgtgtgttgtaaaccaactccacatgttgttcttgcagagcctccaggtagaggccttactcctcttgggtgttcagtaaacactgggtgccaggagcatctagaccctgtgggaggggagctgcaccagggatgcagatgctgtccaccaggctgcacctatcctggcctccctggtaccctgtgcccacccttgataaggcagccagcctttccctgtgatccctggcatggctgccccattggctccagaagatgagtccttgaggttggcattgtgggtcatttgggttggtattagaaaagtaaaacattcattgtagggagtttagaaagtaaaatctccattagaagtttttggtatttcatattatccttttagcctttttcctgtaagtacatttttatattttataaaaaatgagatcatactgcacatactatccgtagcttgatttttccacctaatgttttgtgactgtctttctgttttaaatattcttctgtaagctaaattcaggtatattcagagagctgaagaaagacccaacattatcttcccagtgttcagtatggagcttggcagacactgagggtcattctgtgtttgaggaaaggatgaggcaatgggaggccctgtgcatggtggtttaaggcagaattatctggttgaccctggctctggctctaccactcccaagctgtgtgatctcaggtgactttacaaaacctctcagaagtaagacgaggatagtagcaggccctatgtcagggtggtcatggagattaatcagtgcattccctgagaacactgcctgcccatggtcatcactcaaaatgtgctaactacaattaattcatgtctaactaagacagaatggggtaagtgacagaagagggatgatgtttacttaatttcttcaatgcctccttattgatcttagaatgaaatccagattcactaaagagttcctcagtcctctaggacctggcccttttttctcattgatcatactgcctgctcctattctgagggtaacaggaacctcgaggagggtaagtgacatttagactgagactccaagggtgaggggagacttccaggctgggggacggggtctgtaaattcccactgtcatgtgggaggaaagatcatccagcgggtcctgaaattggctgcacgttggcgtcatctggggacctttacatgctgctgatgctcagcttctgcgccacgtgctctgatttagttgatgaggtgcagacctgggcatagaaagcagttgctttcaagagtagctgtgaacatggtgatctcttctagaatgtccccatttcccaggaggatattctgtttccctataacgttttgaagagtctcagtagaagcagcctgtttttgacaaaaagatcgtcagagtacagctcagcacattctcacagacagaatcgccctggtccagacatcgtcagcatcctggaagctgccatgccacctatcactacccccaccaagggagccactacgctgacttctaaatacagattatttttgtctgttgttgtgctttatataaaaatgtatgctctgtgtctggcttcttttaatcgacatttcgtgagtgccgtctgtgttgctgtatgcccatgtagatcactgtcattgctgtttaatactgcatttttgaatatacaactattcttatacatttgcctattgatgggcatgtaggcagtgtccagtttgtggctatttcacatcgtgctgctatgaagactctcgtgcatgtcttgtgagccaatgcgtgcatttgtgttggacagttcctgtttacccggtcatggggtgtgcccacgttcagcttcggtaggtgggaaacggtggtgcctgctcacagcccacagtgtgtgggagctccacatccacgtgtatgcttattttctgttttgttcattttggcatttggtgagtgtgtagtcacatcccagtgggctttgctttatgtttttcctgatgattaacaaactcaagcaccttctcatccacttcctggccattcaggtctcctctcgtgtgaagcctcttaatctcctgcccatttttctatcctgtgaatacgggatagccctctgtgactggttggttgttttcaatgtagacattatgcacatttaccttacatttattcttagatgtgtgtcatttttcatcaccaaagagaaacgattgaaagggcagacacttcccccaagtcagcatctttagacaccatgagtattagcaaacggcctgtggtaaggccaggtatcagcaacactcctggggtgagagcactttgccttggccacagagaagacagttgccgtgacttgggcccacagggctgtagtgggcactgctgatgaccccttgcccgtaaggtcccttcctgctctcttagccacccctggctttggcatgcttgactgcagcttgtggccttaaaggaggccttgggtgctggagccataccctgcacagaggacaggaagagcctgagttgaggtctgtgcctcctcagcctgagccagtgccaacgaatgggatgtgagtacaaatgcccggctcctttgcctggaggtggaacaagctgtggcatatcttatccagattttattttattactgttttttgagacggcgtcttgctctgtcacccaggttggagtgcagtggcgcaatctcggctcactgcaagctccgcctcccaggttcacgccattctcttgcctcagcctcctgagtagctggtactacaggcgcccaccaccacgcccggctaatttttctttgtatttttagagacagggtttcaccatgttaaccaggatggtctcaatctcctgacctcgtgatctgcccacctcagcctcccaaagtcctgggattacaggcgtgagccaccgcatctggcccttacccagatttttaaaaaatgtttttaaaaagtgtggtaaaatatacgtaacagaaaatttaccattttaaccattttaagtatacaattcagtgacattaagtatagccacgttgttgtgtaaccatcactaccatccatttccagaatgttctcatcttcctgagcagaaagtctacccacttaagcaataactcccatccccctgactcccaagagtctctatgtggctctatggatttgactcctctaggtcccttacatgtagtatcatacggtatttctctttttgtgtctggcttatttcacttaccataatatttccaaggttcatctgtgttgtggcatgtaacagaatttccttcattttatggccgaatgatattccattgtatggatggaccacatttgtttatccatgcatttgttgatgcacactttctggctgctgtgagcattgatacataagtatctcagtcccggcttttagttgttctgagtatggatctaggagcagaattgctggatctgtagttatctcatgctcctgggctcctccagggcttgggatgagtctggggttaacctgaaataatgcccttgcttggcctcttcctctcccttctcctgggagcatttccttaacaaatcacttgcacttgaatccttggctcagggtctgctttgtggagcacccaacccaagacaatccagagaggcggtgaggcctcccgtgaagacaggagtgcggtctgtttgccccagtggaatgatggatgatgacccccattgaactcgccctcgtcttccctgtctagtcgctaagacttgtactttgaaaaatagacaaaactacgggtgttttgcagaatgcttgagatcaggagaccctttgaaagggagcatccaggagcacatgttttcgctgattagttttgaattgtaaacattttatgaacagtctgctgcattatgatcactgtgcttcatggtgattctccctttttaacagtccctgctttttataagggactaacacatttttttttttaaagtgcaccaaggactagaaagcaagtggctttaaaggctttaaaactaaaacttggccagacacggtgtctcacgcctgtaatcccagcactttgggaggccaaggtgggcagatcacctgaggtcaggagtttgagactagcctggccaacatggtgaaaccctgtctctaaaaaaatacaaaaattagctgagcatggtggtacatgcctgtaatcccagctactagggaggctgaggcagaagaattgcttgaacccgggagggggaggctgcagtgagccaagattgcaccactgcactttagcctgggtgacagagcgagactccgtctcaaaagaataaaaaaacaaaaacaaaaaaactgaaactcactaggcaggtgggaagaacgtacacagttacccaccaccagcgtcttccctccctgttcctctcatctctacctcttaaatttaccatcaaagttgctttatccgtttttttttaattcaagacaattgaatttattgttaagggacattaataagaaggactaagagaaacaagataaaaaatacagaatatatttggcttaggaatttccaagtaagtttacagggcaaggatttcttaccccaggtttgtcagctggcaccgttggcagatgcgcaagccctgtatcttccccctctcagtgtccagttggggaatgcaggcctttctctgcttctgaagcagcttctctttctttcagagagagctttgagccagagtcagagccacacctgcgtctctagtagtcttaagctacccagaggccaaggggaagagagggtgggaacccacaccgacagagcacctgcaacatgtcaagggtgtgccaagtgctctgctgctccaaggctcatgttatcttcagtttacagagaaggaaacagactcagtcacccagctattaggcaattaaggtggatgtcatagcttgtgtttttgtcgacaaagcctgttttctatcctaagtagtctcggctacctccacttggggaagatggaatatcaatctcttgcagactatttttagtcctaatgagaaaaaacaaacttttaggtagattttgatgactggctctaaggtcatctctctatctctcttgaacttactttctttttcttgttttttgtttgtttgtttgtttgtttgtttagacagagtctcgctctgttgctcaggctggagtgcagtggcaccatctcagctcactgcagcctccacctcctaggttcaagcaattctcccacctcagcctcctgagtagctgggattacagttgcccaccaccatgcctggctaatttttgcatttttagtagagatgggagtttcaccatgatggccaggctggtctcaaactcctgacctcaggtgatccacccacctcggcatcccaaaatgctgggattataggcgtgagccactgtgcctggcctcattcttctaaataaggttcataacagctgagtaggaaacaccccctaaacatctttttgttattaaaagcaacattgatttgtgtacccctgtaactccagtaatatttattttcttaaagtctattttatgctatctttttgttcttatttgcgtggtatgtctttttctattcttttactttcagtctttctgatatttaaagttttcttttggaaatagctgttctttattttttgtttttttaatctagtctgacaatcttggtcttttaattggagtgttttgcccatttgcacttcatatagtgtaaaatatatttaggtttaagtctaccatattgctatttgtttttcatttgtcctatttgttccttgttcctttattcctttcttgccgttctttggattaatcaagttttttttttccatttttctctattagcatattagttatgcattcttttagtacagtattcttttattgattaccttggtaataatatgcatccttgttgcgataccttcttccttaaattagcgtatttactacttgctgaacattgcaagaatctttcagctgtttaactgcgtttacctgccttcctcctttgtgctattgttgtcgtatattttactgctacatgtgttataaactccacaagtcaatatatgtatatgttcatttcccttcgacttgaagagctcccttccatatttcctgtagtacagatctgatggcgaaacaatctcttgagcttttgcttgtgtgaaaatttttttatttcactttcacttttgaaggatattttcactgagtaccgaaatctagaaatctagctttgtattttttcctttattttttaaactttattagttttattttattgtggccagaacacaacatgagatctaccctcttaacaaaattttaagtgtacattacagtattgttgactgtaggtttgatgttgtgtaacagatctctagaacttatttatcttgcttaactggaactttacactcattaattagtaaatcttcatttctccctccccccagcccatgacaaaccaccatttcactcttcgattctacaaatttcattgttttagataccatatgtaagtggaatcttgcagtgtttgtccttctgtgactggcttattagcatagtgtcctcaaggttcatccatgttgcttaagattgcacaatttccttatttcttaaggctaaataatattctattgtatgactataccgtatgttctttactcatttgtccatcaatggacatataggttgcttctacattttgactattgtaaatagtgctgttatgaaaatggggtgctaatatctctttgacatcttgatttcaattattttgggtaaatacccagaagtggggttgctagatcatatgaggttctagttttagttttagtgtttttttggtttggttttgtttttgtttgtttgtttgttttttgagacggagtctagctctgtcgcccaggctggagggcagtggcgcaaccttggtttactgcaacctccacctcccaggttcaagcagttctctgcctcagcctcccaccagcatgcccagctaatttttgtattttttagtaaagacagggtttcaccatcttggccaggctggtcttgaactcctgacttcatgatccacccgcctcggcttcccaaagtgctgggattacaggtgtgagccaccacacccggccagttttagtgttttgaggaacgtccattctgttttccacagcagctgcacccactttgctttcccaccagcagtgcacaagcgttccagtgtctccacattctcaccaatacttgtttttttttttttttaaatagccatcctgacagatatgaggtgatgtttcattgctttgatttgcatttccttcatggcattgagattttttcatacacctgctggtcatttgaatatcttgtttagagaaatgtctatttaagtccttagcccactttcagattgggttattgggttttttgctattgagttgtaggcattccttatatattttagagcttagccccttgtcaggtagacatggtttgcaaatattttctcccattgcatgggttacctttttaccattttgtttcctttaccatgcagaagcttttgagtctgatgcagtctcatttgtcagtttctgcttttgttgcctgtgcttttgttgttatatccgtgaaattattgccaagaccagtgttatgaaacttttcttccctcatggtttttcataggagtttaacagtttcaggtattacatttaggtctttaatctatttttggtttatttttgcgtatggtgtaaaataaaggtccaatttcattatcttgcatgtggatatccagttttcccagcaccacttattaaagagactgtcctttctccaccctattcttgtcacctttgtcaaagatcagttgaccatatatgtgtggatttatttctgggctctttattctgttccattggtctgtctgtcttcacactagtattatactggttttttgttgttgttgtttgttttttgtttttccgagacagagtctcactgtgttgcccaggctgacatgcagtggcgtgatctcagctcactgcaacctccacctcccgggttcaagtgactctcctgcttcagcctccccagtagctgggactacaggcatccatgcccagctaatttttttatttttaatagagacagggtttcaccatgttgaccaggctgatctcgaactctgacctcaagtgatctccccacctcagcctcccaaaatgctggaaatgctgggattacaggcgtgagacaccacacccagcccacagtgtcttgattactgttgctttatagtatattttgaaatcgagtctagatgaagaaaaagagacaattcaaataaaaccagagtgaaagaggagacattaaaactgatgccatagatataaaaatgataataagagactagtatgaataattatatgccagcaaactgaataacctaaaagaaacagataaactcctaaaaacacacaatctatccagactgaatcatgaagaaacagaaagtctgaatatctccttaactaatatggagattgagtacataatccagcaccttccaataaagaaaagcccaggaccagatggcttcactggcaaattcaaccagcgtttaaagaagaatcaacaccaatccttctcagattcttttcaaaagttgaagaggagggaaccattccaaactcattttatgagaacagcactaccctgatactaaagccagacaaagacactacaagaaaagaaaactataggccagtattcctgatgaatatagatgcaaaagtcctcaacaaaatactggtgagccaaatcaaagacgctttaaaaggatcatattattacaccataaccaagtagggtttatccctggggtgcaaagatggttcagcacacataaatcaatatggtatattgtattaacagaataaaagataaaaatcacatgattatctcaatagatgtagaagaagcatttaacacaattcagcatcctttcatgataaaagttatcaaattagaaatagtaggaaagtacctcagcataataaagacattatatgaaaagtcaacagctaacatcatactcactggggaaaacaaaagcttttcctttacgatcaggaaaaaggcaaggatacctgcttttgtcacttttattcaacatagtactggaagtcctagcaagagcatttaggcaagaaaaagaaataaaagacatccaaataggaaaggaaaataatattgtccctgtttgcagatgacatgatcctatacatagaaaaccctaaagactacataaaaaactgtgagaactggctgggcatggtggctcacacctctaatcccagcactttgggaggctgaagcaggcagatcaggaggtcaggagatcgagaccatcctggctaacacagtgaaaccctgcctctactaaaaaaaatacaaaaaattagttgggcatggtggcaggcgcctgtagtcccagctactcgggaggcaggagaatggtgtgaacccaggaggtggagttttcagtgagccaagatcgtgccactgcactccaacctgggcaacagagcgagactctgtctcaaaaaacaaaacaaaacaaaacaaactgtgagaatgaataaatgaattcagtgaagttgcaggatacaaaatcaatgcagaaaatgagatgcatttctatacactaacaatgaactatttgaaaagacaattaggaaaacagtcccatttacaataccaccaaaaagtatgaaatacttaggaatagacttaacaaaggaagtgatagactagtatacaaaaattacagaacattaatgaaagaaagaagacacaaaagccatctcgggttcatggattgcagtacttcatattgttaaaatgtccgtactacccaatgcaatctaccaaatcaatgcaatccctatcaaaatttcgatggacagaaatagaaaaacaattctaaaattcatatggaaccaaaaaagactatgaagagccaaattaatcttgagagagaacaaagttggagtcatcacacttcctgatttcaaaatctatcacaaagtcgtttttccctttccgttcagcatctctgaagatgccatagcttctgttgaaacgttaacaaaatcatttttaagattgaagtaactgtgccctgatatgattgtggttttccctttggttatttttaatttttttctgtttgtatttggctttcgatagtgtgacaatgatgtacctaggtgtggttgtccttatatttatcctcatttggggtactctgagctccttgaatctctgggttgatgtcttccatcaattttcaaaattttttggccattatgtctttaaatattgccttttctccattctctctcacctttctctttggggctgcaattgcatgtatcttaggccatttgtcttcctcacatatcttacactcctttctggtcttttcattcttttttctattgaaatctcttccagttcactaatctaatctccttcactaatcttctttcctggtcttttgttgactctatcgaatgagttcttcagacattgtgtttttcagttccagaatgtccacttggttttttaaaaagagatcctaattattgaaattctccatcttttcatatatcttgttcatcaatttccctattttctttaacatattaatagtaattttaaagtcccgctctgaatcatctgtgtatctctttctattgcctgtttaatattttggcttctggtcattcaatctttttttttttttttaaagcatgcctcataatttgggattggatgctgtacaccatagagggttttttttatttttttggtatattgtagagggtttgaataatgctatcctcctccaaggagggttatttcctgctagcaaacagggctgatctattccagttttgtccttattcctagaatgtaacccacccctgggatgtagtccttatttctagggcctgatcttatgcccagagtgtaacccttgtagggtccagggtgttttctgagatccctccaccttgttgggtcatggtcctttcctgccaggtccatgtggctgacaaaacctctgcttcattcttcagcggttgctgtttcctgctggttgtttttgtttgcctgttttgagtctctctctgcttttatgtaacttaggtatcagccagttatttgaggaagattttaattcagattattaggctccttatttttgtttccttccttttctggatttccctcctcacttcccagccactttggcagtcctgaactctgacctctctttccttggccctttctcttgagatttattaccctaatatacaatttgaaattttcctgagtggaaaacaccaggatgattgtggagctcacctcgtgtcttttccctctccaaagatcgtggcctcttaagtcctgtctgtgttggttgtactcaatgccttcaaacaggtgctttagatgcccattgctcttggaattcccagccttcagaactgtgagaaatgtatttcttttctttataaattacacagtctgtggcattctgatatagcaacacaatatggattgtgacagatggccaacaggcatctcagatttaattaatccagaaaaaaaaattcctgaccccccgccctcccaccctgacccaaaccatggtctgcagtcttctccatctctgtaaattcttgtttatttgtctctttgtgaaccccattttcattctgtcagaatgtcttataggttctgccttccaaatgcatctggtatctgaccatagctcctctcgctggagctcccttgatccaagccccatcctctttcctggatgatgggaggagcttccctggatatctctgcttctgcagccatgtggcatttaaagtgtggattatactaaaagccttgtcactcagagtcaaattcaaagtctgtctgtggctgttgaccaaggtgccgtgatgctgaccttccagccccaccttctatcctccagccagtccagcctcactgtctgcttcctcagacacactccaagtctcccccatccccgtgcatcacagcttcagggttactatcccagtgagttcttcttcgtccatgctgggagcctcctgtccccctctctgagttgttttatgacttgctcattttctaggttattgtttttctctgtccatgaaaccataaacaccctgaaggcaagattccattattatgtttctttccagtttgaatccgcagaatcaagaacaatgactcataggtgagcggtagatatttgctgaatatataaaggaacacggggagaaaaggaagaaaagagagagggagatgatttttaaagggaaaagagtggaataaacataattaaaaacacaatcttcagttgccaagagagcttgaaattaagtcctgggcaactgaccatttctgagcattgaggaagaaccgcagtgagcctgtggcttcaccaagaaaaggttgtgccgcacaagtctcattcctttttttgttagggaataccaacagggagagcttagaacactgtggatatcatggaaatggtaccaacagggagagcttagaacgccgtggatatcatggaaatggcaccgacagggagagcttaggacaccatggatatcatggaaatggcaccgacggggagagttcagaacgccgtggatatcatggaaatggcaccgacggggagagcttagaacgccgtggatatcatggaaatggcactgacagggagagcttagaacgccgtggagatcatggaaatggcaccgacggggagagttcagaacgccgtggatatcatggaaatggcaccgatggggagagcttagaacgccgtggatatcatggaagtgacactgacagggagagcttagaacgccgtggatatcatggaaatggcaccgacggggagagttcagaacaccgtggatatcatggaaatggcaccgacggggagagcttaggacgccctggatatcatagaaatggcaccgacggggagaattcagaacgccgtggatatcatggaaatggcaccgacggggagagctcagaacgccgtggatatcatggaaatggcaccgacggggagagctcaggacgccgtggatatcatggaaatggcaccgacggggagagctcaggacgccgtggatatcatggaaatggcaccgacggggagagctcaggatgccgcggatatcatggaaatggcaccgacggggagagctcggaaatggcaccaacggggagagttcagaacaccgtggatatcttggaaatggcaccgatggggagagcttagaacgccgtggatatcatggaaatagcacccatagcgagagtttagaatgccgtggatatcatggaaatggcaccgatggggagagcttagaatgccgtggatatcacggaagtggcaccgacggggagagtttaaaacaccgtggatatcatggaaatggcaccgatggggagagcttagaacgctgtggatatcatggaagtgacactgacagagcttagaacactgtggatatcatggaagtggcaccgacgaggagagcttagaatgccgtggatatcatggaaatggcactgacagggagagcttagaacgccgtgcatatcatggaaatggcaccgatggggagagtttagaacaccgtggatatcatggaaatggtaccgatggggagagtttagaacgccgtggatatcatggaaatggcactgacagggagagtttaaaacgccgtggatatcatggaaatggcaccgatggggagagcttagaacgctgtggatatcatggaagtgacactgacagagcttagaacaccgtggatatcatggaagtggcaccgacggggagagctcaggacgccgtggatatcatggaaatggcaccgacggggagagctcaggacgccgtggatatcatggaaatggcaccgacggggagagctcaggacgccgtggatatcatggaaatggcaccgacggggagagctcaggacgccgtggatatcatggaaatggcaccgacggggagagctcaggacgccctggatatcatggaaatggcaccgacggggagagctcaggacgccgtggatatcatggaaatggcaccgacggggagagctcaggacgccgtggatatcatggaaatggcaccgacggggagagctcaggacgccgtggatatcatggaaatggcaccgacggggagagctcaggacgccgcggatatcatggaaatggcaccgacggggagagctcaggacgccgtggatatcatggaaatggcaccgacggggagagctcaggacgccgcggatatcatggaaatggcaccgacggggagagctcggaaatggcaccaacggggagagttcagaacaccgtggatatcttggaaatggcaccgatggggagagcttagaacgccgtggatatcatggaaatagcacccatagcgagagtttagaatgccgtggatatcatggaaatggcactgatggggagagcttagaacgccgtggatatcacggaagtggcaccaacggggagagtttaaaacaccgtggatatcatggaaatggcaccgatggggagagcttagaacgctgtggatatcatggaagtgacactgacagagcttagaacactgtggatatcatggaagtggcaccgacgaggagagcttagaatgccgtggatatcatggaaatggcactgacagggagagcttagaacgccgtgcatatcatggaaatggcaccgatggggagagtttagaacaccgtggatatcatggaaatggtaccgatggggagagtttagaacgccgtggatatcatggaaatggcactgacggagagtttaaaacgccgtggatatcatggaaatggcaccgatggggagagcttagaacgctgtggatatcatggaagtgacactgacagagcttagaacaccgtggatatcatggaagtggcaccgacggggagagcttagaatgccgtggatatcatggaaatggcactgacagggagagcttagaacgccgtgcatatcatggaaatggcaccgatggggagagtttagaacaccatggatatcatggaaatggtaccgatggggagagtttagaacgccatggatatcatggaaatggcaccgacggggagagcttaggacactgtggatatcatggaaatggcaccgacagcgagagtttagaatgctgtggatatcatggaaatggcaccgatggggagagcttaggacgccgtggatatcatggaaatggcaccgacggggagagcttagaatgccatggatatcatggaaatggcaccgatggggagagtttagaacgccgtggatattatggaaatggcaccgatggggagagtttagaacgccgtggatatcatggaaatgtcaccgacggggagagcttagaacgccatggatatcatggaaatggcaccgacggggagagtttagaacgccgtggatatcatggaaatggcaccgacagggagagtttagaacgccgtggatatcatggaaatggcacccacagcgagagtttagaacaccatggatatcatggaaatggcactgacagggagagtttagaacgccatggatatcatggaaatggcaccgacagggagagcttagaacgtcgtggatatcatggaaatggcaccaacagggagagtttagaacaccgtggatatcatggaaatggcacccacagcgagagtttagaacaccgtggatatcatggaaatggcacccacagcgagagtttagaacaccatggatatcatggaaatggcaccgacagggagagcttagaacgtcgtggatatcatggaaatggcaccaacagggagagtttagaacaccgtggatatcatggaaatggcacccacagcgagagtttagaacaccgtggatatcatggaaatggcactgacagcgagagtttagaacaccgtggatatcatggaaatggcactgacagcgagagtttagaacaccgtggatatcatggaaatggcaccaacagggagagtttagaacactgtggatatcatggaaatggcacccacagcgagagtttagaacaccgtggatatcatggaaatggcactgacagcgagagtttagaacaccgtggatatcatggaaatggcactgacagcgagagtttagaacgctgtggatatcatggaaatggcacccacagcgagagtttagaacaccgtggatatcatggaaatggcaccgacggggagagtttagaacgccgtggatatcatggaaatggcaccaatggggagagtttagaacaccatggatatcgtggaaatggcactgatggggagagtttagaacaccgtggatatcatggaaatggcacccacagcgagagtttagaacaccatggatatcatggaaatggcactgacagggagagtttagaacaccgtggatatcatggaaatggatttcagaaaggcttttgtatgttagttttcagccaagtcaagaagtgagatgcatccacatctggctgcatgcttgtaattagaatctgactttcaaattcgtctcaatgtgtgtggaagtcttagaaccacagttcatcctgcagtttgttcagttctgattaaaagcactcactccacatgtgccaggcactgcaataggctttggggatacaaaggttaatagaagagttcatgccctcaaagagctcattcagtcctaatacaccttcaaaccggaagtgtccctgctgacacagagcaaaatgaccacttttatgagcgacatgaaactgggaaggggacccagatatcctcctgtccccatccccgtcccccagcacagggcctgtgtcccagcagcctgctggtagaccaaagcagccaaggtaaaaggccaatcccggctctccccccagccagcttcgcaccactcaatctgtgggaaattgagggcatcatatttggaccatgacttacttgtggttgtttgtttaattggttttgatgagtttggtttgcttttctctccttgtacgatttgcccattttctgtcctcggtttttccatgtctgagtaatagtcttcttttgtcttatgcccatcccccgtttttgccagagccttccaccctcctgcctcagtctccacagcctgctccctcggcctcctctgggctggctgtcctgggtcagcggtgagttcttctttcttgggttacatgctttgcggcttctttgctgaatgcagtcaggggcaggggcaggggcaggcccagggagctcgcctgtcttgccctacagagtcttcagctcccagctcttagcttgacccaaacgagatactttcacgcatgtgtgttacaaactggagcaaaaccgcgcacttggcaactaaggagagttagcctgcaaagagaaatctgggatgggtggaatctgtgacttcagttatgacggactttcaggtgaaaaaatgtgtatttattttgagtggacccagatggcagaacaaggatgattggatacagttgtggagatgtagttcctgcactatggacagctgtgggctgtgctccccggcaaggaaaaggcgagcagccaccccagagcgccagtgcagaggctcccttggcactagggtgtggggcaggtgtgggctcctccaccacagggcagtgggtgaggagcaccagacccacaggatggcttccaggaccagtctgtagctcttggactttaagggcatactgttctcttttaaagaaaagttaaaactgtggcctgatgcgccttttttttttttttttttttttgagatggagtctcattctgtcacccaggctggagtgcagtgacgcgatctcggctcactacaacctctgcctcctgggttcaagtgattcttctgcttcagcctcccaagtagccaggactgcaggtgtccaccactactcctggctaattttttttcttctttgtatttttagtagagacggggttttaccatgttggccaggctggtcttgaacccctgacctcaagtgatcacatgcctcggcctcccaaagtgctgggattacaggtgtgaaccaccatgcctggccctgatgcactttcaaagttttccataacagtgagttttaagtagccaagctctaaatctaaataattgcccaagggtgatggttaaggagactgctgagtgggaagaacagagagtagggaggcttgggaagaccaggtgaggaggagcagtcagtcagagaagagccttggcaggaactgaggagggaggcgtggacagcagcatccgtgggaaggaggactccagaggctcctgacttgggtgagggagccagccacagtgggccctggtcttccagccagatgggaccgcttgccagaggatccttggggtgtcacatttctagctggaaacttctgtggctggtggcacccttgcccgagttttgcttgggcccactgggcttgttctgcccactcagcctggcatgctgcactcaactcacgctactggcctggatcccacacctgccaagagcgagtcaggcacagagcagtgaggggtgtgtgagtgagcatggggtccagccactgtgcagtcaggcacacccgcagctgctgcaaggtgggcagctccagtgctggcatgggcgcccactctctgcaaggctgcagctggaccaggtgcactgcaagcagcttccacagctggcactggggaatgcagtatgccaggaaccacagggccccaaagagggagtccaactcagaaggggcagggctcctgcttgttcctggcctggggggctcccaagtctaggctccctgaagggctgcagctcttctctccttctcttcccccatagcatggcaagcaaggggcatgtctcagccctgtttgtgttataccagctcttttagccttgccatttgacgggtcccaagttcttgtcctgtgaccaggaagaatgaggtctgcagacaagtggagggtgagcaagaggaagacgagctttattgagcgatacaacggctcagaggagacccgcaggggcagctcctttccacagccagggtgtcacaacgcgtgttcagctcctagcacagaggagaccgtagagtgggaagctcctcttggcaggcaggccatcctgtcatctctgaggctctcagcagagaggaggccctggagtgggttgctcctgtctgcagacgggccatccctttgtgcctgcggctctcagcagagaggaggccctggagtgggctgttgctctctgcaggcaggtcctcttgttgtctccccagctctcagcagagaggaggccatggaatgggtagctcctctctgcatctggttgccctgatgtctgctcagctctggttgagcctagggcttttatgggccttagaggggaggaagtgcactgtgattggtacattggcagtcatgggtaaaggcaccagaagttcccactctggtctgcaggactggcagcccagtccccagccttcaggacctccctggcctgaaggtgggggcctcaccagggacctgccctcttccacccaggaacttgtctgcgtcctgctgctattcatggtgtccaggctataggtgccaaggggtgcctgcaggccagtgccaagctaccctcagcccacccttggcttccctcctattctcggtgcttaaagtctggagggtgctgaggcagcagggggctggtgtattagcactgccctgagcgtgtgcacacctggccaggctgcaacagtgcccaggctcgccctgactttactctgagatcaaagtggacactgacagcagggagaagccaggcagcagaagcaggcacttccaaacctgcgaaggccggggatggggcttcctgggccccctagagtgcagagatgcctgggtctgcagccatggtttgggtggctgtagctgcgcctaggagaggggcttctctctgctcccggcttccaggagcacagggatgcctgggtctgcagccatgacttgggcagctgcatctgtgcccagaggggtggggctcctgcctgctccatggagcagaaggcctggatctgcagctgggacttgggtggggcttctgcctgctctgtggagcaggaggtctgggtctacagctgtgacttcagtggctgcagctgtgcccaggagagtggggcacccatctgctcccggcccgagagcacagggatgcctaagtctgcagagagctaccacccaactcggaaggggcagggctcctgcttgtccgcagctcctgccagttccatggagcatgcagccctggctgtgcctccctgctgcagctggcatgatggcaccagccactttagatggaccgtggtgtcatcactgagaccctgtcttgacacagctgtcaggacactctctagccacacttgccttcctgctgccagtgccgccgtggctcaggtggctgcagttccttgagatgtcccagtgggtcctgggtgagcccatccagctgatgggccatgaggcaacaggcaagtggacaggccagcactgtcccccttcctcttcttctgccccttcaactgcaggctggaaaattcatatgttaccaggaaaacagccggctacccagggctatttacctcaggggccaagcttcccgtgggatgagatcgttgggctcagagaacgtgttgagcaaacacagtactttctgtgagctgggttaggttgtaaaagccttacaaagagtaacctaatcatcagcacaaccaacagaaatagatgtttgtttttttaatcatcattgcatttcacaaattaaacagagggtaagtcacttgcccagtggcacacagctctcaggtgacagactgggatttggatccaggcaggcttgtacagactccagagtcccaaatatggcttcatccacagtgtcggagcagcagcgagggctctaagaccacccagctctcttcctggctattttttccatgctactcatcccaaaacttgatctcacattgctctgtttctttctctgcctccatgcttgatgcatttacttaatctttcgcaggatgggtcattactttttgcaatagcacactcaaaggtaatgaccaagataaattgaaaagaggattcaacagtattcattgtaagattgaatgggatataaaatacgtaatcagcacttgtgaggaatatcactagattctcttcttcctactccccctccttttttttttttttttttttttgcattaaaacccgggaatttgatgttgattgtggcctaaatgttaagcatattctggattttctacaccgttctgacaccacaggtacttgtttctttctcagaaggcaggtgaagctcagctgtgtggggctgtgcttggtggcagtgtgggaaacgtgtggaactcaccatggtgttagcagcttttactagccgtttgcttggaaaacagtctccgatctgcacttgcacacccaccacgatgccttctccccatggctctgtggacaccaggaggtcagggcacagaggacgtgcgacttgtgctcctgtcttgctgcacagtctaaagacctcacgtacgttttgaatgttcaaccactattagagtgagaaatggcatccaagatgcttttactgaggaacattgacaactggaaaacaaatcaagcttggattccagggaacactgtccagatttcctgttttatgaattttaccattcactcttaaggctgttaggtttgaataacttgataaatgatcaagagaaaaccatgcagcattatgttcactgccaagtaatatggacgtagaggatggcagaattctgtaaaaccacttctggagttcaacatttaaccgagcacattttacttacctgttaccagtgtgtcgcttggaatgtcttctattaggcatttctcctcacgttcccctgcgtggaaataaaaggcagttgaaaatggaaaaccaaaacataaaagaaatgttaacatttgcatttctgttgcttgagccacttctgataatactttctttgaaatggatccgttgcaagtgccactggttagtgggtgtttgtatttcactggctaattttgtaaaattgatttttgtgagaagtgacacgtggcgctgacactgggcagatacttgcagcaaatccgacgaacaagataaaaaggcgtaagaatttggggcctttccaagctgatgatgcagagttctttctgatccgccactgaaaagatgttgaagcattctgatggagtgaagaagcttctaatgaagatggtgtcatggagtatgagaaatgagagatggggaggcaggtgtaggcaggaggggagggaggctgggtgtgggggtgaggctaggcatgtcgaggggaggctgggtgcggtggggaggctaggtgtgggggggtgtggctgggtgtaaggggtgagtttgggtgtctggggggagtctgggtatgttgggggaggctgggtgtgtgagaggagtctgggtgtgtgaagggagtctgggtgggtgggggagagctgggtgtgtgggagggagtttgggtgtgttgggggaggccgggtgccgggggaaggctgggttgggaggagtctgggtgcgggggaggtgggtgtggacctgtgggtgggaggaagggaacctggctaaagtggaaccacctggactaggaagagcgcgtgccctgaagagactaagtctgtttcctcatttaaaaaaggagtgaaaatcacttagtgatccattaggtcttttcagctgcgacatccggtgttttctctttaaaccttttatttaaaaatgtctgtagactaacaaaaagttacaaaaatagtgcagaggtcctgtgacccattcgtcaacgcccccagtgcaacgtcttatgtgactaatcactgcaggactgcatcacggggaccgggcatttgacagtggcagagaacagctagctcggctgcaaagctcacgtgctcacatttttgcacacgcttgttttttgtatgtgagtgcaccatcatgagaatgcttcagcgagcccttttgagcactctggaaagaagtgggaagatggaaagaatgcatcgtgtggtttggagcaagtgctggcagccgagggcctgggctgtctgactacactgcttctcagtgacgtgagtgtggacagatcgacggacctccgggccgtcacccataaggcaggggcagtgcattgtcgcagggattagatgacacaggcggtgtgggcttctcagccctggtctggtgcatagtgggcatttggtgaagggtgtagctgttgcttttctggtgccaggtggagctctggctggattccaagcgtgtggcaagggtgaccaggcacgcacctgcagctgtcttcatccacgacctgcccttcctcctacctaaacccagctccagtttcagagcccaccttttccttcctcctcagagacctctctcccttcccactggtctgttccctctgcctcagtctcccaaacagccaatgttttcctttagagatgttctgaagcacaatgttgacaagcctagactctggggccacactgtctgggtgtccctcctctgccccttacctcctgtgcgatcctaggcaagttccttagttgttctctgcctcagtttcctcatctgagagaataaagagcccactttatacggtggctgtaaagaccaaatgatactctctgtgtaaagtgctaagaacagtccctggcacacagtacactctgtgtaagtgtttgccagtgttatttcatagcctgacatcttgaggggttgccagataggctagctccacttctctacttcctcacacagctaaaaaaaacaaaaccgtctattctagaacagtttaagcacatgaaactagagaattgtgtgatgaaccccaaactagttttacttaaccaacacacacacaccacacacacacttttaaagtatgtcaggtcagaggccgttttcacctatcggcacttcagtatgcgtcactaactagtgaggaccttattaaatgaaacagtcaccaaccatgccatcacagcaaggttaataagaatcccttcctgtcctccgacacgcagttcacagtcacatttccctgattgacttaaaaggtctttttcacagttgatttattttgatcagtatctaaacagaatccacacatgacacttggttgctatgtctgttaaaactcttttatttatagggtctgccttccccacacaagtctctttcttaacccactaatttgttggaggccctggggcccttgctcttggcggccggcatcccagatgtggtgaaagtgtcctcaggtgccgttggactcagcacaccttcgctgtgactgcaaatctctgggggttctttttgagctcacgccctgatctggaggtgaggacggggcctgggcactgacactgatgctccagagactgtgctgggagtggcgaggggttggctggctcttcctccagcttcccaggtactggcgtgtgcagttagagttgatgagactcgggctcagactttaagctagagttgctgctgagtgcctcctggtgcctcacagtggaggccatgatgtccaggtgtcctgccttgagtgaccacagcccatcaggggctcagtgctgtccccgcttgccccttgtcaggttccctcagcctctgcctggcagttttgacatccactctctctcgattcctctttcctcagtggttgctacaggagaacttctcaccaactagctgcttgccctgaagcagtttgtacaggaaaggccggccatgggcttggttctttccctagaattagcagttttcaaaggagtatgtttgttccctaacagccgccatgtaaccaatggggattctttaaagtatcattatgaattcatgagtggctgggtatttaatgcttttctgatatattggagtcattattcttaatacttaaattgcccaacctttggccaatggtgacccttcagtttcactcctgtgtcctttagacagaataacattcactctttaatataatataaaaggcattcacgtgaggggcatttgcttctgcagatcgtcattgccctgagctttctcaggggacagagctaggaaaggttttactgtgggcttatttttaaattaaaaaaggagctcatattctcatgtccaatcgaagtgtaagactaaagagttttacttcatttcattgaatatatacttgtatctcttttatgccaaaaatctacttactggcattaatacaatatatttgctttatccttcaacatagctatacaggccataccttggagacactgcaggttcagatccagaccaccaataaagcaaacattgcagtaaaccaagtcacagaaatgtttttgtttcccagtgcatataaaagttatattgacactatattgtagtctattaagtgtgtaataagcactgtgtctacaaaaaagatgcatgtaccttaattaacatactttattgctaaaaaatgctaatgattatctgagccttcatggagtggtaacctttttgctggtggagggtcttgccttgatgtagacggctgctaactgatcagggtggtggctgctgaaggttgtggtggctgtggcaatgtcttaaaattagacatcagtgaagtttgtcatatcaattgatgctttcacaaaagattcctctgtagcatgtgacactttgatagcattttacccacagtagaaagtctttcaaaattggagccagtcctctccaattctgctgctgctttatcaactaagtttatggaatattctaaacccttggtttcatttcagtgttcatagaatcttcaccaggactagattccatctcagtaaactactttctttgctcatccataagaagcactcctcatcagttcaggtttcagcctgagattgcaataatttggtcccatctgcaggctccacttctaattctatttctcttgctgtttccaccacatctgtagagacttcctgcactgaagtcttcaactcctcaaagtcatccttgagggttaagatcagcttctcccaaactcctgttcatgttgatatttgtatgtcctcccatgaatcatcagtgttttgaatggcatctggaatagtgaatcctttccagaaggttttcaatttactcgtccagattcatgagaggaatccctatctgtggcagctatagctttacaagatgtatttctcaaatagtaagacttgataattgaaatttctccttgatccatgggctgcagaatggatgttgtgttagcaggcatgaaaacaacagtaatctccttatacattttcatcagagctcttgggtgaccagctgcattgtcaatattgtcaatgcatagtaatactttgaaataatcttttttttttttctgagcagtaggtctcaaaagtaggcttaaaatattcagttagccatgctgtaaacagatggctgtcatccaggccatgttgttccatgtatagagcataagtggaggaggtttagcataattattaagggccctaagattttcagaatggtcaatgaggattggagtcaactttaagtcaccagctgcattacccctaatgagagagttagcttgtcgtttgaagctttgaagccagacactggcttctctctagctatgaaagttctagatggcatcttcttccaatagaagactgttttgtctacatttgaaatccactgtttagtgtagccgtcttcatcaatgatctcagctacatcttctgggtgacttgctgcagcttctacatcagcacttgctgcttcaccttgttctgttttttttttcccttaaacctcatgaaccaacctctgctagtttcaaacttttcttctgcagctcccttacctctcttagccttcatagaactgaagagaaagccttgctctggattaggctttagcttaagggaaggttgtgtccggtttgatcttctatctagaccactcaaactttctccatatcagcaataaggctgtttcactttatcatttgtgtgtttactggagtggcactcttaatttccttcaagaacttttcttggctgggcacagtggctcatgtctataatcccaacactttgagactgaggcaggaggattgcttgaggccaggagtttgagaccagcctgagcaacatagcaaaaccttgtctcgacaaaaaaatacataaaaaaaaaattagctgggcacatgcctgtagtcctagctagtttggaggctaaggcaggaggatcccttgagcccaagagttcaaggttacagcgagctatgatcatgccactgcactccagcctaggtgacagagcaaaaccctgtctcaaaaaataacaatacttttttctttgtattcacaacttggctgactgtttggcacaagaggcctagctttcagcctatctcagctttatgttaatcatttctagcctttgattgcaagagagagatgatggctcctcctttcacttgaacacttagaggccactgcagggttacttgttggcctaatttcatattagtatatctcaggaaatagggagacttgaggagagagagagaaatgaggcaatggacagtcattggagcagtcagaccacacacaacatttatctactacatttgccatcttacgtgggtatagttggtgacgtcctaaaacaatttcagcagtaacaacaaagatcactgaacacagatcgttataacagatataataatgataaaatacactgaaatattgtggcagttaccaaaaagtgacacagagacatgaagtgagcacatgctgttggaaaatggcgctgacagacttgctcaattcaaggttgcctcaaaccttccatttgtaaaaagcacagtatctgcaaagcacagtgaagcaaagtgcagtaaagtgggggtgtccacaagaatttccaaagagccacaccaacatttgctgctatcaaaaagactacgaaatgccatctaagatttctttgccattctctttcgtcttttcccggggacatacgcacaaaaacaccatttaaagttattgaagtaattattttcatataaagtatatttcatttgtgtcagtttgttttcaatatttgcagtttagtcattttgcctctttaaagttcactatttttatttttgattatgtaaaatatttacatggctcaaaaataaaattatatgcaagaaaagaaagaacagatgagacaaaataaaaatgaaattggtagatttaaatctgatgatatcaattaagtccattcgatgtaaatgacataaaggcagagattatcagaccagtaaagaagcaagactcaaataagtaatgtctacaagaaactggcttttaaaaagatattccatgcaaactctaatccaagaagtaggagtgccaatattaatatcaggcaagatagatttttaaataaaaggagattactggagataaaggagcatttcataatgataaatgggaactatcttaaatatatatgtacctaataataaagcttccaaattttatgaaacaaaaattgccagaattgaaggagaaagagatacatctataattatagttggagatgtcaacaatcctctattagtaatataacaaataaagggaagtcagtaggattagtgaagacctgaacgatgccatcaaccaatgtgacccaacttgagcaaactaacattagtgaaacaccacactcaggcatgacaggatgcacagggaatatttgccaagataggtcttacttggggctataaaatagtatcaataaatttacaaggattgaaatcatacaatatgttcctgaccataacttaattgaattagaaatcagtaataaaacttatatgagaaactgcaaatatttagatattaaacacagttttaaataaaccatgtatcagagaagatgtcacagggaagataggaagtattttaattgaattgcaatgaaaatatatttcttttgtggtatgcggctaaagcaatttataaagggaaatttatgcctttaaatacctgtattgagtttgagaccagcctgggcaacatagtaagatcatatctctattttaaaaatttaaaaattagccaggcatgatgacatgtgcctgtagtcccagttacttgggaggctgagataggagaattgcttgaacccaggaggcggaggttgcagtgagctgagatcacgccaccgcactccaacctgggtgacagagtgagactctgtctcaaaaaaaaaaaaaaaaaatgcttgtattagaaaagaagaaaagtttaaaatccatgacctaaacttctaccttaataaactacaaaaagaaaagcaaattaaacctaaagtaagaaggaaggaaacattaaagattgatggaagaaaaagtaaaagtaaagtgtggaaatcattgaaacaaaatgaacaaacactagagaaagctaatgaaactaaaactcgttctttgaaagatcaataaaattggtaagtctgatcaggggagaaggagaaaaaccacaagttaccaatatcagaatgaaaggggatatcgttataaattctacagataataagagggtaataaagaaattttatgggccagtgtggtagctcatgtctgtaatcccagcatttcgggagactaaggaagatggatatgacttgaggagtttaagaccagcctggacatcatagtgagaccttgttgctacaaaacaataaaaatcagctgggtgtggtgggggggtacctgtagtcccagctactcaggaggctaaggtgggaggatggcttgaacctagaaggctgagactgcagtaagcagtgactgtgtcactgcactccagcctgacgacagagggataccctgtctaaaagaattttgtgaatgagttgtgccaatacatttgacaatttagatgaaattgacaaattcttcaaaagcacaaattacaaaaactttcacaagaaaaaatatttttaatagcctaatcaatctaataaagaatcgaataaataaattttatttgtaattaaaaactcctcccacaaagaaaattctaggcccaatggcctcactggtgaattctgtgaaatattctataaaacgtttatgaaaaagttaatatccatttttcacaaagtcagagaagagagcacttggattcattttatgaggtcagcattatcctataccaaaattatactatgacattatagaatctagtaataaatgtatttggaactgacaattccctgtgcttttaaacattctgtggttaaaaatttgcccagttatttgaatttgggtgtttgttttttgggggtttttgtttttttgagaaggagtctgtatcgcccagggtggagtgcaatggtgcaatctcggctcactgcaacctctgcttcctgggttcaagcaattctcctgcctcagcctcctgagtagctgggattacaggcatctgccaccactcccggctaattttgtatttttagtacagatggggtttcaccatgttggccaggctggtctcaaactcctgacctcaagtgatccacccatctcagcctcccaaagtgctgggattacaggtgtgagccaccgtggccggccagttatttgaatttgtgaacctgaacttccagcttaggatttgttttcctcggccctgctgatcagctctcactttaccgctgcttttcagcttctctaattttgctgttatttttttctccatctttggggaatttatacttttgttattggagagatttaaaataatttgtattaccattcctcaaatctcagaccatccttttgggataattttcctccaccctgaacaacatcctttagaagtttttcagggtaattatcttggtattaagattcttcagtttctgttaatctgaaaatgtctgcattttgctctcattcttaaaaggtgttgctgagttcccagctgtgggttgacagttaatttctctcaacatttcaaaagttattatctgactgccttctgactccctttgggctgttaggaagtagctgtcattcaatagatgttccttcataagcaatctgtacattcctctgggtcctttgaaggttttttcttgttttttttttttgttttttgtttttttttttttgagatggagtctcactgtctcccaggctggagtgcaatggcgcaatcttggctcactgcaagctctgcctctggggttcatgccattctcctgcctcagcctcccaagtagctgggactacaggtgcccgccaccgcgcccagctaattttttttgtatttttagtagagacagggtttcgtcgtgttagccaggatggtctcgatctcctgacctcgtgatccgcctgcctcggcctcccaaagtgctgggattacaggcgtgagccaccgcgcccagcctgaaggttcgttctttgtgtttagtgttcaccagtttcaatatactgtgtgtgggcgtggactgctttcacttctcctctttggaatacattatgctttctgtttctggagacagcttctaattttaaccagtgctgtaaatttgcactattttctctttaaatattatctcttctccactctccctattatctcctttagagtctctgatttaaaacattttagaactttccatcttgtcttccatatctttgtgaaatttcccatttcctgtctctctgtgctgcattctgcctgatatcttcagctagatcttccagttcactaattctttgttcagctatgctaattagctctccaactcactcaggcttcctcattttataatttttcctttccaaatgtatctgtttgtttctaattt

SEQ ID NO: 1281 - DNA, 64316 bp, Homo sapiens
gtagtaatgatgatgatggcggtggtgatggtgatgatggtgatggtggtggaatggtggtgatggtaatggtagtaatgatgatgacggtggtggtgatgatgttgatggggaggatgatgataagtggtggacggggatgacggcgatgattaataaccctaatcctcacaatgaccttatatgtaagtacagatgagaaagctgaggctaaaagagattaaataactgcccaacgtcacatggaatatgggagagacagaactcacacccggatccttatgattttagcttcatgctttcatcagttgaagtattgtagaggatctgtttgttttctggctgcccagcagcctttcaccctacatcccataattctggtgagggatctaccttttgctcccttctgggtatgaatggggtcctgcctccaccttcagcatggaacagctgatgcaggtcagagccaatcagtgacgggctcaggggcaggaccatgacccaatttcagtctctcagagtggacagactattgttcatgtaagggagagagtggcctttcttattctttctcaacagagccagagccaccacagcatctgcagccacgggagtgtcacctttgtgccccaaatagtgcctactccatgattgggagggtctggggtctggggcctaatgtgagcctgaagacttttcagctcactaagaatttgccttgttttgcttaatccaatttgagttggattttctgtcacttgcaagaaagagtcatgttagattcaactctattccatattattagtaggagctgccatggtggagtgcttaggatgtgctcggcacttgatgcactttcttattatttccctgtaacagccctgcagcccacatcagctaggaaacaatcagcgagagctcacgacttttctaagtcccgacagcccataggcgggagccagggttccaattcaggtttgtctgtaccaccctgcaccttctctgagccccagcttcctcaatggtaaaatggaaacaacaatacctaacgcggagaggtttctagtatttaaattttaaaatatgcaaacaccaggagcagcctggcacacccataggtgtccctcaagccaagtttccttttatttggcctcactgctcccagactaagcagtgcagaaaaagggaacaagaagtcaaggaggtgaggttttaaatataataggaaagagacagaaatagggaacccagctttgaaattatctaggccagtggtttttaacgttttttaaaaacccaaaagacatttcattaaatgaaagcttatacaaaaggctgatgtgcaaagcaccatttgaaaatgctggttttacagggattagagccaagtgatacaaagaggtaacgtgtgtagttcaggtctatctggctagtggcagagtcagaacgcttttccagggccccagactccctacgccctcacctgcacctctgagaaagcggaattgagacattaagagttttagttttcctactgccaagggggtaaggctgatgggtataataattgtcagagcatactgcaaagagaaggaatccttaaaatgtaatacaggtgctgacaccacatcctgcacaagtgttccctatcttgctctcacccatcaaccaatatcaaatgccatcctagatttggggccacggggcctgtctgcctcttccccagatgtaggtcccctgcctaacaccctcccacacacgttagacatgtgggtatttgggaagaagactagtttaactataacttttgttgttattgttttacatcatatttagaaacccagtctggtgaatttcaaatgaaaaataatctaacacccttaacttgagatctgggtcaaaaccccacttacctgggaagcaatatgaacgctgaaattatgattaagagactcagtgacctctactggctttttgcttgcttttggtgtaagggaaacatacgatcatttaaaaaaagattctgaaagcaaaaaaagagagagactcaaagaaatggccccctccccttgcccacatcccttgaagactgattatggagacatagacaggtgcccaggcaaagtcaggagagttggacaatgttcatggataggaatttgtacaaggatctctaaaatgctcattttgtaacatgcactgtaggtcaaaaacaatttgttatacgggcaatggaattgatctcaccttgggtttctccccagccagtgacataacattcaatccaggcggtgaccacgtaatttggggatggcagacaggctgggattactctgtcagtgatgatggcaggcctataagggaagtattagcagttatgtttgactgcccagctgggagctgcagtacctataactaggcatccttaccttgaggccccagagccctctgagctggcactgccttgcttcaatgacacagagcaacgtagaacacagcgtttcaccctcacatttgcctgtggttgcctatggactacacagatgtaaggtttcatttgaaaggcatgagttgcatgcaagaagctgagggtggccttcacctttgaaagtagggatgacaaaggcgcacttctcatgtatattctgtgcacgactgggatctcatgccaagtgtgtcctttcatattaattgaagagggcattgatgactgggcagaatgtctggccgagacatcatcaagagggtataaaattgcaaatgtgttgtgtgcccagagcaagttgctccatctggatcctccacttcctccttgtgaatgttactaaaccgtggttgtaagaatccagtaaaatgctagacatcaaatgaaagaggattggaaataagcaccttgcatgaacaaaatggcattgtcaaagaacatttatatatcttagagttccaggaactctcaaacattagaactctggtttttagacctgattctactttagtaagttcaaggggataaaggactggatatgagaaatgccctattctgacaaagaatcatcattgccaccaactttgaagcagacacactttctgcttctgggcaacagacatctgtggtgcagaagtcctcagtctacaggttccctggtggagcactctagggtgtgaggatgtggggtgggaactctaaactcaaaatgtatcagcctatcagagaatacctccaaaactcaaaatttccaaattgctttttcaagccatcagaacaccctagctctctgaggaccatgaggagcggagaccttgtatttgcacatttgctgggatggtggggaggagactggggagcacgagagagatcagctactgtttaggctgagccagaaaggcccttctctccttcctagagtgtcagagcatcccagaacatcacttgctttctaggactgcataggcaggtgatagctcagaatactggcgtgagccactcggagccagagtgtaatgaagagtacaggtaaaaagtgcatgttggcagcactttgataaatccatgaggacacagaccaccacgcagtttaggaaagaatgaatctgaaatatgtggaaggtgaaagctctgtaaagcaaggagtttctaaccaataaagtaaagaaaaatcaaatcaacggcagagtgaaatgcaatgtgatcaggtttgtcgatggcatttcataaacctgtgaaaagaaggctctttaggggagaacagtaattgagcacaggcaccctgatgtagaagtgagccaaggaagcaaaacatgcaggcggttgggcctgtttcctatgcgtgtttcctaagagatacccaagaaaactgaacttatgaaaggcatgttccactgaaacaatacccaaaaggtccaggttctgtgggattggactgattactcttcatttatggggatcatgacctataattttttcctgtgtttgtgaatggatgagtagcctcggcattgaattcaatgattcacaaaagtgtaaaaaaaaaatcgtgcctgtgacagactgtaggtaagtttgctcttgtcctccctcactgcaaagtgtcacatttctaaaaacttccctctcttttcatctgacagtgagacaatggatatccatagaaaccctcagagcatcttcaatattttccagcaatatcggaacttggtgcaaatcactgcgcctacagattttgatgtagctacttagatcaagaaaaagattccaattttggccattttcaaagtagagaacctaaaataatataattatttttatttttctatattttttcctccttcagaaaacatagaggcaggtactgatgcctcagctgtgtgggttctgtgtaaatgtagaaggattttgtggggcttgtgtggaaggacaatatagttggtttctgggcctgttcttaccttgttgtaagactgacttgccagggccaggaatgtgggtgggccacacaaccccctacaatgcttctgggacatttctttggctccacttgaggcttcccacaatcaaatgaagaggatgctgtggcacaaggtgggaaagaagtcgcatttgagtccaagttggcaattttgtcaattaatttaggacaaattccaagcactgagtttttgatatttcaaaggtgaaattaaacagtaaaattataaacaacttttagattttttttctaggtttcaaaagtggtagtaaacaacacaggatgctctcctttcaaggaaatataagcgctttctaattattttgttggagaagtgatcaaagaaattggtatagttcagcattagaatgagatcttttctgagaagaccttgattggcacaaatagttattcgtcattgttattccgaacaatgtttagaacatgatgtcatccttcccatcatcatcctcatcaccatccccatctaacccacataaagtttacagaaaggcatgaaggtttcttttgcatgtgagtctgtgtgtgcacgtgtgtgtgtgtgtgtatgtgtgtgtgtgattgtatgtagcaaggattactgtcctaagttgaaatgttgccttctctcagccagcttcaggacagctcctctggggagcctcccatgactaactgactgtcattggggtgacttacacacatgtgcctttatttttcttttacctcctctctgccttctctctgcagccagcctgcaagatctctggaggtaggaacagtgtcccatctttggtaccacccatcaatgcctacaacagtgcataggctacagagggtgttcaaaaatgcttctctgtctccagtccttcaaggtcttcaaaattataaacattaatatagttaataatattcacataattattaataacaactgcaagaggaatttcctccccaaccaaccagagattctacactccagtgaatttggaacctgagttttccaaataactgtccatttgccatgggctgttctgagaatctatctatataagtcttttttttttttaaagaaacattgcatggaatgaaatcatcttccctagtgctgaactcaatttctgctaatatgccttacacacagtatacatgcatcattgtactaaaagagtaactacagaaattatggtacctgctcctactatttaaaataaaactgaatgtttctatttatttttacttattatttatactgaatgtcttagtggaaatgaactagctattaaaatcattctccaccagagtctctagatttctcaagcatgagtcaaacctgaataaaccacatccttctgcaggaaaccaaacccaccaaccacatccttctgtaggaaacagttctgaggatttccaagtgtcttatgggaacccttctcacaaggcttggggttaacctcacttgtcttacatcaaggttaggtgggggacctcacagtccattgggaaaaatcttgctcccattcttccttctttctccaatctttaagaactcgattctcatacaacctttatgtgggtgaggacagcagaaatgcacctgggaagctactgcactttcctaccataggagtcaaaggtgcatgagtcccaggcacagtagtggggtctgaggcaagaaagtcagtgtgggctcaacttcaaggcagcctgtcaaggatagagagcccaggcagtgagaggcagtggcatgtaccagacggggccagaagtggagaactggaactgaccccatcgagggactttcaggtagaggagccaccaagatgcttctgcagaacaaacaaaaacacccactcaaggaaaaggtcagctatcaactcacactaaatccagagaccacaatgccacaatacaataatattggccaagtagaatctttactatcaccctaacctctcattcttccctcttgctctccccaggagtgtcccaaatgcgaagctgggcagtgtggctcccataatcttcatcactgccctgtaccgcctccccaggaaatcttggaatggtggtcttcagtggacttggaggccaagctgcttcccccagctcaaggttcttccacatggcagacccaaccacaagcaaccaaattatacaaatgaaaagtccaggacagctttctgtaactaggacagacaagttgattggtcagcagaaagtaaaataggggacaagtccaagtggctttttgttttttcagaaatacccatggatttgttatcccagttgtttaagatctaatgtcaactccacttaccctgatccaagcctcatactcccaacaagagtcttggagcaatgaagagggaacccaacaaacagtctctaagcaatgatgctaatgtgaatcgtgaggaataatcttaggagaaaggccatttggggctaaagagctgcactacccttcactgaattcctaggatggccatctgtaggtttacaatgtgcaccacatgcttagctgtgccctgctgttcgtatatttttcatacttctcagctgcagaagagaaaggttttttatccgaatgactgtaaatttctttttcatgcatcccatgctagacactgaagtgctcagtgggaccaccctggggctgattagatcacctctaagtgtgctctttgggaattttacatttattttatttatgtgtgtgtggtgggaggggcgggtgtttccctaacaaatggggccaattgtagggcaggttcaagatgcccatgacgaagggcaggctctggtggagagggcagccatctcctccccagaagcactcagctcaaaagccattttctggtttttttttttttttttttttttgcaaatccatatgaaggaagcagtttccttaccaaaacagaaggcaacttaccacagagagggatatcacagtagtcaaaaagttttcttggattcactctgtagcaccagggaccattgatgtcaccatcagggttacggcagtactgaaaacaagcaggcatgtaagctccagctcacgtggggcaagagagggagaaggtgttccaaggcacacatgtttcacatctattcttagagacataaaggagtgtttcttcttcctttctttctattattattaagatatttttcgcaaacttattttttgtatgctctaaagccatcagtcatgtgttccagttcaaaagaagctatgaggccacaccctgaccaaaggggtggtgaccctgaagggtctttggagaatgggcctcttctccagaaacccgacccagtggaggtcttagagccagagccccagagaacagtggaacatcattgatgagctttgtcccttgggggctcagggctcttctacctgataaagcctgttagctgttgagtcagaaacacttacttccatgcatcatgcaccctccacgggcgagacacacaaaggcagtgtcatccttcccttcctgtgatactgagatagaataagaaatgtatattgggtctctgccccccagttcctaacagagctcctaaatcccttggagtttcctgggtgaagggagctgcaatgaagcaactcttggtgggttcctggatagcctccggggctggttgccaagggaaccaaccatgtgatttgagtgttggaaccagtcagccccaccctccaacctccagggagggaagaggggctgaagttgagctgatcaccgatggccaatgatgtaattaactgtgcctctgtaatgaagcctccacaaaaacccaacaagactgcacttggagagcttctgggttgctgaacccttggggtacctgggggtggtgcactagagagggcacagaagctctgagctcctttccatgtgtcttgccctgtgcatctcttccgtctagctgttcaccaggatcctttgcaatatcttttacaataaatgggtaaataaaagtaacgtgttcccctgagttctgtgagccactccaggaaagtaatcaaatccacggagggtcatgtagaaaaacagaatttgtccagtacaggtcacagcctggaacttgggattggcatctgcagtggggcggtcttgtgggactgaaccttaacttgtgggatctgacactgtctccagatagagtgtcaggactgagttacattgtaggacacccagctggtatctgctggagactcacttggggtatgaggagaaatccccccacatctggtgtgagaagtgttatgttacatgggtgtgagagtgggggaacacagacacttgggtttttcctatatctcagtcttccctatacacaggccccaaagtaaaccatcccagagaatgcatgagactaggagaagtcccactgccccttgatggcccatcccaatcttttctagaaaaatctgactcaagcatcataaaggacgtctttgaccactagaacctagagcaatggtccccaacctttttggcaccagagactggtttcatacaaggcaatttttctatggacccagggtgagggggcattggtttcaggatgattcaagaacattccatttacagtgtactttatttctattaaaattacattgcaatatataccgaaataattgtgcaactcaccataatgtaaaatcagtgggaggcctgagctcattttcctgcaactagatggtcccatcttgggatgatgggagacagtgacagatcatcaggcattagattctcataaggagtgtgcaacctagattcctggcatgtgcagttcacaatagggtttgtgctatgggaatctaatgctgccactgatctgacagttggtggagctcaggtggctatgagagtgatggggagcagcagaaaatacagatgaagctttgctcacttacctgctgctcacctcctgctgtgcagcccagttcctaacagaccacagaccaggatcgggaccagtaccagtaccagtaccagtactggagtgggaacccctggcctagaggacaaggactagaaatgagaaacagcacccaacaatggaaacagtaaagaaatgtcacaaaagagaagaggcctgagaatccccacacgcgtggggctttgctggcctgtgctgcttacactttccatgctaaggccaattacgcttagcctcctgaagtctttccagtattttcctctgcccatcctctgtttgaaaagatgtgtcagcaaagggaaaaagagtccaaatcaaagtggcttacatttttttttattatactttaagtttcagggtccatgtgcacaacgtgcaggtttgttacatatgtatacatgtgccatgttggtgtgctgcacccattaactcgtcatttaacattaggtatatctcctaatgctatcctcccccctccccccaccccacaacaggccctgggtgtgatgttccccttcctgtgtccatgtgttttcgttcaattcccacctgagtgacaacatgcggtgtttggttttttgtccttgcgatagtttgctgaggatgatggtttccagcttcatccatgtccctacatttttttccagacctgcccgtggacttgtccctggagtgaacctgctgtgtctatggggctcttgggcagtccattcttggcgtggcgtcccagtaacagtggttgccttcttgccccggtatcctttcccattcccaaacatagagtctgtagaaaaaaaaaacgaaaacaaaaacaaaaagcagatgatatgcacagccacatagacccaggacaatatggaatcaatgcagtcatgtcaggtttctctaggacgacggaatcaggggccacattagtcagaagccactgctgaagactgccatgaacactattttaagaaattactggaaatgtttattggcttggaaagaatcacatagttgacagcatgttagaataggaatttgactgggacactgaaataacctattttagaacaaggtgagtggttaagttgagcaccctggaggttttgcgccagtcctaaagtcactacactcgcaagttgtgccaaaaatcacagctctggctttcccagggacggcattgaggcttccttggtcatggcagaccctcaaccaacactcgagctcccgtgcagcactaaaggcttctgcatcagtgtggtttttcatgtcttttcatcccgttgtccaagcacatagatgtctggatacagactttttacttgttcggaaggagcctctaggcttggaacctggataacagtcggaggagcgaccacagtcccttctgtctgagcatcgcgtcaggttgcagtactcccacctgacgctggggtctgtggtaaaacaccaagggcctgtatcggcatctggattcctgcagtagttcattgtcaggccactggaaattccaaagcaatacaggttacaggaggcggaagaatattcaggggcacccagcaccctctacattttgttctaacaaagccttaacaagtgactttgaaatattcccattaagggtaccatacaattactacaacaaaaaaggtcctcaatttcttttctttttttaattttttttaattttttttttttttttttttttgagacagagttttgctctggttgtccaggctggagtgcaatggcacgatctcggctcactgcaacctccgcctcctgggttcaagtgattctcctgcctcagcctcccaagtagctgggattacaggcatgcaccaccatgcctggctaattttatattttcagtagagacggggtttctccatgttggtcagcctgttctcgaactaccaacctcaggtgatcgcttgcctcggcctcccaaaatgctgggattacaggcgtgagccactgctcccggctgggtcctcaatttctaacccactgcatacccttaaaagatagattctaatttttattttaaaatatcaaaagtagtatatgcttgtattagtccgctctcacattgctatgaggaaatacccgagacagactgggtaacttacaaagaaaaatgttttaattgactcacagttccacattgctggggtggcctctggaaatttacaatcatggcagaaggcaagggaaaagcaggcaccttcttcacaggcggcaggacagagtaagtggaagcaggggaaatgccagacacttacaaaaccatcagacctcaggagactctctcactgtcatgagaacagcctgggagaaactgcccccatgatccagttacctccacctggtcctgcccttgacacatggggattatcaggattatagagattacaagtcaagatgagattttgggtggggacatagccaaaccctatcaatgctccatataaaaactgagatcatatataaatgtgcttaagaaaggaccagaataccctccttctaccttctgccaaacacatacctctggaggaaccggtatagattttgaagtgtgtcttatagattttttatgcacatacaaatacacctatgtctctctagctctctgtatctctctctataggattgtatattaatatgtgagttggaactaacatatatttctccaaggaggaaatgccatccaagatgatatcattcccaggccagcccccttactctctgtactcgttgtgtagctaaaaggctctgcatttacaatgaaaaacaaccatgaaaatagtattactgtcaataccatttcaggtgggtcaagtgggtttgagtctacaagacttataaaagctgaactggaagactagctcccaggcaggatgctgtttctctaggatgggttcctgggcaggacctcctctcttgctctcagtccatcctctgctggctgcagccactccgggactgagggaatgggggatgagatgaaggaacagtgggacccaaggcataaagggagatggctggctagactatgggatctgaagaggtcaattgactatggaggaggcagaaaaaaaattgaataagaggcacagcaggtgaggaccccagggttgggggcatcttggagaatgtgctccccttcgttcctcccaggaatgttgcttcaacctctcagaatcctcacattcatggcctgtggctgtctgagaaaacttgaaatgtattatgtaccatgggaatgcaacactatctctgtagagactctacacatgtgacccagtctcaagcccagactcccagctacaggaggctggttctccaagcaactggatatgttagcaagtgtggtattcgaaggagatttttttatctattttcaactgaggtacactttcatgtatagtcaaatgcacagatcttagatgtagtttgatgaattttgatgaacatgtacacttgtgtaactcgcaagttacgatcgtgacacagaacatttacatcaccccagaaacaacttttgttttacggcaaaatcaatctctgctaatttcttcccatggccagaggcaaatgatactggtttccttcaagagaaattatttttgcctttctggaaccttatatcaatggactcatatataatgttcatttgtgttatctgacatctttccttaatgtaatatttttgagcttcatccatgctatttgagagtatcattaatgtgctcccttttattgctgaatagtatgccattgtatgaatagatcgcaaattatttattcattttcttattgattgacactgtagttgcctacagtttggggtataaaaaataaagctgctatgaatattcttgtagatctctttgtggaattatgttttcatttctgttgggtaaatattcaggaatagaattgcagatttgtagagtagatgtgtctttattgaacttttggagaaatcatcagactgatttccaaagtggttttatcattttgcacttccaccaacatacgagagagttgcatatccttgctctacatcagtgacatcagttactgtggtgtcttcttaataatatccatgtccactgggtgtttggtgacatctcatgatggttataattctttatttttcatggctgagatattggacattttttcaagtgcttattggttttgtgtgtatccatccctgagaaatgcctattcaatctgttgccttttttgattaagttgtttgtcccctgtttagcaagtgggagaaatgtttctatactctggacacaagccatttgtcagatagatagaaagagagcatttttcttctcatgtgttatttgcttatttattttcttaaaaatgacttttggtgggcatgagttttcattttatgaaagcccacatcataatttgttttcttttatagttagtgttaatgactcctctgtcaaaaaaaattgccttctccaaggttgtgaagattttatattttctcttggaactttcatatttcagtttcagttttagctctgacacttaggtggaagagatatctcaaattaatttgagatgaaaagtaaaagtcaaggtctgtttttgttttctatcatggatatccaaatggttcagaatgatttttgtaaaagattattgtctccatttaattgctttgtcatctatatagaaaatcaattgaccatatgtatgtgggtctggtgctggaccatccctttttagttttgcatacttttttgccaataacgcatatctttttattttttgagatagggtatcattctgtcatccaggctataatgtagtggcatgatcaaggttcactcatgcctagacctcctgggtcaagtgatcctctcccctcagtgtcctgagtggctggaactacaggtgtgactcatcacacccatctaatggttcatttttttttgtggagagagggtctcgctctgttgctgaggctggtcttgaacacctgggctcaagccatcctcctgcctcagcctcccaaagtgttggggttacaagcatgagccaagggtcctggccaataccacgtcttgattcttgtacctttataagtctttatattaaggtatgtaagtcctccacattttttccaaaaaaggactgcagcaatagtgtttgggtgagagtttaatccaaagatcaatttgatgagaagtgatattgagcctttcaatctataagcatggtgtatctttatttagatcttttaattctttccttgacaacgttttctagtgcaagctgtatagtccttgtgcatagtttgttaaatttatcattaaatattttttggttttgataacattgtcagtgatattgctttaaaacatttatttttccaaatgatcatagaaagtatacagaataccaattaactgttatacacagagcatgtgtatattttttaggactgtctgcatccattaatcaggttttccttctggtttttcattctttctttttgttttcatttttgggtcttggtgcaaaggctgtgaccattgtagtgaagtggtgatgagaagtattgagagcaaacatctttcttattcccaatcttaaaaaacaataatatttcaccattaacatgatgtttgatggaggttttacacagatgccctttatgaggttaaaggagtaccattctgtttctagtttgctgagacattttattatgaaagagtgttgaattttctcatatttccttctgcatctatggatatcatgtgatttatcacttttattctgttattatgttggattacattgtttgttttgcaaatgttaaatcaaccttgcattctcaaagggaagctccagtttttttgtgatattcatcacattaatgataaaaatacattttaatattgctggatttaatatcccaatattttattaagtctttttgtgtttattcactatagacagtattctgcagtttttttttcaatatcctgtgtacttttttaactgggtttttttgttctcacaaactgagttaagaagtattcccttcatctctattttctgtaacatactgtgaaaaattggaattatttcttccataaataacaaaatttctaatgaagccatctgggcctagagatttctctgtggaagtgttttgattttttaaaatatgtattattaaggaatataaacatacgtagtcttgaataggtatcacactgtttagcaattcaacttattcagtgtctgacctgcatatttgttttcttcctaaggaatcagtccacattatctaaggtactggatttgttaacataagttgttctgagtattttcttattatctttaatacctgtagcattctgtagtgataactcctcttctcttttattcctgatggtggtggttgttctcccttctttgtttgtcatcagtttagccagaggtttatcaatcgtaaggatattttcaaggaaccaactttctgttgcacagatttactcaactgtttattatttttacattgaatttcatttttttaatcatttcctttctttcacttaccttgggtcttatttgctttttatatattgctagatccaatacctcaatattttattaagtatttttgtgtttatgtttactatagacagtattcttctctagatttttaaattgctttcttagatgaacaattcccaatatttttatttttaggatcactctgcattcttaaaaagtattggggatcccaaagagctttagtttttgtaatatatacaaatatgcaaatatattgttgcaatcgaaaccgaaacagagaattttttgaaccataatatagacaatcatacattttcctagccattagagagatgattccactacacattatgtagctgctggaaagtttcactgtacctttgtcagaaaatgaaagtgaaaagggccaataaaaaatgtttcttaattaaaaatattttatctccctagattctccgaggggatctcatgagtccccaagtttctgctttgagaattgctatctcaaatcattgatttttaaatgtttctattgtctactaagagcatttaaagttgtaaatgtataaagacattaactgtttcccacaagtttgagtatactgaattattattattattattcaggtcaaaacttttccaagttccttggagatttcttctttgactcatggaacatttagaaatgtgttgttttattaccaaatattcagcaatttcccaatgttttggttatttatatcttatttctttctgttgtgttcagaaaacatactatgtatcaatgtaattcttgaaaatttattgaaacttttgtaaggccacatatatggtataccttgatgcatgttccatgcacatttgaatgtgtattttgtagtttggcatagtattaaataggttgatgttttactttaaatcttatatattttttctgattttgtatgaatgtgttcttttacattttgtttttggaagatttataacaatagtaagagaaaaatgaagaaatttccatctctaattgtggacttatctatttctctctttagttctgtcaagaactaagttctaaagttttgcttcatatttcacaattgctgttattaggtgcaacacattgagcattgttatgtcttcgtgactggaccctttttcttatgaagtgtcctttttgtttttgtattatttcttgtcctgaaatcaactttgtctgttataaatattaccactccagtttatttatgattcaggttttcatggtatatatcatttttcatattttgctgtttgtaggtctttacactgaaagggcatttattataaaaagaacacaattaggctgcagtttttattcaatttacagtctctgccttttatttgtagtgtttaatcattttatatttaatatactcataaggtggtcataaggtggttcagtttatatctaccacaatgccatgaattttctgtgtacaccatatcatttttatcctttattcctcctttgcttccttcttttggacaagtgaactattcctcttattatccattcctctcagtttaagtttttgtggttttcctaggagttatgatatctcaccttaaactatcacattcaaccatgtattaatattatataacttcatgggtaatgcaaaaagcttataacagtatatttccatttatcttctacattatttatgccacttttttaaaataaattttacttttacatatgttacaatatattcttattaattcacatcacaaattgtcctttaaattaaaaaaaagtattttatattgacattgacatttgccatttccagggctgttcattgcttagtatggattaaagtttccatctggtattatttttcttctacctaattggctttctttaacatcttttattacagaagcctgctgtggaaacattcttttggtttttggttgtttcctctggaggtggcagaatacgtatttacatcacatttattttcaaggtttttttttttttcctggacatgttgtcctaggttgatctgattttttttctttctaatcactttaaagatgttatttcattgtttctgagaagaaggcataagtcatttgcatcactgttcctctatgtaaatgatcttttttcccctctagcttataataagattaccctggttatctttgatgttggacaatttaaccatgatatacccaagtaaatcataaatttttgcttttaagaattctatttctgattagttgagcttcttaactgtgagtatataattttcttcatatttgtaaagtcttcagccgtcattgctttcattatttttttctgtcccaatatctctttcctgttcttctgtgactgtttgtatgactttcattgcattattttctagttcactttttcttctgcaatgtataaactcagagtaagaccacccagtgaattttttattaaggacgtacttttttgtagttctttactttccatttggttgttttatatgttgcttttttcttggtattctgcacttgtttctcttatgtccatgttttctttaaatctttgaacacaattatcatatatacacagtttgaatttctttaccaattccattgtctttattatttgttggtctatttgtattgactgatttttctcccagttatggttgctttttttgcctattaaattttaaaatttatgtcactcattgtgaatgtcacattacggagtaccatgatccagttatttacctccagtgatggttgagtttccttctgtcaggcagttaatttacttggagattatttggatccttttagacttggtttttaagttttgctaaggtatttctggagtagcctttattctaagaaggcataaatcctgctcctaaagtatgactttcctggggtctctactgaatgcccgagatgttcaatgaggtgtctctccttaggctgatcagaaccccagtatcccccagtgctacgtgagctctggcgtcaccattgagctcactgtttccctgaatttgtcctttccccagtagtggttctctgtcccactttgtagaatttctccctgtgcatatgcagtttatattagacttccatgcatattccttcagctccttttcaccacaaattctttctcattattacctagcatagaaaatacacattttcttagctatcccaaactccagtctctttcctcagttcagcaagactgctgtggttggctttggctccaattccttgcccttcagtccaggaaggttctccaggaagaaagtcataatagttatggagttgcgctcattcatttccttttctaaattatctcagtcctgtactgtctcttgtccaacatgtggaaagtttttttgtatatcttttgtagtcttttatggcagaaagccagtttttgtcagaccaggttttttgtccatgtaccggcccgttttaatctgtacatctgtttacttcctgactgactctcatctacgttcttgcttttgctcttcctgtcctggcaacccatatcccttcagaaaactggagcttagaacccagtgtgttcacacaggtgtatatatataactatatataactatatatatatatacacacacacacatagttatattatgtgtgtgtgtgtgtgtgtgtgtgtcctgcagattgtatagctatatagcctgcagctgtgcagactatagggtgattggtcatcagtcagggacagacatgaaaaccttgcacatttccctagaccatatatgaatacttgcctgtatgaacacatatatgaataccaacctatatgagcacatatatatgaatactagtctgtatgaacacacctggttctatatatatgcacacacatgtgaattatttacttgtgacccatgacaaaaatggcaaacccaaccttcacttcagggaagggaggttagaatgatagaattgcatgggtgaaagactgcattgatcttttatgagccttgtagaatggcactctatttgatcgtttgttctcctgagctttatattaaaaagacctcatcagctccatgtagccttctgcttccatcagactattagaaaagatagcaagcctaaaatacctattctctcagactctttgatcaaaagcaaagttgtttggacattttgacacaccttctgggtctaagggaaatttgtcctaacaagttagcttgaagcaaggctcttctaggaggaacttaagttggctgttgctcctcttacaagtaacatcaaagacatactcatttgggtagttttctggggtcctctgatgccggtgtggtgtcatggatgaccaagattgacatgtccttcctgtgacagtggtggagaatgtgccttgataactctgtccattaccatggtagcactgccggaccacaggggtttgctcagttggtgctgaaaatagtcaaaatcaagctcagtaattactagtacgcagaaacatgtgaagcaatttatgacacaaacaggacagtagtttcagaattatgactgttctcttcagaatactcgcaagcagaaggacatgctgaagcaaaaacaatagattaatagcattctaatattttaataagttcttagaaatgttatattcaaaatctggtggggaaaggacctatcagtgttcttacaattgcaactaagactcatgtgcaagctcttttgtgtggctctctactgattgttcatgagaacaacaaggcaggaaaccagacagtgatggattaggccatgcaggctgttgggtgattggctgtcagtgggggacagacaggaaaaccttgcacatttccctagaccattgctcctgaaaagccaaagccttaagcttctggtggacggggcagttcatggtcctgcatctagtacttgcaggcaaagacacattgcttcttagagaaggatggagactaaaatcttattcccttacaggagagacagggaatcctcttgttccagcaccctgcattgcaacaaagcagaagtctactacctttcctctcaacacacaccaaagatgcacgttccacgagaagaaggcgcaagaacaccaagaaattcctgccttccaagcataggtgtgcagagcctacctaagactaagataagccagagaaataatgcattctgtggttatgtagtgtcaaatagccccaggattagatggaataaatgtcatcatattaggtttctccaggatgacaaactcagcggccacatacctcagcaaccacaatgcaatgattgcaatgaacactgcccattttacgaaaggcctggaaacactcactggtgtgaaaattggcacaaatttggccggacgttagaactggaattttgtctaggacaccaagataactcacttaacaagatgagtggtaagtcaagcgccctggagggttgcacccttcctaaagacaccattgactagcattgcaccaaaaattacacctcttgctagagcagagagggtgctgaggcttccttatgcacggcataacctcaaccaaccatcaagtttctcagtagcatggaaggcttctgcatctgtcagattttaaatcttttcatcccaatgttcaaatgtgtagatgtctggccacagacttcttacctgcttcagaatgagcctccatgcttggaactggaacaacagtgggagtctctaggacactgattctgtttctgagcattgtgtcaggttgcagtactcccacctcacacacggatcagttgtgtaacaccagggttgtttcccagaatctggattcctgcagtagttcctggtcaggccactgcaaattccagaacaatacaggttacaagagatggtaaaaaattcaggggcacccagcactgtctaaattttgttacaataaagtgttaaaaagtgacatttgaatattcccattttaggtaaaatgatattcccaaggcaaaaatggtcctcaagttctaaagaagagtgtaaatttccaagatagattataatgtatattttaaaaaatcaaaaatagtctatgctccatttaaaaactgagatcatgcataaacgtacacaagaaaaaaattagagctgggtgcgatggctcacacctgtaatcccagcactttgggaggctgaggcaggcagatcacctgaggtcgggagttcgagaccaacctgaccaatacggagaagccctgtctctagtaaaaatacaaaataagctgggagtggtggtgggtgcctgtatttccagctacttgggaggctgaggcaggagaatcccttgagcccaggaggcagagattgcagtgagccgagatcgcaccattgcactccagcctgggcaacacaagcaaaactccatctcaaaaaaaaaaaaaaaagggaaaaagatcagaatatgtttctccttctgccaactgcattcctccagaaaactgatgtggattttttaagtgtgcatcttagattttattaatgcacataaaaatatataatatattgatatctgtctacttctttatatccttctttaggactctacagtaacatgtaaattggaatcaaaatatatttcttcagggaagaaatggcatccaacatgacaccattcccaggccagcccccttactctatgtattcgcagaggagtcagaaaacaatggagtaagaggcaaaggtggtgagtaacccgcgatgggtgtatcttggagcatttgctcccccttatgaatcccaggaacattgctccaacctctcagtattctcgcattcatgacctgtggctgtctgtgaaaacgggaaatgtattatgtgccatggggatccaacactctctctcaagagactacacatgtgacctagtctcaagcacagaccctccattcaagaagcttgttctctgagcatttggatgtgctcagagccgagcagttgacttatttttcttccttggctgccttctttttgacatatggaatattcttgtcatagaatatacctcagtgttcacaattttgtgattactctagaatttgcaatatctctttgaacccaaatatttcaaacttttattatgtaccatcataggtaaggcaagaaacttacaatggtataattctttattccctacacgatttatgctacattttcaaatttttacttcaaatatgctaaaataatacatattgctgtcattttgcttcaagcagtcaaatataatttaaggcaattacgaaatttgatcaagaaaatatttttgcatttacatctacatttgccatttgctgggttcttcaatacgtgggatgcagaaagttcccaccttgtactattcttcttgtacgtaattccctttgggccacatcttttgtgacataagcctgctgattccaaattctcatagctttcggatttcttgtttggggggtgcacaaaatgcaattatacaacattgatgattttcaaggcagtgtatagctggatgtagcattctcggttgatctcttcttttccctgtttatcattttaatgatattcctttgcctgcagtttgccatgtttctgatgagaacacattagccatttgtatcaccgttcctctagcaagacacagctctttttcctacagtttctcacaagatatttcttgatactatatctttgtcttctgagagtcaaactgtgatgtaccaaagtgcttcatacagttttctttttgaaaattccctttctgatccactgagcctattgaatctgtaattacttaacgttcttcatattaggaaggttttcagccattcttgcttcaggtacttgttattgtttcagtatcaccttcctctccttctgtgccttgcttctcacaggtaggaaacctttttatattttcctttgtgtctgtgaggcttggttgatttcacttttcaggatttgtggatgtgagtgtgtttgtgtgtgtttgtaagcttgtgcatgtgtgagtgtctgtgtgtgtgtgtgtgcatgtgcgcgcgcacgcgtagctgtttctgtagtttctataaattttctttcagttagtttttcttctgaaacttctaactggatgaggaggccacccagtacttttttgatttaaggcatacctttcactagagttctaatttgatattgctcttttatactgttactttctcttgatgttacatctgctaggttccatactcatattttctgaaatcctagaactcagttaacacactgataggtccaatttttatgccattctaatcattcctgtcatttctgggcctatttgtattgactgatttttctcctggtcgtgggtcataaccaacgctttctatgtttagggagtttttaaatttaggactcacactgtcgataccgcatagctgagccacttgattttgctgtttacctctaaggagggttgtgttttcctctagcaggcagttaattgacttggaaacctttttgatgcttaagagatttgcctttaggctcagctaggttttgtctggagctgcctttattctaggaatatattaattctacccttaaagtctggcttttctggggtctctactgaatgcccaagatgttcagtgacttctctctcctctggctggttagaactctaatatccgctagtgctatgtgagcactgtcatctttactgagctcactgtttccttgtagatgctgttttctcatagttgtccccttgtagttgctcagtagatgtccttggccccactctcctgtggagcccttttctgtgcacaagcagcttcatgtttagccaatgacttgaggagacttctatgcatattcccagagctcctttcctccacacatccgctctcattcttagcaggcctagaaaaatcctagctacctgagtaatcccaaactccagtctctctcctccattcagcaagatagctacagtccacatgtgctccatctccctgctcttcagtgcaggaagggtctccaagaagacagccagggagggcacttatggagttgatcgcattgttccccctctcacaattctcttggtcctctaccgtctgttgtctaacatgcagaaaccatttttccatgtctttggtagccacttacagcagagaggctggacacagggtggtcagaccagggcttctgaccatctacccaccaggcttaattttcagcatctgcctctttgttgactctcatctgccttcttgcctttgctcttcccttgctggcaacctgtatcttgtcagagcactggtgctcaggaccaagtgtgtttctacccattggaaaagacgtagatacagaaagagagacatttgcctctccatagatatgcaaatatttttttctcttgaaccaagacagaaaaggccaacacaactttcacttcaggaattggaggttagaatgatagtattccaaggtggaaaggctgcattggccctcagtgggtggtgtggaaaggtactctaagtgtttggtcgtttgtggtcctgactttttccttaatgtgatctcctcgcctccagatatcctcctgctccataaaactaggaggaaggagagccagcctaatatttctcttctctcagactctttgctccaaggcaatgttcctgagacattttgctatgccctttgcatctgacacaagttgagtcttgagcagtcagctcgaaacatgactcttctaatagaaacttcagttggcccttccttctcttatggtaaagaacaaagacgtatgcatttgggtacttttctggggtcctactgtgctgatgtggcgtcatagatgaccaagcttggcaggttcttcctgtgacagtggtgaagtatgtgcctcgataactctgtccattaccgtggtagcactgctgctcccaaggccttggctctgttggtgctgaaattaaaagagaaaaaatcaagctgagtatttcctagaacagagaaacaggtgaagccatttatgacacaaaccaggcaggagtttctgatattacgacccttctcttttctctattcttaggcagatggacatgagaacataaacaaacaaacaccaaagcaacagatttctaccattctagaagtgtagtacattcatagaactatttcctgtaaaagctcagagaaaaacagcagatcagaatgcttctcataggaaactgtgctcacaggcaagctggtctttagggatctctactgaatgttcacgggaaccatggggcatgagagaacaaagggctgtgcatttggcggtgtgggctgtaggtggtgattggctatcaagggtggaggtggggacagacatggaaacattgcgtatttccctaaagtgttgatcacgggagccaaggccttcagcttctgggcaatcgggcagaaaacagttctgcaactaagactgcaggcaaaaacattttgcctcttagggatggttggaggccaaaatcttatccccttggaggagggatggaatcctctcgtgtcccgcattctgcatcgtaataaagcagaagtctactaatctttctctccagacccctccccactatgcacacacaggtacaagttccatcagaaggaggtgtcagaacactaagaaatcactcacttcaaagcctaggactgcagagcctgcctgggactgaggaagctcatgtactgctccatagacccagggcgatatggaattaatgccgcctgttaggtttctcgagattcacaagctagagagccacatttcctggaatctgcagtgctgaagattgcaatgaacgctgtctaccttaagaaatccctggacaagtgactcgcttcgaaagagtcacacatctgacagcatgtgacaataggaattttggctaggacactggcccaacccctttgacaacaaggtgagtggtgaagtccaccaacctggagggttcgtgcctatcctaaagacacagcccactcacgttgcaccaaaaatcactcgtctggctcccccccagagtgccctgaggattcttccaacatgacagaccatcaaccaacatgtgagcacgtgcgtagcactgaaggcttctgcaacaatgggagtttcaaaggcttttctacccagtgtccaagtgtggagatgtctggccacagacttcttacctggtttggaaggatcctctaggcttggaaccgggataacagtcagaggcacgactgcagtcccttctgtgtctgagcatcgtgtcaggttgcagtactcccatctgactttgggatccatcgtgtaacaccaagggccttccacaggatctggattcctgcagtagttcatgatcaagtcactggaaattccaaaaggatatacgtcacaagaggtgggacaatatgcaggggcacccagcaccctctccgttttgctgtaacaaggtcataaccagggcctttgaaatattcccattaaaagtaccatacaattgccacaagcatgaatggttctcaaattctcatccactctgcacatttccaataattaatggattttaactgttttatttttgttgtttgcaatgcttcttggaaacactgaaatagtacatccatgtggcctggaagggatcagaatattgtccttccacctttggccaatacatctctctggaataactggtatggattttgacgtgtgtattgtggaatcatttatgcacatacaagagtatctcgatctgtctagctgtctttatctctctctataggacttcatatagtattgtgagaggtggaactaacatagagttcctcaaagaaataatggtatccaggatgatatcaatcccaggtcagctttctaactctttgtgctcaaaatgtagcaaaaaggctctatgttattatcatggaaaaccatcatgcaaatagtgttactgtctgtcgataccgtatcaggtgggtcagaaaggtttgtttctgcaagacttattaaagcttccgtgcaaaactagcttccaggcagaatgcagtatctctaggatgggtcccagtacatgacctcctctcctgctctcagtccatcttctactggccgcagccactccgggactgagggaatgggggatgagttgaaggaacagtgggtcccaaggcataaacggagatggatgaatagactatgagatctgaagaggttaggcagctatggagaagttagtagttggtcatttgtggtcatgaccatttttttcatgtctttggtagccacttatggcagagagacttgccattggatggtgggaccccagcttctgtgcatctatctaaccccctcgcttacttttcagtctctgtctctctcctgagtctcatctgtctttttgcctttgttcgtctcttcttggaaacctggacctattcagaccactggtgctcaggacccagtgtgtttctgctgattgaaagatacatagatatttatagatagagatttacctctccatagatatgcacatatgctttcttcgagatccaagatagaaaaggccaacacaaccctcacttcaggaaatcaaggttagaatgatagaattttaaggcaaaaaggctgcattggcccttagagtgtgttgtggaaaggaactctaaacttttggtagcttgtgatcctatctttttcttaatgtgatcttctcgcctccagatatcctcctgctctataaagctataaggaaggagagtcagcttaacatttctcttctctcagaccctttgctccaaggcaatattcctgagacattttgctatgccctctgcatctgagacaagtagagtcctgagcagttatctcaaagcaggagtcttctaaaagaaacttcagttggcccttccttctcttatggtaaagaacaaagacgtacgcatttgggtacttttctgaggtcctactgtgctggtgtggtgtcatagatgaccaagcttggcaagtgcttcctgtgacggtggtgaagtatgtgcctcgataactctgtccatttccatggtagcactcctacattgaaggccttggatcaatcagtgctgaattaaaacagaaaaattcaaggtgagtatttcctaggacagggaaacagatgaagctatcaatgccacaaaccagaaatgagtcttcaagaattacaatcattctcttttttttatttgtaagcagatggacatgagaaaacaaacaaacacaaaagcaacagattcctaccattctggaaatgtagtaagttcttctaaatatttcatataaaagcttagagaaaaacaacagttcagagtccttttcatgggaaactgctctcacgtgcaagctcatctctagggatctctactgaatgttcatggagacaatggggcatgagagtacaaagtgtgatggatttggcagtgcaggctttaggtggcgataggctgttgaggtcagaggtggggacagacatggaaactttgtgtgtttccttagacccttgattaccagagcccagcccttccgcttctgggtgatcaggcagaaaacggttctgtgtctagcactgcaggcaaaaacacttcacttattaaggatgggagaaggctaaaagcttatccccttggaggagagacaaaatcctcctgtccattctcttttctttattcatagtctgatgaacattctgcattgcagtaaagcagaagtctactactccttcactccagaccccccacaggtacaaatttcatcagaagtaagtgcaagaacactgagaaatcactcccttcaaactgagggctgcagagcattcccaggactgaggaaggtctgaaagttagagcctgggagctcacgtactgctctacagacctagggtgatatgtaattaatgcagcccttctatgtttctcaagattcacaggctcgagagccccatttcttggaatctacaatgctgaagattgcattgaatgctgtctattagaggaaatccttggagaagttactggcttggaaatagtcacacatctgacagcatgttacaataggaattttggattggacactgagatagcccgttttacaacaaggtgagtggtgaagtcgagcaccctggagggtttgtgcccatcctaaagacacagcccactcatgctgcaccaaaaattactcctctggctcccccagacacggcactgaggattcctttaacatggcatatcttcagccataattcaagcactcgtgtagcatggaaggcttctgcattagcaagagtttccatggcttttctatgcagcatcgaagtgtgctgatgtctggccacagacttcttaccttgtttggaagtatcctctcgtcttggaaccgggataatagtcagaggcgcggccacagccctattcttgtctgagcatcctgtcaggttgcagtactcccacctgactttgggatccgttgtataacaccaagggcctgccgaacaatccggattcctgcagtagttggagatcaagccactgaaaatcacaaaacaatacacgttaacaagaggtgggacaatatgcaagaatatccggcaccctctccattttgctgtaacaaggtcataaccagtgcctttgaaatattcccgttatgggtaccatatgattgccacaagcatgaatggctctcaaattctcatccactctgcacatttctaataggtaatagattttaactgttttttttttaagacctgaagtagcaaattccttttagaaacactgaaataatacatacatgtggcctagaagggatgagaatatcctccttccacctttggccaatccatctctctggaataaacggtacagattttgatgtgtgtattgtggaatcacttatacacatacaagattatctcgatctgtctagctctctttctctctctctacaggacttcatatagtattgtgcaaggtggaactaacatagggttcctcaacgaaataatggcatccaggatgatatcaatcccaggccagccttctaactctatgtactcaaaatgtagtgaaaagcctctatgttacccatggaaaaccatcgtgcaaatagtattgctgtctctcgatgccgtatcaggtgagtgaaaaggtttgtttcttcaagacttataaaagctgccctagaaaacaagttcccagacatgatgcagtacctctaggatgcatccctggacaggacctcatctcctgctctcagtccatcctctactggtggcagccactctgggactgaaggaatggggaatgagttgaaagaacagtatgactcaaggcataatgggagatggctgaatagactatgagatctgaaaaggtcaggcagctacagagttgtcagcaaacaatggcgctaagaggcaaagcaactgagaatcccgtactgggtgtatcttggagcatttgccttttgttatgactcccaggaacattgctccaacctctcagaattcttacattcatgacctgtggctgtctgtgaagatgagaaatgtattatgggccatggggatccaacacctctctctagaaaatctacacatgtgagctagtctcaagcacagaatgtccattccaggaagctgattctcagagcatttggatgtgctcagagccaagcagttgaaagacttctttttcttccttggcttccctcttttggatacaaggagtcttcttgttatagaatatatttcagccttcaaaatttagggattgctctagaatttgcaatatctctctgaaaccacatacttcaacattttattaatatttttaaccatcatagataaggcaagaaacttacaatggtataattccttttatttcctatctgatttatgccatgttttcaaatttttacttcaaatatgctaaaataatatgtattgctgtcattttgcttcaagtagttaatgctcatttaagtcaattaagaaatttgatcaagaaaatattttgcatttacatctacatttgccatttgctgccttctttattatgtgggatgcagaaagttcccctcttgcactattcttcttctacctgatttcctttgggttacatcttttgttacataagcctgctgatttcaaattcttacagttttgggtttgtttcgggggggtgcacaagatgcatttatacaacatttatgatattcaaggtattttattgcttgatgtagcattctcagtatatctcttctttttcctgtgtattgtttggaccatattcctttgtatgcagcttgtcatgtttctgatgagaacgcattagtcatttgtatcactgttcctctagcagacacagctctttttcctctagtttctcatgggatttttcttgatactgtatctttgtcttctgacagacaagctgtgatgtaccaaagtgcatcatagagttttctttttgaaaattctcttgctgatccattgagctccttgaatctgtaatctttttatgcacctcatttttggaaggttttcagccatccttgcttcaagtatttgtttctgttccaatctctcattcctctatttctgtgacttctttcccacatgtaggaaatcttttatattttccttcatgtctgtgaggcttgatttcattttacagtatctgtggatgtgtgtgtgtgtgtgtgtgtctgtaacttgtgcatctgtgtgtgtgtgtgtgtgtagctgtttcttcagcttctatgggtttgttttcagttagtttttcttcttaacttttaactggatagggaggccattcaggaattttttatttaagtcatacatttcactagatttttaatttgttttgacttttttttactgttacttcctcttgatattacatttgtttggttccatatccatgtttttttaaatcctagaactcaactatcatactgatatgcccaatatttatgccattcttatcatttctgtcacctcggcctatttgtattgactgatttttctccgggtcatggatcacactaaatgattttcaatgtgtaggcagattttaattttaggactcacacagctgatatcgcacagctgagccacttgattttgttgtttacctctaaagaaggttgagtttttctctagcaggcagtaacttgacttggacaccattttgatgcttggacacctgcctttcagccttgctaggttttctctatagctgccttaattctaggaatacactaattctactcctaaagtctggcttttctggggtctctgctgaatgcccaagatgttcagtgtggtcactctcctctggctggtcagaactccaaccgcccccagtgctatctcagctctgtgagctttattgagctcactgttgccttgtagttgctgttcctcagtagatgtcctttgccctagtctcttgtggaacatttttctgtgcacaaaaaactttatgtttagtcaatgacttgaagagatttctatacgtattcctagagctcctttgccccacaaatccgttctcattcttagcttgcctagaaaatcctaggtaccggaaaatcccaaactccaatctctcctccattcagcaagatggatacagtccacatgggttccgtctccctgctcttccgtgcaggaacggtcccaagaagaaagccaaggagggcatctgtggagttgatctcattgtactccttgtcacaattctctcagtcctctaccatctgttgttttacgtgtggaaaccatttttccatgtcctttgtagccacttagaggagagagactggccatgagttggtcagacccaggcttctgtccatctgcccaccccttttatttttcagcatctgtctctttgctgtctctcatcagccttcctgcctttgcccttctctttctggcacctcatatctgagaccattgctgcttgggatcgagtttgtttctacctattggaatagacgtagaaatagaaagctttgactctccatagatatgcacatactccttcctcgtgagccaagacagaaagggccaacacaacttttacttcaggaatcagaggttagaatgatagaattccaaggtggaaaggctgcattgactcttactgtgtgttgtagaaaacactcttaagtgtttggttatttgtggtcctgacagttttcgtaatgtgatcacctcgccttcagatagcctcctgatgcataaagctatgaggaaggagagccagattaacatatcctatctctgagaccctttgcttcaaggcaatattcctgagacattttgctatgacctctacatctgaaacaagttgagtcctgagcacttagctagaagcatgactcttctaacagaaactttagtcagcccttccttctcttatggtaaagaacaaaacgtatgcatttgggtactgttccggggtcctactgtgctggtgtggtgtcatagatgaccaagcttggcaggttcttcctgtgacagtggtgaaatatgtgcctcgataactctgtccatttccatggtagcactcctgaacagaaggccttggctctgtcggtgctaaaattaaaacaggaaaaattaagctgtgtatctcctagaacagggaaacagttgaagccatttatgacacaaaccagaaagaagtcttggagaattacgaccattctcttttttttatttgtacacagatgaacatgagaaaacaaacaaacaccaaaagaacagattcctaccattctagaaatgcagtaagttcttcccaatatttcatgtaaaagcttagagaaaaacaacagttcagagtgcttcttatggaaaactgcgctcacgtgcaaactgctctctagtgatctctactgaatgttcatggggatcacggggcatgagagaataaagggctacgcatttggcagtgcagactgtagatggtgattggctgctgagggcggaggtggggacagacatggaaacctcgcacgtttccctagaccattgatcacgagagccaaggccttcagcttctggcttctggcagattgggaagaaaacggttgtgcgtctaggactgcaggcaaaaatagtttgcttcataaggatgggtggaggccaaaatcttatcccattggaagagagatggaattttctcatgccccacatcctgcattgcaataaagcagaagtctcctactctttctctccagaccccccacaagtacaacttccattagaaaaaggtgcaggaacactgagaaatcactcacttcaaagcctaggcctgcaaatcttgcccaggtctgaggaaggcctgaaagatagagccttgggagctcatgtaatgctccatgatgcaagggcaacatggaattaatgcagccctgttaagtttctcaagattcacgggcttgaaagccacacatttctgagaatctgtgatgatgaagattgcactgaatgttgtctacttgaagaaatccctggagaagcttactgcattggaaagagacacatatctgacagcatgttacaacaggaattttggactggacactgagataactcattttacaatgaagtgagtggtgatgtcgagcaccctggagggtttgtgcctatccaaagacacagcccactcatgctgcaccaaaaattactcctctggctcccccagacactgcactgaggattcctccaaaatggcagatcctcaatcaacattggagcacctgtgtagaatgaagccttctgcatcagtgggagtttccatggcttttcttcttagtgtctaagcgtggagatgtctggccacagacttcttaccttgtatgaatgaatcctctaggcttggaactgggataacagtcagaggcacgaacacagtcccttcatcgtctgagcaccgtgtcaggttgcagtactcccacctgacattgggatccgtcgtataacaccaagggcctgccgaacaatccggattcctgcagtagttcgagatcaagccactgaaaatcacaaaacaatacacgttacaagaggtgggacaatatgcaggaacatccagcaccctctccattttgctgtaacaaggtcataaccagtgcctttgaaatattcccattagaggtaccatatgattgccacaagcatgaatggctctcaaattctcatccactctgcacatttctaacaggtaatagattttaacttttttttttaagacctaaagtaggaaatacctcttagaaacactgaaataatacatacatgtggcctagaagggatgagaatatcctccttccatctttagccaatccatctctctggaatacatggtatagattttgacgtgtgtattgtggaatcacttatacacatacaagagtaccttcatctgtctagctctctttatctgtctctacaggacttcatacagtactgcgaaaggtggaactaacatagagttcctcaatgaaataatggcatccaggatgatatcaatcccaggccagccttctaactctatgtactcaaaatgtagtgaaaagcctctatgttacccatggaaaaccatcgtgcaaacagtattgctgtctctcgatgctgtatcaggtgagtgaaaaggtttgtttcttcaagacttataaaagctgccctagaaaactagttcccagacatgatgcagtacctctaggatgcatccctggacaggacctcatctcctgctctcagtccatcctctactgatggcagccactctaagggtgactgagggaatggggaatgagttgaaagaacagtatgacccaaggcataatgggagatggctgaatagactatgagatctgaaaaggtctggcagctacagagtcattggcaaacaatggcgtaagaggcaaagcaaccaagaatctcgcgctgggtgtatcttggagcattcattcgccttttgttatgactcccaggaacattgctccaacctctcagaattctcagattcacgacgtgaggctgtctgtaaagacaagaaatgtattatgggccatggggatccaactactctctctagaaaatctacacatgtgagctagtctcaagcacagaatgtccattccaggaagctgattctcagagcatttggatgtgctcagagccgagtagttgaaagacttctttttcttccttggcttccctcttggatacatggagtcttcttgttatagaatatatttcagccttcgaaatttagggattgctctagaatttgcaatgtctctttgaatgcacatatttcaaccttttattaatattttttaccatcacagataaggaaagaaacttacagtggtataattccttttattccctatctgatttatgctacattttcaaatttttacttcaaatgtgctaaaatatattgctgtcattttgcttcaagtagttaatgctcatttaagtcaattaagaaatttgatcaagaaaatattttgcatttacatctatgtgccatttgctgccttctttattatgtgggatgcagaaggttctcctctcatactattcttcttctacctaatttccattgggttacgtcttttgttgcataagcctgctgattccaaattcttatagtttttggtttccttgtttcgggagtgcacaagatgcatttacacaacattgatgatattcaaggtattttcttgcttgatgtagcattctcagtatatctcttctttttcctgtgtattgttttaagatatccctttgtacgcagcttgccatgtttctgatgagaacgcattagtcatttgcatcactgttcctctagcagacacagctctttttcctctggtttctcatgggatttttcttgatactgtatctttgtcttctgacagacaagctgtgaggtaacaaagtgcatcacagagttttctttttgcaaattctcttgctgatccattgagctccttgaatctgtaatctttttatgtacctcatttttggaaggttttcagccatccttgcttcaagtatttgtttctgttccaatctcttattccgctatttctgtgacttctttcccacatgtaggaaatctttttatattttcctccctgtctgtgaggcttggtagatttcattttacagtatttgtggatgtgtgtgtgtgtgtctgtttataagttgtgtatctgtgagagtgtgtgtgtgtagctgtttctttagcttctatggattttttttttcagttagttgttcttcttaaacttctaacaggatagggaggccatttagtaattttttatttaacacatccttttcactagatttttgatttgacttttttatactgttaattcctcttgctattacatctgtttggttccatatccatgtttttttaaatcctagaactcagttatcatactgatatgcccaatatttatgccattcttatcatttctgtcacctgggcctattcatattgactgatgtttctcctggtcatggatcacactaaatgattttcagtgtgtaggcagattttagttttaggactcacactactgatattgcatagttgagccacttggttttgttgtttacctgtaaagaaggttgagtttttctctagcaggcagtaacttgacttggacaccatttcgatgcttggacacttgcttttcagctttgctaggtttctctggagctgccttaattccaggaatatgctaattctactcctaaagtctggcttttctggggtctctactgaatgcccaagatgttcagtgtgatcactctcctctagctggtcagaactccaaccgccccagtgctatgtcagctttattgagctcactgttgtcttgtagttgctgttcctcagtagatgtcctgtgccctagtctcttgtggaacatttttctgtgcacaaggagctttatgtttagccaatgacttgacgagacttctaaatgtattcctagagctcctttgtcccacaaatccgttctcattcttagctgtcctagaaaatcctagctgcctgaataatgccaaactccagtctctcctccattcagcaagatggatacagtctgcatggattccgtctccctgctcttcagtgcaggaacggcatccaagaagaaagccagggagggcatctgtggagttgatctcattgttctccttctcgcaattctctcagtcctctaccatctgttgtttaacgtgtggaaaccgtttttccaggtcttttgtagctatttagagcagagagactggccatgagttggtcagacccggcttctgtccatgtacccaccccttttatttttcagcatctgtctctttgctgtctctcatcagccttcctgcctttgcccttttctttctggcacctcatatcttttcagaccattgatgcttgggatcgagtgtgtttctacccattggaatagatgtagaaatagaaagagattcgactctccatagatatgcacatactccttcctcgtgagccaagacagaaaaggccaacacaacttttacttcgggaatcagaggttagaatgatagaattccaaggtggaaaggctgcattgactcttactgtgtgttgtagaaaacactctaagtgtttggtcatttgtggtcctgacagttttcgtaatgtgatcacctcgccttcagatagcctcctgatgcataaagctatgaggaaggagagccagattaacatttcttatctctgagaccctttgcttcaaggcaatattcctgagacattttgctatgccctctacatctgacacaatttgattcctgagcacttagctagaagcacgtctcttctaacagaaacttcagtcagcccttccttctcaggtgggatgatatgcagggcacccagcacccagcaccctctcaattttgctgtaacaaagtcataaccagtgcctttgaaatattcccattaaaggtaccatacaattgctacaagcatgaatggctctcaaattctcatcctctctgcacatttgtaatatctaatagattttaactgttttttttttaagacctaagtagcaaatgtttcttagaagcaaagaaataatacatacatgagggctaggagggatccgaataccctcctttagcctttggccaatccatctctctggaatacctggtatggattttgatgtgtgtattgtggaattgcttatgcacatacaagagtattttcatccgtctagccctcttgatctctctctataggactttataaagtattgtgcaaagtggaactaacatagagttctccaaagaaaaaatgccatccaggacgatatcatttccaggccagccttccaactctatgtactcaaagtgtagtaaaaagcctcagtgttagccatggaaaaccatcgtgaaaatagtattactgtctgtagacactgtatcaggtgggtctagaatatttctttctgcaagacttatcaaagctgccctagaaaactggttctcaggcaggatgcagtatctctaggatgggtccctggacacgacctcgtctcctgctctcactccattctctagtggcagcagccactctgggactgagggcatgggggatgagttgaaagaacagtgggacccaaggcgtaaagggagatggttgaatgaactatgagatctgaagaggtcgggcagctacggaggagtcagcaaacaatgtagtaaaaggcaaagcaggtgagaattccgtgtttggtgtatcttggagcattcgctcccccttatgactcccagaaacattgctccaacctctcagaattctcaacattcacgacctgtggctgtttgtgaaaatgggaaatgtattatgcgccatggggatccaacactgtctctctagagactctacacatgtgacctagtctcaaccccagaccctccattccaagaacctggttctctgagcatttggaggtgctcagaccagagcagttgaaagacttctttttcttctttggctgtcctcttttcaatacatggaatattcttgttatagaaaatactttagcattcaaaattttgtgattactctagaatttgcaatatcccatgaacccaaacaactttttattaatatttgttaccatcattgataagacaagaaacttacaatgatataattcttttattccctacatgatttatgctatgttttcaagtttttacttctacatatgctaaaataatatatattgctgacattttacttcaagttgtcaactcttatttaaggcaataaagaaatttgaacaagaaaatattttgcatttacatctacatttgccatttgctggcttcttcattacctgggatgcagaaagttcccctcttgtactattcttctacctattttcctatcggtcacactttttgttacgtaagtgtcctgattccaaatttttatagtttttggttttcttgtttggggaattgcaaaatacgcatttatacaacattgatgatattgaaggcattttatggctggatgtagcattctcagttgatctctttttttttttcctgtttatcattttgatgatattcctttgtatgtggcttgccatatttctgatgagaacacattagccatttgtatcactgttcctctagaaagacacagcactttttcctctggtttctctgagatttttatgatactatgtcgttgtcttgatagtcgaactgtaatgtatcaaagtgcatcatagaattttctttttgaaaattctctttctgacatattgagcttcttgtacctgtaatttttaaatgttcattatatttggaaggttttaagccacttttgcttcaggtatttatttctgttccagtttctcattcctctacttctgtgacttgcttcccacatgaagaaaatctttgcatgttttccttcatgtctgtgaggcttggttgattcaattttaccgcatttgtggatgtgtgtgtgtgtttgtaaggttgtgcatgtgtgagtgtgtgtgtgtgtgtgtgtgtgtgtgcatgtagctgcttctttagcttctatggatttttttttcagttaattttttttctgaaacttctaactggatgaggaggcaatccagtgatttttttttttatttaagacataccttttactagatttttaatttaatttggctcttttatactgttacttcctcttgatattacatctgatagttccatatccatgttttcttaaatcctagaactcagttatcatactgatatgtccaatttttatgccacttttatcatttctgtcacctgggcctatttgtattgactgatgtttctcctggtcatggatcacactaagtgattttctatgtgtaggtagattttaaattttggactcacactgcggatattgcatagttgagccacttgattttgttgtttacctctaaagaaggttgagttttcctctggcaggcagttaattgacttggacaccattttgatgcttggaaacttgcttttcagctttgctagggtttgtctggagctgcctttattataggaatatactaattttatgtctaaagtctggcttttctggggtctctactgaatgcccaagttgttcagtgaggtctctctcctttggctggtcagaactccagtctccagcagtgctatgtgagctctttcatctttattgagctcactgttcccttgtagttgctgttcctcaggagatatcctttgccctactctcttgtgaaacctttttctgtgcacaagcagctttatgtttagccaatgacttgaggagattctatacgtattcctacagctcctttcctccacaaatccattctcattcttagctggcctagatcagcctacctgagtaatcccaaactccaatccctctccttcattaaggaacatggctacagtccatttgggctccatctctccactcttagggaagggtctccaagaagaaagccaagaagggcatctacggagttgatctcattgttccccctctcgcaactctctcggtcctctaccgtctgttgtccaacatgtggaaaccatttttctatgtctttggtagccacttatggcagagaaactggcaatggggtggtcagacctgggcttctgtccatctatctgccccttttacttttcagcatctgtctgtttgctgactctcatctgccttcctgcctttgctcttttcttcctggcaaaccgtatcttttagatcactggtgctcaggactgagtgtgcttctacccattggaatagatgtagatacagaaagagagagctttgcctctccacagaattgcacatatgctatccttgtgagccaagatagaaaagaacaacgcaaccttcacttcaagaatcggaggtcagaatgctagagttcaaaggtggaaaggctgcagtgacccttagtgtgtgttgtggaagggtacgctaagtgtttggtcatttgtggtcctgatatttttcttaatgtgatctcctcacctccagatatgctcctgctctatcaagctaggaggaaggagaggcagcttaacatttctcttctctcagaccctttgctccaaggcaatgttcctgagacattttgctacgccctctgcatctgacacaagttgagtcctgagcagtcagcttgaagcatgactcttctaacagaaacttcagttggcccttccttctcttatggtaaagaacaaatacatactcatttgggtacttttctggggttctactgtgctggtgtggcgtcatagatgaccaagcttggcaggttcttcctgtgacagtggtgaagtatgtgcctcgataactctgtccattactgtggtagcactcctgcacagaaggccctgtctcagtcggtgctgaaatcaaaacagaaaaaattaagctgagtatttcttagaacagtgaaacaggtaaagccatttataacagaaaacagaaaggagtctctgaaaattatgaccgttctcatttctttatttgtaggcaaatggaaatgagaaacaaacaccaaaacaacagattcctaccattctagaagtgtagtaagttcttagaaatatttcacctaaaagtttagagaaaaacaacagatcagagtgattctcatgggaaactgcactcacatgcaaactggtctttagggatctctactgaatgttcatggcgaccatggggcatgagagaacaaagggcaatgtatttggtggtgcaggctgtaggtggtgactgggtgtcgagggcagaggtggggacagacatggaaaccttgcatgtttccctagaccattgatcacaagagccaaggccttcagcttcttggcgattgggcagaaaatggttctgcatctactactgcaggcaaaaacactatgcttcttagtggtgggtggaggccaaaagcttatcccattggaggagagatgtaactttcttgtgccccacatcctgcattgcaataaagcagaagtctcctactctttctctccagacaccccacaggtaaaagtttcatcagaacgaggtgcaagaaccctgagaaatcactgtcttcaaagcctaggggtgcagaacctgcctaggactgaggaaggcctgaaatatagagcattgggagctcatgtaccgctccatagacacagggcattatggaattattccaaccttgttagctttctcgagatttataggcttgagagtcatgtttctcagaatctgcaatgctaaagattgcactggatgctctctactttatgatatcttggagaagcttactggcttggaaaaagtcatccatctgacagcatgtttcattaggaattttgggctccaaacagcatccctatctgccactaacatgtcaagcaccactggatctgctgggtcatatggcccaagtggcagagcagcttgcacagcagcctgattctgttgcagagccttctcttgttctcgacttcactcaaaactggcagcctttcaggtcactaaataaatgggccagagtaacagacccaaatgaggaaggtgttgcctccaaaatccaagtaggcccactaggcattgtacctctttcttggttgtaggagggttcaaattcagcaacttatgcttcaccttagaaggaatagctccataggccttacacctctgaaccgctagaaattttactgaggtagaaggtccctaaattttagtcagatttatttcctatcctctggcatcaaatgtctcaccagtaagtacaatgtgtttactacttcttgctcactggatccaatcagcataatatcatcaatataatggaccagtgtgatatcttgcagaagtgaaaagtgattaaggtctctcgaataagattatgacacaaagctggagagttgttatacccttgaggtaggacagtaaaggtatattattggccttgtcagctgaaggtcaattgcttctgatgggccttatggacaggaatggagaaaaaggcatttgccaagtcaatggccgcatattaggtacaagaacatgtgttaatttgctcaagcaatgaaagcacatctggtagagcagctgcaattggagtcaccactaggttaagcttacaataacccactgtcattctccaagatccatctgtcctctgcacaggccaaatgggggagttgaacagggatgtggtagaatcaccaccccctcatctttcaagttcttgacggtgatgtcaatctctgcaatccctccaaggatataatattgtttttgatttactatttttctaggtagaggcaactctaatggcttcaatttggcctttcccatccataacagccctcaccctaccagtaagggagccaatgtggggtttctgccagctgctaagtatgtctatgccaattaggcagtttggcactggggaaatgaccacaggataagtccaggtactaactggacccagtgtaagtcagacatgaactaaaatgccattaattacctgacctccatatgcccctactttaactggaggaccacaatgatgttttgtgttttctgggatcaacatcagctcagagccagttttcagtagtttccaaaacgtctgattatttccctgtccccagtgcacagttaccctggtaaaaggccagaggtgtccttgggaaggatgggagaaagataaacaccataaattgttggtagcttagtagggtgcttccttaaggggacccagcctcccctttattcaagggcttctgggtctgtaaactggctcgagtctggaaattaattgaggggccatgattctgtgtcttaataattcagattagtcttttgtccattctacctggtagttttctgtttatataaattaagtaggaatgcagtaggctttctatcaatttcacttctaggaacatcgtgattaattagccagtgccagagctctacacgagtcagactattctgattgttgctttgcctctgctgtgcattatggtagctatacccagcattcctctgatgggtcagtgttgccacttggtccctggccctcaggatccaattattcccattgtatttaaattttgtagttgagtgactgtggttcccactgttagatctgacatacagagaagagcaattacagggctcttgaaaaatgcaggtgctaccctcacaaaactatttcacaaagcattggtcaagggtatatattctggaccctcccagctgggatgagtaggtctaaagtgactaatccaacaccaccatcctaatctccctaagcctttggaccccttcctctacattaaactaagggagatcaggcatttccagctcactcacagcaggccatcttttaatctatatttcgggtaatcaagcaaataaactattagaaccttttttaagtccccaagctgcaacattaaatgcagaatccctacttagtaggcccacattaataaattcagcctgatccaactctatgttacttccaccattatcccagacccttaatatccattcccatgcctgttctccatatttctgcttatataaattagaaaactcaagcaattcttttagagtgtaatgcatctcctcatgggtcacactctgaacctcacctcttgggcccaacaggactttagtctagttgtaggtctagaagcaaacaagggcattggagatgcctcctaaggagaatcaacattatcttgcctggcaactgcctcacgggaggccgtcactgttgcctcaagcagcgcagggttcacatcctcagacaaaggtggaaaggctaatggcagcatgggtcagggaggggatgttgccagtactgaggatggggaagctgtttcttttcgcaaaaaaaggttaatcaaagttcataaattcagtgtcctcagtttcatcagggtcctctcacatgtccccattccaagttacagggttccattcttttctattcaatgccctcactttaacagtagacacctggcagggctgggcatgcacctttcattgcaggttagctactcgcataataagagcttgcatctgttttactacaatttcaactctttctctacaggagttaagactctcactcagggcaatcttagcagatgtgtggctcagtatctgcttctgaagccaggagacagaatccctgagtttatcattttctttcatcactttctccagtgaacttaggaccaaccaacttcattatgctccttggttctccacatatagtcaaaggtattatgcatagagtcactaaactccttccctcatgagtggtgaatcaggagtgtcaaatgcatttattttgcctaactctttaaacagttcatgccaaggactatcagtgttctccatactattagaagtagagtgctttgcatttttgggtctaatcatattaagcagtcatatccagaaatctcaaaaccaatgaaagaactccatccttaatattctgttcctccagaaccactcctggttccaaaatctatattactcagggttctctagagggataaaactaataggatacacacacacacacacacacacacacacacacacacacacacacacacacaaaggggaccttattaagtagtatcaactcacaagattacatggtcccataataggccatctgcaacctgagaagcaaggaagccattctgagtcccaaagctgaagaacttggagtccgatgttcaagggtagaaagcatccagcacaagagaaagacgtaggctgggaagctaggccagtctagcctttttacatttttctgtctgctttgtattctggccacgctgccaactgattagatggtgcccacccagattaagggtgggtctgccttcccagcccacttactaaatgttaatctcctttggcaacaacctcacagacacacccaggatcaatattttgcatccttcaatccaatcaagttgacaatccgtattaatcatcacataaacaatagtaatatactcaaatatgtatcttaaggatggttgttctttatactacctcattgaggttctctgaatttcctgagtttgtgtgtcgacctctctagttagactgggtaaattttcatggacaatatcctcaaatatgttttcctcattgcttgctctctctccctttcagggacaccaatgagtcatagatttggtctctttacataatcccatatttctcagaggctttgttcattttttaaaattctttttctttatttttgtctgattatgttaatttgaagaaacagtattcaaggtctgagattctttccttaactacttttattatactaatatttctgattgtgctatgacattcaatagtgaggttttttttagctctacaagagagggttggttctttcttcaaatggcttgtctttcatctcttgaatcattttacttcattccttagattacttgaaagaggtttcaattttctcctgaatctcaatgctctttgttgccacccagattctgaattccatgtctgtcatttcagtcatttccttctggttaggagccattgctggagagctagtgtggtcatttggagataaggagacagtttggcttgcagagttgccagaattcttgcgctgcttctttctcatttgtgtgacctgatgttcctttaactatgatataagttgacttcatttctggatgttttcagagggccaaggtggtgtacaaggtctttatttgtggttgaattcttgtccatggttttacggggtggtatattagcaaagtattttggattttgaagattttgattttgcaaactaacaggtaggctcttcttcagccacatggctcctctgtatttcctcacaattgcttctctcccacttgagttccagttgcagatctcagcttagcattctttggccgtgtaccgcagccctggggcaagctcagctttgttttggctccatagcttgggagaagcaggggcaggggcgtcagggtgcttgcagggaagacacactaaactttttttccatagggtggctggggcctgctggtgtgtgaataaagcactcaggatctttgtttcttccccagtccacagacagcaagggcagtaccactgcagtggcagtggcagatgggctttcagtcgcctctgggagctccatcccacagaaacacagagagctgccaatggaaatgttcagctgagtatgaggtgcctgtactgtgtgcccaagccaggaaacctgcctggtgaagagtaacaggtgggagctcacagggaagagagactggaattctttccatataacccctgctgtgtgctggaggcatcagggaagtgaccaggtcactttgttccttctgcagcccaagggcagtaagggcggtattgctgcagctgaaatggcagaggggctgtgggttgcctctgggatttcctccccagagaagcacagtgccttcctgtgctcccctgcctgaacacactgactaaagtgttcaggcagggccagggtggttgtgctctgcccattgaggagtagccggggcaggcaccagtgcagaaaacagtgtgcccacttttccgtaaggcagctatactgtgctggaggtccgtgagagtcctgaagctcctcgctccctcctgagcctgcactttaatctcaagagtttgagatacacagtggtaaggaagaaagtaacaatgagtacagctaatgaaacccaggaagacaagtcaattctctttgaggggtgaggtgggggccacaggcagatggagtggattaaagaatgactagtagagtggcagcagaagacaagcctggctctgaaggcagcaagtcctccagggaatatggggtcaggggaggttctgaaagatgacacactgcagagagcgtgtgtttgtatgctgatgacaagtatcagtagaaaggcagatgaacggattctcattctcagaaagacctgtcctgacctcctgagagtacacagagcatgagggcaggacagggaggaggacgcactctcattgattcatgcaaagtcctcggccaaagtttacctgctctccacctctgtgactttgtcctttctcaatttaagatgctccaagctggaaaaatggattattgaccagtagttggctgatgcaattctaaagctaatacaccaaaaagcacttgagagatgtatcagaagatcatagagaaatagatactttaagctaatatccatgtcttcaccctgcactgtcttcttatttgaactcccttttccgggaagagttgtgcttgggtaaattctatagctcacagtgtgacttcaaaacacataataaattcataaactgtttcctacagtgagttatgttaaactttctgaagagtgtttttgaaatgtaggagagcagactacaattgatattcaaaaagaggaaacttcctggccgggcgcggtggctcacgcctgtaatcccagcactttgggaggccgaggcgggcggatcacgaggtcaggagatcgagaccatcctggctaacacggtgaaaccccgtctctattaaaaatacaaaaaattagccgggcgtggtagcgggcgcctgtagtcccagctactcgggaggctgaggcaggagaatggcgtgaacccgggaggcggagcttgcagtgagccgagatggcgccactgccctccagcctgggcgacagagcaagactccgtctcaaaaaaaaaaaaaaaaaaaaaagaggaaacttccatttattttcccctttaaccaagttaacccataactgtgtcgtgttattatgcttcatagcgcatcactgctgagatcccctctccagctcatgtcgctaggaaatatcccaaaacagaatcaattttttgtctttttaatttgataatttttccccaaggcttttgtttctttgattcacctcatatggcaaggggttttaatagggtttatttgctggtgaagaaacattaaacacatcttttaatagaaaaaatacttttataggcaaatgtagttgtatattgctagtgaagtaactggattttattaatggtgtgagaatttcttcctcactgtggtatgtgaatgtgtatgcatatttgcatatgtaaaagaaatagtaatttgtgaaatggaagatgattctccacttctcactgagtatggctgtaaaataaacttgctctcctcgggcactgaagtacactggaaagatgacacatctacagaaagcattcctctccaaaagagcttataagagaatgtgccccccaggttggttaaaacgtatgttaatcctatggcagagaagtttgatttagcctttgggtgtagcccactgagtaagttcatagtgatctatgtcccagttttcatgggctgaaatataatactcatccccctgcccccatctacacacacacacacacacacacacacacgtagacaccaatttccccccaaaacctctttgcttaatcttctcctgctttgtattttctttgatactttgttgaatggcttccactaagttcaaatgtattttactctaaagtcaatttgtaaaattttatctggtaatttatatattaaattgaaagcatctacacattgcttatatgaagaactaccatgaaaacgtatggttccatttatatgaagtgtccaaaataggcaaatctataaaagcagaaaaatacatttgtggttgccagaagctgcagacgcagggcaacagctaaggagagtggagtccctttttggtgtatgaaaatattttaacatttattgtgatgatggctgcacaactctgaatatatttacatccattggcttgcatgccgtaaatggatgaattagacctcaataaagctgtttaagaaaaacctattagtgagaccaaggacccccatttttctaagagatggtttaattttttgtgtgttttttgtctccccagctccccactttatacttggccctttagaattgcaaatatggctttttacctccccttcatctgaatctccctacagggcaagtcatctaactatgtgcttcaagatggaactcctgagttcacagttgatttataaaccaaagaatgtccactacaaaactctcaccctccagagacttgtctcaagcgacaacatcctgttcacaagggcaccagcaggcaccagctggtggataaggtgccaaagctagcatggacccctgaaccattgcttgcttcctcccctgccttttaaaagtaccactttctgctccaaaagtgaagtggtaaaacaggactcttgtatttcttcccctaagctagcgttggaagtacatcactttctttacaccagacttctctcttcttaattagattctgcaagtggcaaataactaacctgctcttccgttacactgggatgtgtttagattagtttttcaaaggttagaacaaagttgaaaaagtgagaagagccctagattttttttcttggaaatctggcttaaatcctggttcctttatttccttgatttgggaatttggtctctgggcaaataacatcattttcctaagtctagatttccttgtttataaaattgggatgaatatgctatgctatctacaccatgagctcaataagctactgtctgtaaagaaatcacactcacactgacatgtacacacagatatgtatgtacgtatacaaatgtgaggacctaacccaagcactgagtgagtatttgctgagtcactatctgcatacagcatctggcaaatggatgtgtgtaatttctccagggataagaagcaaacgtatacctatggaaagccttattcaggccataacaaggagagaaatgctgagtcccactccatgaatgggtcaaggagcagaatatattcaaagagatatttcattgtttcaacttgaaagtgaggggagcatggcacctgaacagagatgatataaattaatgaaactgagaaccaggtgaagagcttgaccatcctttgcgtagttagctacattgcctatttttttctttcaactagactggccatgatgtaggcacactcttttagattagaaacaccacccattatgcccattcattccagcaccctgacagtcttcatgtggaaattaaacttagttttttaagaattcctcaatcttatacaagattttgaactggcgattttatgaatcaaaaattaaattaaatgaattgcacataaagatatggcatatgtatttttactacattgtgggagaaaaaataattattacacaaaaaaaactatgtcttacctgatttcagaaataacagaagtagaagaaccacttccttatgttccattttgggactggccagcagtgcccagaaagtgtgtcccaatcccaggatgttgttgacttacatgagagtaaacgcatccacaaaccagatagtcaaattaagttaatgattctctcagagacccatgccactggctcagcagagttcaaacattacctgaatttttagaagcccttttctgaatccaaccatccctcagtcccctaagagtggccagagaagaaggactccactgagctgacattccagttcagtaagttgtagggacagttttttaaaagaatctgtaggtaggggagcaccaacccataacatactgtaagcctgcagggttctccagcccagtcccttctagaacccttccctgtccacaaccagtgacggattattccaaacgttgttcagtttcatttgacctagtttgaaaaccaagttccaataatgaataactatgggagcttgggttgctgtattcggtctctgagtagcttttccacctacccaggccacaatcaataataatcaccattgaacatccttgaagcaattcttttgaaattactttgcatcaaagattgcacaagaactgctttaagtagaaggactgatgtcagcaatcaagggtcccaccgagggctgcagatagttcttgaccttcacatgggaaggcgtcattgagttctgacactctggcaatcctctaggactcaactttctgataagctaataaatggaaaggtgaaattagataaagacattattacctcatgggacaactaagcattagaggttagtctaaacatgctcttttagaatctttactacactactagctaccatttattgtaggtttgtctatctgtgccagatacaaacaacactatgaattacccataccatgctataatcaccagatttttctctgttattcccattaccattttatagatcaggacattgaaatttgcttgcccatagttatatcaaaggaaattgggaaagccaggttccaatgcaaatatctcaaatgattacttttttttttttgagtcagtctcactctgtctcccactgtggaatatagtggcacaatctcagctcactgcaaccttcatctatgggtttcaagcgattctcccgcttcggctttccaagtaggtgggattacaggtgtggaccaccacgcctagctatttttttgtatttttagtagagatggggtttcaccatcttggccaagctggtctcaaactcctgatttcaagcaatccccccacctcagcctcccaaactgtggggattataggcatgagccaccatgcctggcctcaagtgattactttcaaccactgcactacaatttactactgggaggaaagaataataataatagtaatggctataatttattgattaatggctatatgcttggcattgtactcacttttgaagttttaatttataattgacacatagtaattgtacgtatttatggggtacagtgtgatgtttcaatgcatggatacactgtataaggatcaaatcagggtgattagcatactcctcacttcaaacattttttctttgtggtgagaagattcaaaattctctcttctagttatcttgaaatacacaacacataatcatgaactatagtcaccctagtgtataatagaacaccagaacttattctttctatctaactagaaatttgtacacattgaccaaccccttttcattctcctctccctgactaccctgctcaccctctggtaaccactattctactgtctaattctgtgaaatcaagattttactaagttttattgataaataataattgcatatgttcatggagtacacagatatatttcaatacaaatgatgtacagagatcaaagaggggtagttagcatatcaatcaatcacctcaaacatttatcactcatttgttttggaaacactcaatatcctctttctagttgcttgaaactatacaatataatattgttagctagactcatcctacagcggcataaaacactagaacatatttctgatacctaggtgtaattttgtagcctttaacaaatctctccctattccccctttccccactcttccagacctggaacatcctccatattactttttacttctttgatataagcttttttagctgccacatattgttactggcagcaaatccatatgggtctgcagcaacctcaattgttgcttccttggacgaaagattttaagaggcaggaggcaaaaggacagcaggagtgacagtttatttaaaagctttagagcaggaatgacaggaagaaaagcacactcggaagagggccaggcaggtgacgaaaggcaagtggggtggctggcaaaatggccgaataggaacagctccattctgcagctcccagcgagatcaacacagaaggcagatgatttcttcatttccaactgaggtacccggcttatctcactgtgactagttagacagtgggtgcacctcatggagggttagcagaagcaggctgggacatcgcctcacctgggaagtgcaaggggtcagagaactccctcccctagccaagggaatccatgagggtctgtgccgtgaggaatggtgcactctggcacagatactatgcatttcccatggtcttcacaacccacagaccaggagattcccttgggtgcctatgccaccagggccctgggtttcaagcacaaaactggatagccatttgggtagacactgagctagctgcaggagctttttttccataccccagtggtgcctgggatgccagtgagacagaactgttcactcccctggaaaggggactgaagccagggagccgaggggtccagctcagtggatcccacccccatggagccaagcaccctaagatctactggcttggaattcttgctgccagcacagcagtctgaggttgaactgggatgctccagcttggttgggggaggggtgtccactattactaagccttgagtaggcggttttcccttcacagtgtaaacaatgcccctgggaagttccaaatgccccaattaaaagacacagactgtcaaagtggataaagagtcaagacccattgtgtgttgtattcaggagacccatctcatgtgcaaagacgcatgtaggctcaaaataaagggatggaggaatatttaccaagcaaatagaaagcaaaaaagaaaaaaaaaaggggggtgggtgggttgcaatcctagtctctgataaaacaaactttaaatgaacaaagatcaaaagagacaaagaaaggcattacatgatggtaaagggatcaatgcaacaagaagagctgactatcctaaatatatatgcaatacagtagctcccaggttcataaagcaagttcatggagacctacaaagagacttagactcccacacaaaaaatagtgggagactttaataccccactgtcaatattagacagatcaatgagacagaaaattaacaaggatattcaggacttgaactcagctctggaccaagccaacctaatagacatctacagaactctccaccccaaatcaacagaatatatattcttctcagcaccacattgcacttattctgaaatagaccagataattggaagtaaaacactcctcagcaaatgcaaaagaatggaaatcataacagtctctcagaccacagtgcaatcaaattagaactcaggattaagaaattcactcaaaacagcacaactacatagaaactgaacaacctgctcctgaaagactactgcgtaaatattgcaattaagggagaaataaataagttctttgaaaccaatgagaacaaagacacaacataccagaatctctgggacacagctaaagcagtgtttagggggaaatttatagcactaaatgcccacaagataaagaaagaggatctaaagtcgacaccctaacatcacaattaaaagaactagagaagcaagagcaaacaaatacaaaagctagcagaagataagaaataactaagatcagagcagaactgaagaagatagagacaggaaaaacccttcaaaaaatcaatgaatccaggagttgtttttttgaaaagatcaacaaaatagatagaccagtagccaaactaatgaagaaaagagaaaagaatccgatagacacaataaagaatgataaaggagatatcaccactgatcccacagaaatacaaactaccatcaaggaatactatcaacacctctatgcaaataatctagaaaatctagaagaaatagataaattcctagacagatacaccctcccaagtctaaaccatgaagaagctgaattccctgaacttgaataacaagttctgaaattgaggcagcaattaatagtaaccaaaaaaagtccaggaccagatggattcagagacgaattatatcagaggtacaaagagaagctggtaccattcctcctgaaattcttccaaacaatagaaaaagagggactcctccctaactcattttatgaggccagcatcattctgataccaaaacctggcagagacgcaacataaagaaaatttcaggccaatatccctgatgaacatctatgcaaaaatcctcaataaaatactggcaaacctaatccagtagcacatcaaaaagcttatctaccatgatcaagtcggcttcatctctgggatgcaaggctggttcaacatacacaaatcaataagggtaattcatcacataaacagaaccaatgacaaaaaccacatgattatctcaatagatatagaaaaggccttcaataaaattaaatagcccttcatgctaaaaactctcaataatcttggtattgatggaacatacctcaaaataataagagctatttatgacaaacccatagccaatatcatactgaatgtgcaaaagctggaagcattccctttgaaaaccagcacaagacaaggatgccttctctcaccactcctattcaacatagtattagaaattctggccagggcaatcaggcaagagaaagaaataaagggtatcagatggaaaaagatgaagtcaaattgtctctgtttgcagatgacatgattgtatatttagaaaaccccatcatctcagcccaaaatctccttaagctgataagaaacttcagcaaagtctcaggatacaaaatcaatgtgcaaaaatcacaagcattcctatacaccaataatagacaaagagccaaatcatgagtgaattcccattcacaattgctacaaagagaataaaatacctaggaatacaacttaaagggatgttaaagacctcttcaaggagaactacaaaccactgctcaaggaaataagagaggacacaaacaaatggaaaaaaattccatgctcatagacaggaagaatcatgaaaatggccatattccccaaagtaatttatagagtcaatgttatccccatcaagctaccattgactttcttcacataattagaaaaaactactttaaatttcatatggaaccaaaaagatcccatatagccaagacaagcctaagcaaaaaaaaaaaacaaaaacaaaaacaaaaaaaaaacaaagctggaggcatcacgcttcccaacttcaaactataccacaaggctacagtaaccaaaacagcatggtactggtaccaaaacagatatatacaccaatgaaacagaacagagccctcagaaataacaccaaacatctacaaccatctgatctttgacaaacgtgacaaaaacaagcaatggagaaaggattccctatttaataaatggtgttgggaaaactagttagccatatgcagaaaacggaaactggaccccttccttacaccttatacaaaaattaactcaagatggattaacgacttaaacataaaacataaaaacataaaaaccctagaagaaaacctagacaatatgattcaggacataggcatgggagaagactttatgactaaaacaccaaaagcaatagcaacaaaagccaaaattgacaaatgggatctaattaagctaaagagcttctgcacagcaaaagaaactatcatcagagtgaataggcaacctacataatgggagaaaatttttgcaatctatccatctgacaaagggctaatatccagaatctacaaagaacttgaacaaatttacaagaaaaaaacaactccatcaaaaagtgggcagtaagaacagacacttctcaaaagaagacatttatgcagccaatacacatatgaaaaaaagctcatcatcactggtcattagagaaatgcaaatgaaaatcacaatgagataccatctcatgccagttagaatggtgatccttaggaggtcaggaaacaacagatgttgaagaggatgtggagaaataggaacacttttacactgttggtgggagtatcaattagttcaaccactgtggaagacagtgtggcaattcctcaaggatctagaactagaaataccatttgacccagcaattccattgctaggtatatacccaaaggattataaatcattctactataaagacacacacacacgtatgtttactgcggcactgttcacaatagcaaatacttggaaccaacccaaatgcccatcagtgatagactggataaagaaaacatggcacatatacaccatggaatactatgcagccataaaaaggttgagttcacgtcctttgcagggacatggctgaagctggaaaccatcattctcagccaactaacgtaagaacagaaaaccaaacactgcatattttcactgataagcgtgagttgaacaatgagaacacatggacatggggaagggaacatcacacactggggcctgtcaggggttgaggggttaggggagggatagtattaggagaaatacctaatgtagatgacaagttgatgggtgcagcaaaccaccatggcacatggatatctatgtaacaaacctgcatgttctgcacatgtatcccagaacttaaagtataataatttttaaaaaaattttttaaaaagaaagtcaagtgtgtgctttgaccttttgacttggggttttatatactggcatgcttccggggtcttgtatcccttctccccactcacccaactcctgagagcttatccagaagctgtttcaggtgttttctatctattgggagatggcttttcactggtgccagctgtgaccaattattactttacaaagacagttaaaaactgcctgaccatcacctaatggttgacaacactccaggtgtgtgtttggggcggtggtaggggaaggcactgttctgccctgctcataccttactagctacctactgtaacactgagtgagaacactcactgtttacctttctgttcctggcttacttaacaaaccttcctttagtttcatccatgttgctgcaaaagataggatctcatttttttaatggttgaatagtattttatggtatgtatatatcacattttctttatccattcatgtgtagtcagacaactagattgattacatgtctttgttattatgaatagtgctgcagtaaacctgaggatgcagaggtctctttgatatttaacgatttccattgctttggataaatgcttagcagtgagattgctggattatatggtacttctatctgtatttttttgaggaacctccatactgttcttcagaccaattgcactagtttaaattcccaccaactgtttttaaaattccctttttttcctgcatcctcaccagcattttttattttttgtctttttgataatagccctactaactggggtgagacaatagctcgttgtggtttagatttgcattttcctgattagtgatgttgagcacattttcatacatttgttggccatttgtatgtcttctttcaagaaatgtctgttcagatcatttgccctttttttttaattgggttggttttttgctgttgagatgttcgagatccttgtatattctaatactagccccctgtccgatgaatagtttacacatatatgaggcaccacgagatcctttacacaggttagttcacttactcctcactccaaccctatgagggaggcgctattactaccactcttattttacccatagagagttcagcagaggttcataacttcccccaaagtcacacagctagtgtggcagatggagcagggttggatgccagagccaggccctccagccccacgcctcgttgctgcaggagccctccaatctgcagtcactgccacaggcatcaatggcactacccagaataaggatttattgagcacctactgtattcacagaactctaatcagtctgaaagtccaagcaatgaagcaaacaaagccaaggaatggcagaaatggcagagttcaaaccagagtctagggcctgaagtgcaccgcatgggccaggttaaagtgaatgaaacattcctattttgatccttttcattatttatcattcatacccctaactacctttaatgcgattagttttagatgtaaaaacaacaaatacgctacaaatcagctcttccaacattttcttctcgtgaaaaaggctctttgaaagccctgttttgcagaaacttgctccttttgcatgaatggtaaatcataggagacctggtagattacgctacatacttaatgtgaaaggttgcttcattcaagagcctggagttttcagacattgtcctgaaacttccctgcctagggtagggtaatgccagcgacggcaggaaatagctctgacgcacttaagagttaaatacaacctacagaagttctggctgggtggggaaaacctattgctaaagagaagagctactttttttcttttctggaatttgcaaacagcatttattctcagccttaccttccacaagctccacctggaacattgctgggcagcgtggaaacagaagcaaacatcagccaggccggcagggggcagcagaccccacattttgccctcgcctcccgtgggagggagtgcccggctcccaaaatcctgtggcgggttttgtcccaagcgacttcagccagcagatagttcgtgtccttctgaggccgcaaaatttggggtggaagaagtggggcgtgaggctgagagtgaggagagcaatccagggtcgccagggtgggagccgcagcgggccctaggcctccgggaggacactgatgcttccggaccgcgcgaggcgcgccggcaatgccggcaatggacgtgcgacagcggcacgaggcggggcaccgggaggggatgcggggggaggggggactcgggcatggcgggcttcaggttccgagccctatccctgcggggaggcggctgaggcccagcgagaattcgagcgcggtgcgggcgggccggcagtgctggggggacccggcgcaccctctgcagctgctggcccgggtgctaagcccctcactgccaggagcctgcggcgcctgctggctgctttgagtgcggggcccgctgagtccgcgcacacccggaactcgcgctggcccgcgagcgccgctcgcagcaccggctcccgcccgcgcctctcgctccacacctccccgcaagcagagggagccggcttccgcctcggccagcccagagaggggcccgccacagcgcagtggtgggctgaagggctcttagagcatggccagagtggacgccaaggccgaggaggcgcccagagtgagcgagggctgctagcactttgtcacctctcaatttgacgttgtaagcttccttccacagagtgacctttttcatgcaatcgatgtgctcctgtgtcagctatgcaaaataatttttgtttactgaatctggtttaaaaggcaagaagttgcttcccattgggcactttgatcctggtgaaacgggatgtgtatgcctggaaacatggacagtcacatgcactgcttggttttgtgtggaactaacatgagatgatcttttcactgattttcagaattgtggagaattcacttaggaaaataagcatgtgtatcaatgcatgaccaatatgggc

SEQ ID NO: 1282 - DNA, 24753 bp, Homo sapiens
accccatccttccctccatgtacaggtctcttctctccctaactctcccttcagccctgggaattctctctccttggcctcatctcatccctgaggcttatcttataggtaactcactctatctcttattccaagtttattatttacatagcttggaatagaagggagttagagaggaaacaagggtgggagaaaaaaaaagaaaagatagttatgtgaatttaatttaggcattaaggaaatacccctgacaaaaactttactatgccagtggggccacatcaaaatggcctcggcaggggaccctgtgctgcttaagtctgtagatcaacccatgatgctgcccagctgcacgcactgaactagattccctagttcagtttctggtaagttgaccccctggctcacccatgccataactcagaagtgaaaaagtctgaggatggcatgggtgctttctctcgtgtctgcttcacgcttgccctgggagtggacctttcgcttcctgcttcaacagaactccaagctgtggtcaggccccctgccctcccacacattctgcagaagcaccccatccctgtcaccaaggtcttcctaccatgggaactcaaaaggacgacccaggaagggtcttctgacacggagacccgcaatgacccatttccagcagctgtgtcaccctggggcgtctctagtccacaaaatatcaggagcattaaaaggggcttctcttcacaggacatcgccctggagatcttcttccacaatggatattccaagtttcttgtcttctacaacaatgatcggagtaaggcctttaaaaggtaagagcttgaaaatcctccttctgaggaaactgatcctgaactgagagcagaggggcagagaacactcagctctgtgctcaggaaaagtgttctcaacccacagtgaacgccactcaggctgggcccagggaggcactgctggcctgcagaactgccaagtcatgaaatgatgtacaggaacaggcagagaaggcccttccttcagtcctaggaagcaggctccattttcctgaactgaagtggcatagaacaggaagtgagaaaaaaattacgcagctaccacagagttaaggaactggctgtttaatgggccttccagaatgttctggctttattttctaattttccaagtaatttttttggcttaatctttctttctgatcccagttgccaattttagttgctccaatttcatatttcattggaaggaattccaaacaactgatttcccacatgtgcactgaacatgtttttctccagatggatcagtttaagaaatctaagccagtgtgtaagttcttaataccatggttatttgtttttattaccattaaagttatagatcagtagattggtttgtagtgaatctagaaagaacagaaaggaaggtcagttcctcatcattatagaccacagagaggctgattaacagagggagtggttatgtgctgctccacatgggctggaagttctgaggtgagatttgatatcccctggccaaggagcccattttgtgctcagaaattcaagccctgccttctagtggccctgtggaactggcacccagggcccactactgcatccaagaggcagggccagggtggagaaaaacaactgtagagaggcttttgtgctagttctaggcgcacttccttggactcaggtgagcctgctcatgcggttcttccatgctgctgctagattgccccctaaaattatattcaaggcctagtttagaccaaaccaaacaagcagacatacaacccattaaacttgattcatttccccctatggtttctgttcattaaacaaagtttttcacagttgatctagaaatcttacacctccatagctcaggatgtgaaggtggcctaatgcagactccacaaccactacccactcggctcaaggagcctggcattaagatggcatttgtcctcacagcaacgcactggaatgtacagcaggattgttgacattggcaatgttgtcaactgcctggcccagaggcggtacctcacacacactgcctaagtaattattgttttattgttgtcattgttggtattaaggcaatagtgtgtaatgccagagagtgctgagggttgcctcagaggtacacccaggcctggtgttcacgacctgggggcaggatggagcgagggggagcaataatgagcctagcttcctgcctgactccggaaatgcctctgcagcaggagaaagggtcttgactctgctgatggaattatcccttcccttttcatgtagcttctgctctttccaacccagcctgaaggggaaagccacctcggaggacaccctcagtctaaggtaatggcgggtagccatgctgtctgggcatggcactgccctggctttgatgttcctcctctgcctcatcccactctaaagaagtcttgcagagagcatgcccaacagtttccctcatttttctctctcctattcctatacatccttcatcctactcctgaaattccttctgccagttaaacctctgtgaacagacttgaagtctcacatgccctgtggctttttcagacccaagtggcaggaagccatcctctgcctttggtgactgggcaggtggcacagaggtgtggagtcaggcccagccttggaggtcaggccctcccatgggggtgtgtgagcaatcccatgctgtccctcctgtgatgagggtttctgaacgcttagaagctaaattcatacaagttggtgtgcgaatcagacattaatttaggaatctgtgctatggggcgtctctcccagtgaatgaattgcttgcagtcccccccgccgccgccaggtcccctttccagctacccagttctctggaaggccacttagggatcagtaggtgtttttatttcagtcggggtgagaatagaagaaggtggtagctggttttctacaggaatgtgtggggaccaatcaagagggtgtccccaggaatgacattcaagatatttataatcagtataaaatgggtctcactaattccttcaaaattatttattaatagcttgtgatacatggtatttgcttgttgatggagcaacaagcaaatagaaaaaaaaaatcccctgtccttattgagttcacattctcaccaggaggacagacataaaccaatataaatgagtgaactataaagcatattagataattataagtgtaagtgtaaaaaaccaagcagatagaggtgggcattgaaatcttagatgaggtggcaagcgaagcccttatcaagaaaacaatctttgaattaatacttggccgggcgtggtggctcactcctgtaatctcagcacttggggagaccaaggtgggcagaccacctgaggtcaggagttcaagaccagcctggccaacatggtgaaaccctgtttctataaaaatacaaaaacttagccaagcatgatggcaggtgcctgtaatcccagctacttgggaggctgaggtgggagaatcgcttgaacccaggaggtggaggttgcagtgagctgagatcgcgccactgcactccagcctgggcgacagagcaagactctgtctaaaaaaaaaggtggagaaacatgttatgcagttaattgagtaaagagtgtgtcagacccagggaagagcaaggcatggctgaggcttatcaaattggagtgcagggagttagttggggtggaggtgagggaggtcacaggggatagttggtgcaagattctcatgtcggtttttattccaaatagatgggaagcgttggaggattttaagcagagggttgatgtgaactgacatattaataagaatcactctggctgctgtgccaagaatagactggagtgggtcaaaggcagaagctggagactagttaggaagctattgctggaggctgttgcagtaatccaggtgagagatgatggtggcttggatcaggaacatgaaagcaaagataatatgatgtgatcagattatggacatgtttaaaggtacatttgatgggatctgatgacaaatcaagtgtgagaaatgcatgtatgtgacagaggacttaaggataagacagaggatttaggcttcagcaattggaaaattaaatgaggatgatcagagaaagagtggctgtagggccactgtggctatctgaagctcagatttagacatgtgaattttgagatgcctatcatacatctcaaagacatcatggagctattgggcatatgaatctggagttcaagagagaggttcaagtgagacataaatttagaatagtgtttaaagtgatgagaatgggcaagattatcaagaatggatgcacatggaaaagagatcagaggactgtgccctgggcacaccaaacttaccctctggtaaggacatgggcagagccagctgaagagatggggaaggagtagccagaaaggtagcagaaactgtaggtgtggaagacatcctggaagccaggtagagtgactcaaggtgggagtggtcaagtgttgttggtaggccaagtgggataagaactgagaaatgaccattgagctttgtaacatgagagtcattgatgaccttcaatagactaattgcagtggctaccagcagaggctcctattgtgccaggcacttaccctttatagattgtggtgaagtgcaaggcatgccagggtatggtccaggggacccgggcagcagtgggtcgctggagttggggtggctgtttaccaactgtaatgggcatagtttaatagttcaacaacaggatagtcctaattgtgcatatctgctgaatctcagccctgctgatctcatattgtttatgtttcatataagcctttatgttcatacttggatttctcagcactgtttcagtacaaggtaaaaagctatttcaaactaattgaagcaaaaaagaggattcatgatagcatctacctgaaggtcaaaaatggtctggctccaggcatggctggaccgctaggcacaagtaagtctgcaggaagtggtggctctccctctctcagggaggattttacttggcctggctccatttctcataggcgttctcatcacaggggcaccgatgcccccaacagctccagactgacagtcaatcatgcaggaatcccaccacacaccgtacatgctctatcccggtaactttagcaaaacttcccaaactgtcattttccccagttaggttaattacatgcccatcccagaaccaatcaagtgttttcattggctggatcggagggatgtacccgcccagcttctggggatagggtcagtcccacccaactacatagaccaaattgaggggagtatggttccctgagaaaatcaaggttctgttatccacaagggggtgagcactaagggtgtcagcaaaagcaggtggccacacatggttccacgcagagggaagttccaagccgcagcactcatgggctgcagatggttttctctctccctggagcaatgctgcatcaatcatgacacacatcacttcactgggctccattgtctctgcagctcaccctttgatgaacctattctgtaatgtcactcagtgacagcatagctgtccctatgactgtgggtagctctctgtccattatttgtcttttgtcctcagaatcttagtgttgccttgcctggaaacacttaccttcctccacataccttctactccaaatatagaggggcaggtagaggaggggcagagggaggaatgcagaagaggagcttacccccagctgtgcccactaagttagaggcccctcagaaatgattgccaggttggaggaagatgatgttttgtagatgagtcaaatgtctggagattactccttactcatccccaggttgatgatgacctgcaatgccaacctgtgtaccaccttgcttctgtggtacagttgagccccattctgattttatttccaatgtgattatttttgccatcatggctacctgatcccactggagcagggtcttccagggctatgctgggtcattcctggcacagtctcagcacagctccaggttggagacccttggagaagcttctggggtcatctaggaacagtgcttagtgcttcagaggaatgctcatctcagttcatggaaggagagcctcagcaaaatgcggacaccccgcagagtgctgaccctcggctctgaggccacccatgcagtgagggcatgtggcaagactgtgctaaataaacagccccgggcttcaggatcaagctgatttgggctcatagtaggtgcccagtaaattgtaatccttctgcctaattttagaatcacctgatgtgtgtttgggcatgttaacagaagaattgattaaaagcaggtggctctccttgctctcagctcctcggagtggccccctttccagcccttctcttgccagcccaattgtggcttcaggagctccagggtgggaaggcagtggtggccctcagccttaggagggcttggctggccactgacatatgcctggaatgaagctgatgatttttcttttggatcactggaggcaataatcatagaatgagtcttgaaaaatgcctagctgcttgttagtcactctaatgaatgtggacttcttacctataaacgaggtgtgtgtgccgttctgagggttttcaactggcccatgacacttggcctaggctacagattttcatgccctaaaccttcagcttttgatgactcatgtggctcctttggacaccatcccacacatacaggaaaatcagagcttttggtaccagagtttgctgaggctttcagtgacaatggttgcctccataactatatatatgctaagaaggctctctgggcctgaattccaagtagaaaatacttgcaaagcctgcgtgaatcctgtcccaatggtacaggactgaaccttttgaagacagcatggtagcctgttcagacttctgtggggtgcaaggttctgcaagccgacagggccttctaacatatgccagctagagctgttggatgagtcctgctctgtggtgttgaataccggcaggatttttgagatgtaaaaagaccaatcagaaaaggagaaatgatggcaggaactgcagggaaagggggcagctagctggaatgcacttgtggataaacacacatcctcacacttaaatgtactcatgcccttccagaaagggctacagacagcttcaaaattaaacacagggtacaaccatcctttaacaattacccaacccctttaaaggggaaaaaataggtgtggtcatgtggagtgagttactctaattgtcctgagactaagaaaactaaaacaaacaatcatattggcttatattattttccagggatagataataagaaacaggcttttgcgattttttttttttatttctggaacatactttctcttggtgctgaatatcaaatttggttcttctctaaaggattgtgggtaccaaaggtggcaattcctttttaataaaacatacaaaaagagtactggggaacctaattctctgtatcagttctctgcatgaatgggagcctaacattcgcacttatttttgtacaggcatttctttgggaagctaacaatacctggctcagttacattgctttctaatgacctcagttcatactgagcccagatttcagaaaactcagagaaatacaaggctaggatgcctatctgattctctttctctcaaatctctcttgggctcagcacatatttttggataaactggaaacatccaccatgtcattgaggcaaaagcatccccgggctggagaaagccactgggtgtgagatggtgcttgtattcagggcctgattgtacctgggtgtttgcagttcctaaaatcattcttaactgtataaattcttcatatataatgtttagaatgaaatttattttgggggtgcaaagatttacagttgaacattttcagtttattgtctcctttagagattatctttgaaaaataatgaaagacaaataacttaaaaaacctaccataagaacctatgcgattcccatgagaatatgaccttccatgttaattaaccacaccccagaggcaccacagttagctggggggaggctaaagttcaagctccccttcctagcatttctcctccttcaatcctgccccctagagattcatgccattggctacagatctgtaaggtacacaaatgcttaactagtaaaggtagtgctggctccaccactgagtagagaagcatggtccttggatttcttgctgtactgaagccctgggagcacaactgtggagaccaaactactcatatcctctgtctataccagagtcactgggaccagaggcgaacggcacctggctgcagactcaaaatgagagtgacagccagtgctgcagcatctaggagcttgttcacacatttggctttgtgggccatgagcatctgatccctggccattctgcctaggtcatgctcagaccttggccgtggccccattccatgttcatctttgtctggctgtactaggttcatgcctcatctctgctgtatccttagccgtaacctcagatcccttccagggcaaaagcctgatgcaagccccagtcactgtagcaagcctgccctttttccttccaactctacccagccacattgcttccacaacctttatgctcccacaccaccaggggtggggaacaggtgtgcaaatgcccaggaatgctgatgagcaacccactggttcaaggtttctgccatcctagttgccccctgtgcccagctacctccagaaaacctgggacatagagatttcatgcagtttctatttattttgcaactttttcaggaatctgcaagaataagatcaacaacgggaaattttagattagccggctgagccgaggttaaggtgcctgaattgccttactctgtgcctcaattgtatatctaggctgactcggtgttttagattctcatgttaagcttgccatagtgcctcataaatcagcactgggcagatgtataaggatctattgattgttgcatctaggctgtaagatttttttttttaatttttatttcaaaatattgattcacagttgcaaaaatagtacagagagacactgtacacctttcacttaatatccccctctaccatggttacattttatatagctatagcacaatttcagaaccaggacactgacactggtacatgtgtatgcgtagctctttgtcattttatcacatgtagatttgagtaaccaccaccacaatcgacatacacagttattttatcaccacaaagatatctctgtgctaccactttatagttatgcctacctccctgtcttcccccaccatccttaaatcctgggaatcatgaatctgtttttcatatctattattttttcatttacagactgttctatacatggaatcatagagtatgtgacttttggagatgggcattttttttttaactgagaatagtgccattgagatacattcaagttgttgcatgtatcagtggtctgttcctcttttcgctgagtagtattccatgatagaaatataccagtttgtttaacaatttgtgcattgagcaaaatttggttgtttccattttgtggtcattacaaataaagcagattgtttacatttattacaattatcaaaatgttagaatacaagtctgccattttatttttattttttgtttttttcctgttgtttatttctctggtttctttttcctgcctacctatgcaccattgaaagatttgttaaaatcctaccttatctatagtattttttagcatatttttctatataactttttgtataaattggagttgcttgaggtatcttagtccatttgcattgctgtaaaggaatacttaaggctaggtaatttataaagaaaagaagtttatttgagtcatggttcttacaagctgtacaggtgccggcacctccttctggtgagggctttggggtataggtgcttccactcatggtggaaggtgaaggggagcaggcatcacatagtgagaggaagagagagagaggagagggaggtgccaaggtctttttaacaatcaattttcaacaggatctaatacagtgagaactcactcattaccaaaaggatggcaccaggccattcatgagggacccacccccatgaccttccattaggccccacctccaacactggggatcaaatctcaacatgaggtttggaggagacaaatgcccaaaccatatcagtatctcattatacctacataaatttatcacagactactggcattgagatgtactagtctgagtgaaatgtagaggcagtaagccttttaagtcttaaagtcttaaatatttagttgtctataatatataatctgtaattttcttaaatttttttctatatacattttaaaaaccacatcaaatatttcccaaagtcattttcacacacaggtgggctaaagctaagggaggtgaagtgaatttgagaagcaagtcggtggcttggccagctccggcgagcctggtttccagaacatctcacttgccactctgtcttctcctaactgggggcttctcctcttcagagtcgtttattctgttagctgagtagtcttcaagattttgccacagctactctaggaagatgtcaagcgtattctggggatggagacacaagaaggtgaggcaattgctccaggccacagaggcaaacacagcaagggcagaggtcacaccagctcaccaaggtcatgcctgaccttcaggatggtcaggttagtgtgaatgggggttttgttgtatttgaggaaagagaacacccaaggctttcctatgaagtatttttatgcttaatacaatttccaaggagtaaaggtgactgaggtattttagagcatgaaggaacaccaacatcaaaccttttccttggcagaaaaagaaatagaatgcggaagatgcctcctaactggtctctatctccagtctgcttcgtcctgctgccagcatttcctggctaaagaggtgtctgacttgaatgcattgaggcaaatccagcccactgcctgtgtatgtctcaatcctggtaaagttaaatgcacttgaaactccttcctgagatgtgtgataagaggcaaagcatgataaagccccagagcaaggctggagtgagtgtcaggccagccaagcagttggcagcaagtaagggtgttgaggaccaagcatggcaagaagtgtgctgcagcggggaagggaggacgtggaccagcaaaccctgggcaccaggtgggctctgtaacctcgatgtttctcttaacttctctcctttgctgaaccttttgaatacctaaggagggaaaattaattctaaagaaaaagtgtctgaagggggagaaattgaaatggaaagtcatcatgtagctatccggcactgtctgtctcaatcatatgtctctgcgtggactctataccttttgggtcagagaagaagtgactgaaatagcagattggctcccttatggatatgtccaagacctggcaggctagcggtggctcctatacctacagcatggtgtctcatcacacatgtctcagacacggtcactcccctcagcttcagaaggggttctcatgagtcatttcagacagtaggtgaagagaaaaatgtgaaggacagtgcttagtgctggcaaggatgccgggaaatgggttctctactacgttactggtaggcgtatgtgtgtaaaccttttatgagctacttgatggcatgtatcaacattattgttaaaagacaccctttaacacaatatttccaataatgaggctatgccaaggaaataattaaaaatattttaaaatgttttagttatataggctctcatcacaagactattcccattagtgaaaactgaaaataacttaaaggtacaacagtaacttatagttatgtatatccacaagaataactatcttgcagatgttttaaagtgtgtttattaataccaggtaacagcatgggtttcaaagcaggacagaaatgacaggaatgctataattttaactatgtataaaaatatatacagaaaaataactagtaaggaactctgccagcattgcagctgacatactgtagaatgatgaatgctttaagctactatatttagtagtatgttgtggttctgttacttctacaatgaaaaacacttaataaagggaaaaactaaaatgaaaattttgaatctagatctcccaaggttttagaaatatgatagggttgtcatagctaagcattacaagaggaagtaagcagcaaggggtgaagaaatgaaatgtgctgtgtgctgtggttgacaatgtgaggagaaaataagttaataccacttcactgatggatgcctcttggtgcttctcatcatccactcagcaaacttgccaacaacataggaaagtcctgggggaaaaaagcctccctcaaggtatcattcttgatcttttcttttacccacatgaaggtgtgagagtgtggtacacagggaggccagagaaggttctcagctattgtgaggattgacttggttgctgtcattttctaccaaaagatctagcgtaactggcaccactgttcaaagtagtatttcagctttgcaatgaactaagttatggttctggaagaaaactggcttctgctgagtacgttctccatgtgctgcctgttttagaggcacagaacacttggagttcagtgtggcattattcccacttcacgagtgagggaacctaagctatgttaggtgcccaaggggatgccaagtcagaagcagagctgccatggacctagacctgtccaacctcagaatctttggcttttctctttgccaggccagccctgcacatccacgactgggatctcctgaatgcctcagacagtggtgctctgccccatctcatttcagttgctctctcctccagcttgcaccaggcaagccaagctttccccaaagggacacggcccctgcacctagcatggtgctgagtaaggtgttgatttattgaatgcaccaatccatacttgccaccattatttcgtttctcctatgaggatctggaaaaacactgaatgtaataggatgggagtgcaacttcattcattcacagccagtcagaggtctgcaggtttagccaagaaagctcatagagcaagttatgcaagctcagttcagagagaaaacattgctttgggcctaagaagctatctgcctattgatgccttaataataaaacctgcccatttctgtggtccagctctgtcccctacccaacaccaagtgctcatctactttcttacaaactcatgctctgagattccttgcctttgaagcccagacccaaaacatttccattaaataacttcacatttgggatctggcagtgggctctgaaatgccagtgatagtgagtgtgtggcggcattagctgcttaggccacagtggtagacaagagagatctgggggcaagagtaggatggacatggacaggcccttcctgactcactgtgcctgtacttgtgagtgtgtgtgcagaggacagagaaatgtgtggaatggcaaggaatcaaaagcccttcaatcaacacaatcacacgccgagaaagtaaggaaaggagttttatgggcttggctgaaagagctgctgcagccacaggggagcccttggtttcctgtggaggtagcccactgccctcttccctccctctctctttcccttctgcctcagggtcaggttccaagtcacctccagtcttcccaggagtccttggccatggaattgggtgagatcagattgggaaagatggtctttctcggtgtcgtcgtggccatgttcttgattctattcaggttgtcccgggcgttttggcattttctcaggcaagccgcacacagatccttctcctccacaacatacaagttctccagcctcctgatggagtctatgaatatttccgactcacctggctttggaaaggggttccgctttatgttgagctttttcagcttggggagcttggagatgctcacggggatgttgttcagtaggttgtcatggagccctacctcgtggagctccttcagggcccccagtgtggtgggcacgctgtccaggtggttcaagcctaggttcacagcgcggatgttcttgagttgcttcagctccacgggcagcccgttgctggtcagccggttgttgctgacgttgaggtagagcaggctggtcatctggccaatggactcaggcagcttgtctatgtagttgctgtgcaggtccagccaccggaggttctggaacttggagatggagtcagggatcttcctgataagattccggctaaggtccagctcgtccatgtcactaaggcgcagaatacacttggggaaggtggtaattcccatcttgctcaagtcaaggcgctttttcccatcaaaagtgattttgatgcaattcctggccaccttgagggtgatcttcttgcccttggggcctttctcacccttaaccatgttcttttagtaagggagtgttagaagtttattgttctgattggatagtgatcagtgtgaggaaaaatcatgaaaaactgctgaaagataagaaaacatctggttaggagatgccagagggcactgggctcccccacgtcatgacgctttgctcttcagtggtttaaaaagcaagaaagaggattgcggagagaagtcagggcaaagtggacccagcccagccatagattgtcagcaaactgtgtgacttcttcagactttgattttcttggatgttaaaataggaggtgcagggtcagcctgaaggacactaaatgtccctctagctgtgccatgccccgacttataaatactctccactgtcccagactgtcacgtacccccaacccagagccatgtgtgtgtgttcttggatatctgccccttcctagacccctgcattaagctaggatttcctgaagttttcatacaagttcctggggagggactgctgagttttccagccaacataagcctggatcttagagaataaggtgggtactaagaccaacttctcacatccctcttcccctcatggacccagaggaactagtgaggccttggctacagtccaacagtagccatgcagaaaagcctgttgctcagcccagggatatcagggtgtgccattgctgggcccagcagcaccataactccccatcatgagcacacagggggatggggggtgcgggcaaagctcatggagaatgctgccttttccatctcctgcccattctctcatccttcacactggacttcaactcctctgcacagaaacttgataaatggccgtgactgcctcagtgcagggaagcagaatgtcaatgtgatgtgatggggattctggcttctgcatgcttggcttagaagtccagctctactctactcacaatcttcttaaattcccagtgcttgtgttttcttatttgtgaaaacagacacccttacagagctatgagggggcgtaaattatctaatactataaagcacttataacagtgcctggtacatagtaatagcttgattaatgttagttattaaaaattgctacacatattgtttctaatcctcaataacaaggtccacagcattaccctatcatagcgagactgaggctcagaagtgaggaaggtctgcagccaggaagaggacgcaactctgttctgtttggttctgggacccccttttctttttaaaggcctcctgtgcctcctgcttgctgatttttttttttggaccaagatttccaaaccaggcagaagtatgcccttgggagacacaaacttgcattgcctctgttccctgcagggatgggcagggagaggtgctctacagtttctgtacttcatcacctgtaccttttattagaacccaagttgatatagcacatgaatattgagcaatcaggctgtgtgggaatatagttgtatgttttcctcacccagtgtcaaagggaaatgtgtacaagcctgtctcacacctactgaaaatcccactgtcaccactcatagctgaagggtcagagggtcctaccctgcgaaaggcctgatggatcacagccgcctgggatagatggtggtctccacagtaaaccaatgacagttcttagctcttggcagcattgatgttcatttacacaggccttgtaagctgaccctagtctttaaaaatagtggactccccattttcgggcataattggctggtttccagagccagcaccatgttcaccaatactgaactgtctatatcattcagctctgagaaaccagataggataaaacagcttaaaaaacaaagtggagtccaagtccagttaagattttgtatgctcacttggtcccaccaaactcctgaaagcaagtaaagccttgggcagaatgcacagagaagcactctggggactctgagataagtgatatcaggcagattggagaagaaatccataactcaaagtaaagaccaatctggccacaagtttcctgaactcctttttctcccctcaaccgtttctcttggcttggactcaagggcagcccagaacacaaaactttgcaccagatgaggacagaaagatttctgatttccaacaagagcctctctttctggtccaaggaacaggaaatggatttttaagggtcagagacagtaagggaaatctgtttggtgttctgttttttgtttgtttgtttgtttgcttgcttgcttctctcctgtctcatcccaggccaccctgtatccctggagtcatccaggcaggcatctagaagctggaagaagagaaccattgtctttgaccaaactgtggtcctcagagctggggggttgctttgttttctctaccctactgccacttggctctagaggcagaaacagttgcaagaagtgtgcaacagatttagaaaacaaaatccagccagaagaccaaaaagtcgggggagaagagatgctcctgggagccacagagttcagagagattgcaacagggaagaaattcaggaaaagtgattctgaaagttgtatagcaactctgaactctcctgagctgcctctgtttaaaggcagaggtgatttcttcattgtgtgatcaaagagtatacttacacaaacctaaatggaataacctactacagacccctaggtgctttttaaaagtaaaaagtcctgctttaaaaatatgtgtgtgtgtgtgtgtgtgtgtgtgtgtgtgtgtgtgtacaaccatgtgctgcataatgatgttttggtcaatgacagattgcatatatgacagttgtcccataagattgtgatactataattttactttacctcttccaggtttagatacacaaatacttacccttgtgttacaattgcctatagtgtttagtacagtaacatgctgtacaggtctgtagcctggaagcaatagactagatcatgtagtctacctaggtctatagtaggctataccatctaggtttgtgtaagtgcactctttgatgttcacataatgatgaaattgcctaaggatgtatttctcagaaagtattcacatcatgaagtgacatgtgcctctatctctatctctgctgatacctatacttacacctgtatctcagaaagtgtggaaaaacagttgtggtgcagaaaaacatttgaaggaaaaatggctgaaaacttccaacagtgatgaaaaagataaaaattacaaacacaggaaggaagctcagcgaactccaaacaagataaataaagaaattcacactcagacacataatcaaactgctccaaattaaagaaaaaacatgaaagctgccggagaacaatgacgtatcacccacaggggaacagcaataggaatgactgcaggtttctcatcagaaaccacaggggccagaggtgctggaaacatcatttttaaagtgctgaaagaaaagaactatcaacccagactgtgacagtatcctttataaatgaaggcaaaataaagacattatcagatgagtgaaaaataagtttttgccactaactaagctgctgtaaaagaaatgtccaaggaagttcttcaggtgaaagggaaactatactagagaggaactccaaactttggggataaaggaagtgcaatggaaatgctaaatatctgagtaaatgtggagtatttttctcttctaaatacccttaaaatatgtatgtgatcgaaagaaaactaacactgtgtgatggagttgtcaaagtatgtagatgtcatacataagacaactactacataacggggaagtgagcaagacctatatggtggtaagggttttacactgcttttgaagtggtgaaaggttaattttaagcagacagtaaagtatgtgtattttaatcctcagagcaatcactaaggcaatatataaaaagatatagtaaatagtaaaaaactaaatatataaatgagaataaaacagtttaaaaattcaaataatacaaagaaggcaggaaaagggaacagaaggagcaaacagacaacaactattaaaatgatagactgaaactcaaacatagcaatacttacattaagtgaaagtgacctacatgctccaattaaaagacacaattatcaggatagattacaaaagaaaaagacccaattgtatgttgtctataaagaaagtatactttaaataagcaacagtgagttgaactaaaagaatgtaaaaagacataccatgcaaacactaaaggaaggatgtagtgactttattaatgtcagataaagcatatttcagaacaagaaaatttacaggaagtaagaccattacttattaataaaatgatcatttaaccaataggacaaaaaaatcctaaatgtgtatgtacctaacagcagagcttcaatttaaatgaagcaaaaacataaaattgaaaggaaaaatggataaatttaccattagaattggagacatcaatacttgtctctcagcagtcaatagaacaggtagagagaaaatcagcaaggaaaagggtttctcaaccttggctctgttgacattttagaccaggtaattatttgttgtcagcagggggtaggatggtgacagggcttgggggaagacctgccttgtacattgtagaatgtttagcagagtaaggccagaagattctacccactggttgccaatagctgcccactagttgtaacaatcaataatgtctcttgacattgccaaatgtccactgaggagcaaaattgcctggagatgagaactgctagtatagaataactcactattaccactgaccaactgaatctgacatgtataaagcactctacctagcaactgcagaatacaaactcttttcaagtacatatggaatatccactaacacagactatattttgggtcatgaaacaagccttaacgaatttaaaggagttgaaattgtacaaaaaagtacaagctggttctttgaaaagattaatgaaacagatagccagactgacaatttaaaaaaaaaagaaagagaagccaaattacacatatcaggagttaaagggaggatttactaaatcccacaggcattaaagggataataagagaacagtacaaacaactctaaaaaaaagaggaacttagataagatcaactaaaaactactaaatatttgcgaaggaatgaaaacccaaatagacctgtatttattgaagaaatggaattcacggttgaaaccctttcaaaaaagaaaacccaaagcccagtagtcttattgttaaattctatcaaacatttaaagaagactgtcttggtccactcaggctactataacaaagtaccatagactagttggcttgtaagcaacataaatttatctctcactgttccagaggctgggaagtccaaatcaagtcactggcagatttgccatctggtaagagcatgctacctggttcatagatgttttcttgccgtgtcctcacatggtagaaagagagcaaaacaattgtctggagccccttttggtaatggcataaattccatttatgaagtctccaccctcaagatctaatttcctcatgatctaaatgcctcactttctgatacactcacactggagatcagagtttcaatacagatttttgggggacacaaacattcaatcaattgcaaagacatactagcaatttgatatgatctctttcaaaaaaaaatagaatagagagtgattctcaacgtattttctgatgtcagcattaccctgatgctaaaatcacacaaagacatataagaaagagatcttcagaccaatattcttcatgaacatagttacaaaaatcctcaacatagtattagcaaattgaatccagtaacaagtaaaaagaatataaatgacagcccaaacttactcaatacttgggaatcagttaatgtaacataccatattaacagactaaaaagaaaaaaaaaagatcttataattgatgcagaaaagacatttgacaatgtaacatctgctagtgattaaaaactctcagcaaactggtaatagaaaggcccttccttatctggctaaaggacgtccacaaaaaagctagagcggacaaaaaaccaaataccacatgttctcactcataggtgggaattgaacaatgagaacacatggacacaggaaggggagcatcacacaccggggcctgttgtggggtggggggaagggggagggatagcattaggagatatacctaatgttaaatgacgaattaatgggtgcagcacaccaacatggcacatgtatacatatgtaactaacctgcacgttgtgcacatataccctaaaacttaaagtataatttaaaacaattgaaaaaaaagaaaaaaaaagctagagctagtatcatacttcgtgaaggacagaaggttcttctctgaagtttgggactaagacaagagagcacactttcactatgtctgttcagtattactttggaaattctaaccagtgcaataatgcaaaaaataaaggcatacagacagaaaagaatgaaataaaactgttcttatgcacagatgtcatgactgtccacatagagaatcccacagaattttaaaaagattcttggaactaataagtgagtttagcaaggccataggatacaaggttagcacacaaaacacccattgcatttccatattactagctattaacaattggaaactgaattatgaaaaataataatgctccaaataataaaatacttctatatttcacataaataaccaaaatatgcaggatttttataatgaaaattataaaatgctgatgtaagaaagcaaagaagatctaaataaatggagaaacataccatgttcgtgaattggatgacttaatgtcaactctccccaaattggtctaatcaaaattacaggaggattatttacatatatggatgaatagattttaaaacttatatgaaaggaaaagaaactaggaatggaaaataattttgaaaaagaataatagagttggaggattatgtgtcccaattttaaaatttaccatatagttacagcatgtggtattattggtgatgggacaggtagataggtcaatggaacagaaaatagagtccagaaatagatctacacaaacatggccaaatggtcaattgatttttgaaaaaaggtcaaaggatgttcaatggagagaaaatgaactctttaacaaacgatgttgaaattggttatttatatgcaaaaattaaaccttggcctaattaacacacattgactcaaaatggatcatagatttgaatgtaaaatgtaagactataaaactttgaaaagaaaatgaaggagaaaatcttcatgactttgaatcaggcaaaagcacaatttacaaaagatagtattaataagttgaacacaattaaaagctctgtggaaaaaaaaaacgttgagcatgaaaagacaagctacagactggaagaaaatagtgcaaatcatatatatcatagatatctggtatccaaaatctataaagatcttttcaactcaacagtaagaaagcaaacaatacaattttttttaatgtccagaatatttaaagatacatttcaagatagaaatgtacagacacaaaaatcgatagtgcaaagttttggcaaggagatgctgcaactagagttctcattccttgctgatgggaatgcaaaatggtatagtctcttggaagacacttcggaaatttcttataaaattaaccatatagttattatatcatctggcattttcccaactaagtatttaccctagaaaagtaaaattccatgttcatactgaaacctgttcacaggtatttatagctgctctattcataattgccccaaacagaaaaataataaatgtccttcaatgggtggattcctaatactgtacagtagtcccccttatctgctatttccatttccacatttttagttccccagattggaaatattaaatggaaaaccccagaaataagaaattcatacattttgaattgctcactgttctgagtagtatgaggaaatctcaggccatcctgctacatcccacccagaccttgaatcatccctttttccagtggattcactctgtaaatgctagctgcctgttcgtcacttagtagctgtcctagtagtgagtagtgatgctggtagttcagatatgccaaagagagagatgccttaaagtgcttcctttaagtgaaaaggtgaaagttcttgacttggggaaaaaaacaaatcatatgctgaggttgctaacatctacagcaagaatgaatcttctatctgtgaagttgagaacagtaaattgttgaaattgttctattttatgatgaattgttgttcatctcttacggtgcctaactcgtaaattaaactttatcataggcatgttttcctataggaaaaacatagtgtactatagtggtttcaggtattcaatgggggtcttagaacatatcacctgtgggtaagcgaggactgtggtaatggaatactactaaacacaaagtctacggatacatgcgacaacttggatgaaccctaaagcattttgcctaataaaaaaatgtctcaaacgtctacatgaatggaatgattccatttatgtcaccttctgaaaaagccataactttaggtgcagaacaaatctatggttgcagggattaggggttggggaaaggcttgactagaagggagagtcacaagtgagttttctgggttggtgtcactgcctgcaccctgacagtgatggtggttacatgaatctgtacatctgttgaagcttagagaactgtgcccaaaaaggcaattttactgcagaaacatttttaaaaaatcgtttttaaaaaaactttacaaaatagttgggactccatattctacttctgttcctctcactgtgtctgctggcttgtcccacgttggaagtctgtgattttgttaagcccccacacaaccagttctgcccctgaaagggcatccaaataggtagcatctgggcaccactgtggtccaatgtgtatgtctccctggtgtatgcactggggggatgttgtgtaccacagggaacagatgttcgcaagctggcatgtcagaaaaactgtctactgtgcttgagttgaaatcttcattaaaaagagatgaattgagatcaaggaagtctatgcactcatctgatgtttatcaatggcttctccccatggtagatttgccagatttagcaaataaaattgcaaaatccccagtaaaatttgagcttcaggtaaacaacaaatagtttttagtatatatatatatatatgtcccaaataccgcatagtcctgtattttatttggcaaccctatcccatgggcctaaacaatcagtaaattttcatttatctatggtcattattagtgcttactcatgcattcgttcatttgttcattcactgtatgagcatattgagtgcctaccatttatcaaccctctgagcaacacagataaacagtaatcaggcccagtcctcaagttgaaatagttcaaatctagattctcactgattctggccaccagattcccctgaacaccaaaaacctgggctgccttttggttttcttctactatctaagataaaattcagctcagggaggccaaacacactgagcatggcttagagagaatcctggacaggaaggggtgcttccagcaaatgggacatccagccagttgggcccagctgtgccggttgcccacagcccacccacactgtgagaagaagccctcccagctctgatgaatggtgatgaggaagcagcacggagctggctacagagaactcctccgttaaggagcctctctccaaagggccctttggctccaagcctgcccattaatcacctcaaggtaaagtgagggctggctaggataatgtacttcacctccccagggagtctgggtccctaggcagccccggggccagatggggcacagtgaacttccaccctttctgcgcttctccctggggtcacccgaccttggca

SEQ ID NO: 1283 - DNA, 61358 bp, Homo sapiens
tataataagtaatggttgcacctagcaattcatttacaaatcttacttgattttgaagccatagaacacctcaactgttagcttgaatgactggagtttagtttttatttctcagaacaaaacagtttgaagcctaattaacatcctcggaaggaacttaacactaaaactcctaacagcttcagttttctgaccttgaagaaagggaaaatgaagagaccatggtgccacttccgaagcaaagcctgaagttctgtgctttagaggtggtgttgccatcctatgattgcaggagtctggccttggcttggtggaggagcctgtggataaggcgaaggaaggtctgttttcattgggggtagaggagggtaaggagttgaaatgggaaggatctcttttttcttgctgtctaaaacttgtcttttcagacacatatcaagcctttccctctctgagctactgaagtcctgggcagaggttttctgtcttacaatacagacttttaccttaggcaatacctgacagagcctttaaataagtaaataaattgctttaataaattgatttaatacattgatttattaattaataaattgatttaatacattgatttattaattaataaatttatttaataaattgatttattaattaactaattttgagagagagtcttgctctgtcaccaggctggagtgcagtggcgtgatctcggctcactgcaacctccgcctcccgggttcaaggcattctcctgcctcagcctcctgagtagctgggattacaggcgcccaccaccacacccagctaatttttgtatttttagtagagatggggtttcaccatgttggccaggatggtctcgatctcctgacctcgtgatctgcctgccttggcctcccaaagtgctgggattacaagtgtgagccaccccacccggccagaacctttaaatttaaaattgtacagtgtacttcctgccaagaagcgtaggaggaagaaggaagtaatgtttttccagttttcggttaagaacttgctttgtattaaaatagtccttcaagtctacagccataccaccctgaacgcacccaatctcgtctaaaatagtccttcaaatatgtatctcttatagccttcagttatcccaacaaaattatctaaagatttgtttatctatttattattattttttagagacagggtcttgctctgttgcccaggctagagtgcagtagcatgctcatagctcattgcaacctcaaactgctgggctcaagggatcctcccaccttagcctcctgactagccaggactacaggcgtgtgccaccacatgtggctaattattttttctggagatggggtcttgctgtgttgtcctgcctggtctcaaactcctggcctcaagtgatcctcttcccccaggatcccaaggtgctggagttataggcatgagccacccaccatgccaagtcatcatgtaaagatttacagaaagttttgtgtaaacattgtcttttttttttttttgaagcagagtcttgccctgtcgcgcaggctggagtgcagtggtgtgatctcggctcactgcaacctccacctcccaggttcaagtgattctcctgcctgacactcctgggtagctgggattacaggcatgcaccaccatgcctggctaatctttgtatttttagtagagatggggtttcattgtgttggtcaggccggtctcaaactcctgacctcgtgatccatctgccttggcctctgaaagtgctaggattacaggcatgagcaaccgcgcccggcccattcagccttttttttactcgtagaagggcttcagtggaacaagagtctactagagatactagaaagggtactcaattgataactgacgttgagatttttttctagtattcatggccctcaggcttagggtttgaagtcagaggcagggctgtaggctaatggaggggagtaggctttcatggatgatgcccagggaggagccagattatctgtaccaaaccttttttgtttttttgagacagagtcttgctctgtcgcccaggctggagtgcaccggtgtgatctcggctcactgcaacctccacctcccaggttcaagcagttcacctccctcctgcccaccaccacactcagccaatttttaatttttaaaaaattttttagtagagacagggtttcatcatgttgctcaggctggtctcaaactcctgacctcaagtgatctgcccatcttggcctctcaaagtactgggattacagatatgagccactgtgcctggcctctttttgaaaatagtcttactctgtcacccaggctggagtgcagtggaatgatctcggctcactgcaacctccgcctcctggttcaagctattcttgtgcctcagactcccaggtagctgggattacaggtgtgtgccaccacactcggctaatttttgtatttttaggagagatggggtttcaccacgttggctaggctgttcttgaactcctggcctcaacccgccttggcatcctaaagtgctgggattacaggcatgggccaccgtgtccagccaacaaagctttttttcagtgagtgattccagcccttgatgcataggagggtggggtccataggagtgtagccttaactgatgaattaaatctctgggtgatgtgagatatgtgccaggttcttggcttatgtctccctctagtactttaggaacttcccaactagatggaggcagtaaaaatgggccctgccaggatgtacctataacagagacgttcaaccatacccttgtgctgtctgcctttaatcacgaagattatgagctaagattcgtggatgcatttttattttttaaccaacatgtagcaatgatcactcagataggcatcttaaatccattagtttgggttggatttaagaccgttgtcattcctatgaaagggaagatagcccagattgctattgagaaggctttgtcagatgcattccagaaactgttgattgtggttctaggtaaaactttcttaatcgtcgttgaagtacttcagtttcagtgagcaaataaactcattttgaaaagttaattggataaaaatatcgatatctaaaacactccctaggatgctttcatttgctaagttctttcacagcgacaggctcaaatttgttctttgtgacatttgtagaaaaaatgacagcaaatattgtccctagtttatagctataaaaggacttgcctcaggtcacacagaaaatgtttgaggcaggtcttctttaattgcatgcctatcgtacagaatagtgattataagccctggacacatggatttgagtcctaactctgtctcttagatttttgtatgcagttttaggtcttatggccagagagatttgaagatatttaatatctctaagctgcaatctttatctgcaaactggggttagtaatccaatcaaccttattgctgatattgtaagaaaaaatgagatgacaagtgtaaaaactcagaactatacttacaaggtaagcagacaaaatatgctattgttgtgattgttttctctctgaataaataaactctgctgaagaatttattagattatgtttctcgaatcgagaattcagttccagctctcatttctggcactgacatattggccaaatatgattcttatacaataatcagctgctttgctgtgagccttggaagtggtcatgctgttgaatggcactgcttgtatttcctattcagttctacagtggcacaaatgtcatagcctgtgcccaaaggaaacctggtgtttaacgagtccctgaacagagttgcctttctgcttcacaaccctgaaggcttagagactgagattgtaattaagttactacagacctttatttgcttgtaagaggtggccctgattgctctcagctttccaacctgggcagcccttctagtgaaagtcttacttccttggtcatcaactgtcaagtctgagtaatgacatttaataaccaagctaaatgtgtgggttgtctacccctccctagtatgcaaaggtatcccttgcacacactcacttcttagaccaaaagccttatagttctagtttgccttgaaggaaattgtattgtctatagagtatgtgggccattttctgcccgtaaaatgttcaaatgttttctctctctaaagctttgttcattgtatctggtggaattttggttctcagggagtagacacctagccatgcttctaatgtgaagtgtctactagcccagtggtctctattttggatttgaacttacttcgaccccccacctggtgccttaccttttaatcatgttatgattgaacatttttatttccacattttttatttcttacgttattattccttagttcctatctgtaagatcataaagtcctttgaaccaaacacagttgatatttcatacatatgttaaaaactgagctgtgagaccagacatgatgactcacgcttgaaatctcagcatttcgggaggccaagacagaaggatcacttcaagccaggagttcgagaccagcctggaaaacaaagcgggaccatgtctctaaaaaagagaattagacgggcacagtgatatagtgcctgctactctggaggctgaagcaggaggatgacttgagcccaggaattccaggctacagtgagctatgatagtgccactgtactccagcctgggtgacagagtgagaccctgtctaaaagaaaaaagaaaaacaaaaatcgaagtgtatgatgaagagatgaggaaactttcaggaaaatgcttatttcctgcttttagaaactaaaagaatgtctcattgtgggttgctaccattatatgcaggaagttttggaatgaaaaagattctgaattcatccttgctaactttatttcagaaagtggtaaaatagctatggagtacagacccagtgaagagattgtagatgtcagatgggaagaagaactacacggtttaatataagtatgtggagataaaaactcaaaggtaacagggccgggcacagtggctcacacctgtaatgccagtgctttgggaggctgaggcgggtggatcacctgaggtcaggagttcaagatcagactgaccaacatggagaaatggtggcacatgcctgtaatcccagctactcgggaggctgaggcaggagaatcgcttggacccgggaagcggaggttccggtaagccaagatcacaccattgcactccagcctgggcaacaagagtgaaactctatctcaaaaaacaaacaggccaggcgctgtggctcacacctgtaatcccagcactttgggaggccgaggtgggtggatcatgaggtcaggagttcaagaccagcctggccaatatggtgaaaccctgtctctactaaaaatacaaaaattggctgggtgtggtggtgggcacctgtaatcccagctacttgggaaactgaggcatgaaaaccactagaacccaggaggcggaggttgcagtgagccgagatcatgccactgcattccagcctgggtgacagagcaagacactctctcgaggaaaaaaaaaaaaagaaaagaaaaacaactcaagggtttgataacattgccagtataaccataattcaaaacaagcagcagaatttggaggataatttgtttaattctcaggaaaatgtgaaactctgaaactgctttttgagtgcagggtatttccggggcttttcctaaagtcttaacccttggctctgaccccttatttgaagtttggagagcagaaccgaggattgtattactacagttgtggacacaggagaggggttagtctccccccgctccaggagtaagggatgctgggctgctcgaacacaggccttgttagaactcccttcaaacaggatcccagagatgtggggagaaggtaactggccttaagaatgattgcgctacagcttttgaaaactataatgcctttcaaatatggcttattgcttggatctcaatatctcccacgtatcttgggtggaatattttgctgaagatctttctgtcaatcatttacaatcatgtgctgcaaaatgaagtttgcgtcaacagtagaccacatatatgatggtggttccgtaagcgtataatggagctatccctatataggtataccatttttatctttttttttttttttttttttttttttttttgagatggagtctcactctgttgtccaggctggagtgcggtggtatgatcccagctcattgcaacctccacctcccaggttcaagtgattctcctacctcagcctcctgagtagctgggattatagacacgcgtcaccacactcagctaatttttgtatttttagtagagatggggtttcatcatgttggccaggctggtcttgaactcctgagctcaagtgatccacccaccttggcgtcccaaagtgctgggattacaggcatgagccactgtgcccaggccccatttttatcttttacacagtattttaactatatattttccatgtttacatacacaaatacctgccattctgtgacagttgcctttagtattcagtacagtaacatacagtacaggtttgtagcctaggagtcctaagccataccgtgtaccctaggtatggtggctacaccacctaggtttgtgtaagtatacgctatgatattagcacaatggtgaaatcacctagtgacccatttctcaagctcctcacgtggcaagcaatgcatgactgcatatgaaagctcttaaatagggattgtttctaaattaatctcaaaacagtcattatttactatttatggaattttttttaaaaaaaggagcaaaagtatcatttcagtgggaacttaacttggggctacagtgttttatttaacttttaccccaaagttgcaaagtgttttgaaatttttccctgtaaaataattattttaattcaatttaaataaaacccaccaaggagacttcaagctttaagaagtctagcttcctgtgaaatgtgagaggaagtcagcactcatttcagaaatctgattataacaatagctccatccctaaatgaggtgaatcttggaatctcttccattttattttattttatttttttgagatggagtttctctcttgttgcccaggctgaagtgcaatgttgtgatctcggctcactgcaacctctgcctcccaggttcaagcgattctcctgctttggcctcctgagtagctgggattgcaggtatgcaccatcacacctggctaattttgtatttttagtagagacggagtttcaccatgttggttaggctggtctcgaacttctgacctcagtgatccccccacctcggcctcccaaagttctgggattatgggtgtgagccaccacacccggccccccttcaattttaaagccatcactatgcaccctatgtctatgccaggcactaaaataagatgaagcaccttcttggagtttacatgctggtaattatgccagacagtaataaaataggtaagaacggctgtgggggaagtcagctgggttctagttacagtcgcatttcaggaaatgatttaacatgctgactttaacaacctaagcctcttctccatgtgtgcacacagggtagatctctgaacacaggtgaccctagaagtgctgtaacttctaggggaatggctgtgttgagtcaaggcaggatgacagttcagcctcctcccaggctagtgcaaagggctcttcactcggattaaaaccttctctcccagaccgaattgccaactcccaacacccctcctacagaaaatgtggagtcctcgcttattccctggcagcccctacctaatagggtggtgaattaattatcaaacatgcgacagtttagcgaaaatggcaacactttggaataagtgactgtaatgtgcatcctggcgcccattttgcaggtcagttgctctccctggaaggaagagtgttctcggatttcaccttaaaggaggaaggctgccagaactgaactagcacttctgaatatcctgaggcgaggtccggtgacttccttgggaagctctgccgcgcccccaccccaccctaccccaccctaccccaccacagcaggcgctggagtcctgggaccaccagggtctgaggcccaaatccttcctcactaaggggaggagaggggtgttccggcagggcaggatgggaaggcgtgcttgggcgggattgtgacataagagtgccctggtgacatggagcagatctgtgacataaataaaggtgtcataaagacagggcggggctcacgcttagaaggggcacgagcgtctcggagctgccagaatgtcttctgctcagtgcccggcactagtgtgtgtcatgtcccggctgcgtttctggggcccatggcccctccttatgtggcaactattgtggctactagttaaggaggctcagcctctggagtgggtcaaggacccgctccagctcacctctaatcccctggggccgcctgactcctggtcttcccactcctcccatttcccacgggaatctccccatgcgcctactctcccagcagacccgtgggactttgatcacctggggccctctgcttcctcagagatgccagccccaccccaggaatcgactgaaaatttggttccattcctggacacctgggattcagctggagagcagcccctggagccagagcagttcttggcttcacagcaggatttaaaggacaagctgagtccacaggaaagactccctgtttcgcccaagaagctgaagaaagatccagctcagcgttggagccttgctgagattattggaattacacgccaattatccacacctcagagtcagaaacagactttgcagaatgaatattccagtacagatacaccgtatcccggtagcctgcctccagaactccgggtgaagtcagatgagcctccagggccctctgagcaagttggaccttctcaattccatctagagcccgaaactcaaaatccagagacccttgaagacatccagtcctcttcactccagcaagaagccccagcacagcttccacagctccttgaggaagaaccttcttcaatgcagcaggaggccccagctctgcctccagagtcctctatggagagtctaactctaccgaatcatgaggtgtcagttcaacctccaggtgaggatcaagcttattatcacttgcccaacattacagttaaacctgcagatgtggaggttaccataacttcagagcctaccaatgagacagaatcttcccaagcccagcaggagaccccaattcagtttccagaggaggtggaaccttctgcaacccaacaggaggccccaattgagcctccagttcctcctatggagcatgaactttccatcagtgagcagcagcagccagttcagccttctgagtctcctagggaggtcgaatcttctccgacccagcaggagaccccaggtcagcctccagaacatcatgaagtcacagtttcacctccaggtcaccatcaaactcatcatttagcttcacccagtgtctctgtgaagcctccagacgtgcagctcaccatagcagcagagcctagtgcagaggtgggaacttctctagtccaccaggaggctacaactcggctctcagggtcaggtaatgatgtagaacctcccgccatccagcacgggggcccacctctgcttccagagtcatcagaagaagctggacctttagcagttcaacaggagacttcatttcaatctccggaacctattaataatgagaacccctctccaacccagcaggaggctgcagctgagcatccacagaccgctgaggagggtgagtcttccctaacccatcaggaggccccagctcagactccagagttccctaatgtagttgtagctcaacctccagagcattcacacctgactcaagccacagttcaacctttggatctggggtttaccatcactccagaatccaagacagaggttgaactttctccaaccatgaaggagaccccaactcagcctcctaagaaagttgtaccccaacttcgagtatatcaaggggtaacaaatccaacaccaggtcaggatcaagctcagcatccagtgtcacccagcgttacagttcaacttttggacctgggacttaccatcactccagaacctactacggaggttggacattctacacccccgaagaggactatagtttctccaaagcatcctgaggtgacacttccacatccagaccaggttcagactcagcattcacacctgactcgagccacagttcaacctttggacctggggtttaccatcactccaaaatccatgacagaggttgaaccttctacagccctgatgactacagctcctcctccaggacaccctgaggtgacacttccaccttcagacaagggtcaggctcagcattcacacctgactcaagccaccgttcaacctctggacctggagcttaccataactacaaaacctactacagaggttaaaccatctccaaccacggaggagacctcaactcagcctccagacctgggacttgccatcattccagaacccactacagagactagacattctacagccctggagaagactacagctcctcgtccagaccgggttcagactctgcatcgaagcctgactgaagtcacaggtccacctactgaactagaacctgctcaggattcactggtgcagtctgaaagttacacccaaaataaggctttaactgcaccagaggaacacaaggcctccacaagcaccaacatatgtgagctctgtacctgcggagatgagatgttgtcatgtattgatctcaacccagagcagaggctccgccaagtgcctgtgccagagcccaacacccacaatggcaccttcaccatcttgtaagaatcacttttcctcaattgtcctctgtgtcctgcctgacatggcagccttttcctggaggccttcctgggccttctttatctccccaagccatatggacaactgactttctgctttcacctttgcttgtcaactctcccttctcctcattctcttttaatgttaggccccttctccagtcttttccttttactctggtcttttactcgtttttgtatccatttttatttagccccatcacatcattgcttaaccgctgctctcctcccattttcgcttcaccctctttacagcagcctgtccctctcccgatctcagtgatgatgctctaagtggttaagagttgattccggagccaggctgcctgggtttgaacccagatctatttattagcttggtgacccagagcaagttattctgcctgtgactcaatttcctcacctttaaactggggatcatgctagttagcatttcataggattgttgtgaaatttaggtgagtgaatatatgaaacacttcatcagtgcttagcatatgtaggagagttggctgttcacatgattattcagtcctttagttttgtccagaactcatttttgtccctagctttctatatgtagaactagttttatgtcaaacccagggccaagtatgctactgtctccagaacacgaaaatgataggagggaagaggctgggtgtggtggctcacgcctgtaatcccagcactttgggaggccgaggcgggcggatcatgaggtcaggagatcaagaccatcctggctaacatggtgaaaccccatctctactaaaaatacagaaaaaaattagccaggcatggtggtgggtgcctggagtcccagctactcgggaggctgaggcaggagaatggcatgaacctgggaggcagagcttgcagtgagccgagattgcaccactgcactccagcctgggcgacagagcaagactccatctcaaaaaaaaaaatgataggagggaagaaagagaataggcataaaaagggaggtatatataattaagtactaaaagataatgcagaccattggtgctagaatttgccagaatctgtgatccttgaggtgtggagatgctacatgggtaagctaaaactttacttgggtcttaaagagtagccataatttgttaaataggagaaaaatgggagtacagtctaggcaaacgcatggctacaggtatggttggaatttagtagaccaatgtggctacaaagaattaggtgagggagcaatgaagatacgattctgtaaaaccttgattatcagctacaggagtttgaaagttacacaatgaggtatggaaagccattgaaagtttccaagcaagagagattacatgatcaaaacaggaagattattttattttgttttttgcattatgtgcaagtgtagacatgcagaggattgttttagaatccatatgtaaagtgtccaaaaggaaaagcttaattcagggagacaaaatagaaaggtctagcaaaatctaggagtgaggtgtgaaggggccaaatcagatcagttgtaataggagtggaaagaaaaagcctaggatgtttcaacagagggcactgggccaaagctttggtgttacctggcatagggtttctttcttctcatttgttgataatgataagcttttgcccatatttctgtggaattatttaccattttggtactgatttgtagaagtctgtttagacacataagtgcttttagataaaatacttacattcaaagtaattaactggcatcatctgtccaagagatgggatggataagaagttaagcttccaggagatgcctcatcatttgtgccggtgaccccgcataatttcttgatgaattgtgcaaactgggaagctgatagctctggaaatgagaaagcaggtgttattttctgtttctgaatatccccaacaagattgcaatgattcttttacttatcgtgttcattgttttcctacctattcaaggatataaactgtgtttcttcacagaaatttccaaggaaactatatttcttacattgatggaaatgtatggaaagcatacagttggaccgagaaactgtgagtatattctctccaaatatgacaaaaagctaactgcattgtaagatccttcttggtccagaattttgaggtcggtacctctgaggaaagatatttctcctccacgccccaaatcaaccactgttgattgcaattgtatggttattttaaaattaaatttggtaggctctctttaaaataagaggcaatttaaatttattttttatcatacaaatagtacatggttatattcctttttgttctctttttttttttttttttttttttttcagagacagggtcttactttgtcctctgggctgcagtgcagtggcacaatcacagctcactgcagccttcacctcccaggcccaagtgatcctctcacctcagcctccccagtagctgggaccacaggtgcatgccaccacacccacctaattttgtattttttgtagagacagggtcttcctatgctgcttaggctggtcttgaactcctgggctcaagtgatcctcccaccttggcctcttaaagtgttcatattacaggcatgagccaccacccgcagcccatgattccatttttaatatataaaaatgcaataacagatataacaaaaactctccttgtgccctactccctcatccctgaagtaatgctactctgcatttagtatacatgcttccagacttttcctcatttacctacatacatatttacataaagcaaaatagatttgttttgtggttttaaaattttttcttcgcataaagggtaacatcttgcaacttgattctttcacttcatgatatgccttagatttctttccttcccagtactgagagggtcaccccattcatttaaactcctgcataatccatagtatggatgcatcatggtttatttaataattcccccattgatgaatgtttagattatgcttagttttcttgttacatgcattgctgcaatgaaatccctgtacatgcttctttgtgaacatgtgcaagtattcctgtagcatagatatctggaaatggaattcttggggtgaagactatgtagatataaaattttaattgccttcaaaaattttgtgccaacttactctattgtcagcagaatatgacagcattcatttcccaacaccttttcaccgctgggtattctccaactttttgctgaagttatggatgaataaaagggattccatctaaatgtgaatttttctgattactcatgaatttaatttagtatctttatatgtttattgaacatttgtgtttcttctctgagttttctggcctttgttcattttcctgttgaattgttttatcattttcttactgatttatagaaggaattggtttagacacataagtgattttggaaaaaatgcttacattcaaagtaactgacatttttcacaacagtttgtgtgtcacatcattattccaatgtatatagacaagccacgatgagttctaaattaaaaataaacatatgctaggcgcggtggctcacgcctttaatcccagcaccttgggaggtaggcggatcacctgaggtcaggagtttgagaccagcctggccgatagggcgaaaccccatctctactaaaaatacaaaaagtagccaggcgtggtggtgggtgcctgtaatcccatctacttgggaagctgaggcaggagaattgctttatttattttttcagatggaattttgttcttgttgcccaggctggagtgcaatggtgcgatcttggctcactgcaacctccacctcccgggttcaagggattctcctgcctcagcctcctgggtagctggaattacaggtgccctccatcacacccagctaatttttatatttttagtagagacagggtttcaccatgttggccaggctggtctcaaactcatgaccgtgggtgattcacccaccttggctttccagagtgctgggattacaggcatgagccaccacgccaggccagaactacattttaaaaacaagaaaattattacaaaggtcaggatagtggttacctattagggttagagagagggatatgattggaaaggggcacactggggcttctggcatgctagcaatgatcttttgtaacgatgtttacatgggtatctgcttcataattattaaactgaatattttggccaggtgaggtggctcatgtctgcagtcacagcactttgggaagcagacacaggaggatcacttgagccaggagtttgagaccagtctgggaacagagtgagaccctgtctcaaaaattaaattaaattaaatataaacaacatttatgttatgtgcactttatgcacattatagttctccagtttttttgatggggggaaaaaggttgaatggcttcacttgcagccctgacatggttccatgtggggctttcataataaggtttgggaaaagagaggaggaaatggaggttctgctgatcttggtgccacccagagttggattctaaaagggattttgtgatctagagaggaggcatgaaataacagaatttggtgggaagaaacccactcttcaaggggtgtgcttgagtgtgtgtgtgtgtgtttgtggtggtggtggagagagatggacacaaaaaggaaaatataagaaaaggtttgaatgaaagcagagcagatcccaccatcttgaagtgaccatgacccagctttcctccacatgcaggagatggttctgtgtagcaaatagttgtagtttgcattttaatctagaaataacttcttcattttccagaattctcagagaaaataacttgactgaattacacaaggattcatttgaaggcctgctatccctccagtatttgtaagttagttaattatatttatgagtttttagtcatattatctgtaaaatgaataaggggttcaaattagataatctctcagatttctttgagcaataaaattctgcaattctgtaagtttgtatagggtctcagcccatctctagcactagctacctcctgtgcattttcagtttttaagttgtatagacaaaatacagacaaaaacatttcacatggtaagaaaatctgagcagtgactgacacccatatgaaccttgttttataagggttcacatatcattctttttctattcagtctacaaccaatagatccaatctaatttatggtctatttttaaatagcccattaagttaagaatgggttttgcatttttaaagggactgtgaaagaaaaagaaaagaaacaaagaaatatgcgagagatcatatgtggcccataaaacctaaaatatttactgtctgaccttcaccaaaaaaaatttcaaaaagttggtttagtaggatgaaaggaactaaagttaacttcagatggttgcctaaaggagaagaaaatggagaccacctgcattcatttgaacatcattaatccagaattttttggtaatttaatcggaattaaattaacatttaaatattaaaaatagctgaattatatcaatattatcatcaagaatattaagctaccaagagaatagactggtattaaggatttcatttcaggaattgttatattaaaacagatgtttaaaatgatggttaactggtagagctagaaatgtttacactaagaagcacatcagaaatgcccctaactcttcactaattacaaaataacgatcgccccagccctgttaccaagaaagggatccctgtatttctgtctgtttagagacaagaagatactatgttcattgctatgaatgcttgattcttaccctttgtccatagaggtgtgtatgtcattaatccttattaagctcattagtgatgctcttttgcaaacagattctctcaaatatagaaggcttaaggaaagtgggtgtaaagaccctcaggtggatgccaaagtgctacagagaccatgaaataataaaactacgtttcctttaaaatagttattttccttctactcactcccccctattcatttattttacaaatatttgagtttgctttatttccatgtgtcagttttaaacatggtgggcaatgcagatgagcaagacctagtccatgctttcagggacctgtttatgctcagaagaaatgggatacaaaataactacattaagaagaagaaatggatgtgggcactaggagggataaattgtttctcgaacatagaagaggaaaaaatgccttcaatttggacccaggaggatgttactagaacaatgccatttgaataggactttaaagggccattgtgtaacaccagacagacatcttggggaaaatactctaaacttgcaaaaggaaaatgggagggcaaaacacaggaaagtattcaaggaatgccatgagtacccgtagagtacaagaagggagagtaggaaaatggagccagatcttctagagctttgaatgccaagctgaggagccaacatggggaaccgtgttaccacagcagcgctgtaaggtagatctgcatcacagtcattgagagggcacgttagaactcagttctggactccaccctcgtagttactgattcagttggtctagagtgggaccaagaatttgcatcttcagtaatttcccaggagatgctggtctttgcaagccacttctggagagtttatatgatgactgtgtgcaggatagtttaggtagggagagactagagatggagacatcagccagacaacgttacaccatccaggtaaagagggagggacaaactccatcactgtataactgaagaaatttttttttatgaaatattaaagcaatacaaaaccaaaaatgaatttctattaatatgatagaaattaattctattaatatgatttgaattagttcaaagttatgtattaggtaaaggggtagcttcctttcaaatgatgtgaaaggatgtcttttatttcttctgatattgaagtggcttaggaaaacagacctaaactaagaaggtgtagaaatgtgagacttgtttgtttgtttgtttgtttgtttgagacggaatctcgctctgtcgcccaggctggagtgcagtggtgcaatcttggctcactgcaaggtccgcctcctgggttcatgccattctcctgcctcagcctcctgagcagctaggactacaggcacgtgccactaggcccggctaattttttattttttttgtagagacagggtttcaccgtgttagccaggatggtctcgatatcctgacctcaggatctgccagcctcggcctccgaaagtgctggattacaggcctgagccaccgcacccggcccgactattttttttaatattagaaattgtgtatatagagataaaatctttgagctcataatctaagatttgatgacactacaaaagggcatctaatcaagtctactgctctcaggaaaaattaattccaaagtctattatgttgtatatttattaaaaccatgaaggtgagactctaggagaggtatgggcagggttaggggctctggaatgttcaaatacaagtccaaacgtttagagttgagatgaaaaacaggtattcagtattattctaaactcttgctgttattcataccaattgacatttaataactaatcaaggcaatattttcgttttcctagagatttatcctgcaataaaatacagtctattgaaagacatacatttgaaccactaccatttttgaagtttatgtaagttacaaatataacttgattacatttggaatttttataaaacttaattataaacctttttgctattcttgaaatatgattaaaattttaccagtagaaagctactaaaattatacagcaaatcctttttgtctctagcaaggattattgtgagaattattacacagatcttagtgaatcatcagagagcagtggttctcaggtggtgtgattttgcactcaggtggcatttggtaatgtccggagacagttttggttgacaaaactgtgagtgtgctcctggcatctggtgggcaaaggccagagatgctgctaaacatccttcaaggtataagacaaacccccatggcaaagagttatatagtccaaaatgttgatggcactgaagttgtgaaatcctgttctagagaaataaagatcacttaacacaggtatttactgagcattcactgttttgtatctaatgcaccacatgtgcagtgttaaagtataaatcataagccagtatcttccacagtcagatttccttagtgcatagagaaaggattgaggttatgttccatcctatataaattagaatcatggcaaatgataaatgttctgaaataattttttttttctttggcttgtgtcttttttttttagaaatcttagttgcaatgtaattacagaactcagctttggaacatttcaggcctggcacggaatgcagtttttacataagttgtaagtgaaatagaagatgaatacatgtaaacaactatttatgtacaaaaactcatacaattattgggtagctgggtataagcccattatcaactctgaaaagcatgtcttaagatccattcatttttctcaaatggggaagctaaggtacaaagaggccaagagacttacgtagcttatatatgacctcctctgcttgtcctagttctgacctatagcatgggcaagaaaaggcatcaaagaagtgaccctcaaattagccttgttgctgggcggggtggctcagacctgtaatcccagaactttgggagccgaggtgggtggatcacccgaggtcaggaattcaacaccagcctggccaacatagtgaaaccctgtccctactataaatacaaaaaaaaaatctgggcgtggtggtgcagttttttgctccctggaggactttgtgttaagcttccttccttgcagctaaatgttgcagacatttaagcagttagaaactctgcatatgagcaggaatcaaatccaaagttgtagggccagaatggtggctcatgcctgtaatcccagcaccttgggaggccaaggtgggaggatcactggaggtcaggagtttgagaccagcctggccaacatggcaaaacctcatctctactaaaaatacaaaaattagcaggtcatggtggcgggcacctgtgatcctagctatcgggaggctgaggcacgagaatggcttgaacccaggagggggaagttgcagtgagccgagattgtgccactaccctccaacctcccctccaggctggtctcgaactcctgtgacctcaggtgatccgcccacctcagcctcccaaagtgctggggttacaggtgtgagccaccatgcctggccaagatggtgtttatgttaagctattgtgcaaaaaaaaacttttgtaaagaaaatatatcgctgtatcttaattccatatactttcctgactactcttctaccataattgcaaaaattctatgatttctctgtataacatacccatcaaatcagagtgggtatattcagtggcctgaaggggactcaaggtgaagattctcctctacatctgactttagaaaagacgttccacctgccttgtggttcagaaatctagtttcacacagttcatttcaagttagagggaggcattcaggatgtgtctggactagagcagcagtttctgcacatgctcccctctgtcctcattaatttgctgatgcataacttaggaaaagtacactaaaggtctgtttttcttttgccctcacaccagagaacaggctcattaggtccctccaccaagaggtttaggtagcatcaatacaaatgttttaaactcaccatctttactaagcactttatacaactgggagtccctcataaaaatctggtggccgggagcggtggctcatgcctgtaattccagcactttgctgaggtgggtggatcacctgaggtcaggagttcaagaccagcctgaccaacatggtgaaacctgtctctactaaaaatacaaaaattagctgggcatggtggcaggcaactgtaatcctaggtactcaggaggctgaggcaggagaatcacttgaaaccaggaggcggaggttgcagtgagccgagatggcaccattgcactccagcctgagggacagagtgagactctgtctcaaataataataataatataataataataatcatcatcatcatcatcatcatcatcatcatctagccagcttcactacaattatgtaggcaacaccaggaaaacactggaatcacagttgataaaaattaatgaattcactcaaaaacattcagagtgtcatgtccatttgtgccaggtactgtactaagtgctggggctacaaaatccatctcaaagacacaccaagatgaggactttgtccccaggggactttcattcctcaaggaggaagcggatgctgatgggaaaacatatgagagccatgtggggatctgtacggcagggtgacaaggagaggacaaagcaggaatgggggctgggttaagaaagacttgagagacactaacttgcttatcttgagtttctgtgttcatcttaaacaacagaaaaaggcatttgcttcatggtgatgaaaaaatcagagctagctgatattggaaactagcactcatttcatataaacagaatagagctgtacccttcaaactaagtcacagttactttcaaagattggcacaagggtctcaacacaccaagtgtatgttaggggctgggcccttttggagtcaaatcttcctggtaaacaaagctacactgcagtcatatttggcatatgtgacatataggcccactgcatttccttccaaaggcaagatgccaagggaaggtgccagtaattttatgaccaatatgacaccattttgtggtgtttgtaagttgaaacaatatatttccctgcattacacaagtttataaaaaacaaacaaaaaaagaggccccagctgtggttgatcgatgatgaatagagcctaaccttccaggcttctcacttgcacaggcccttccaaggtcgtgggagggcccctggaaatttttgtattcataatttttttaatgtttttactagataaggctcaggccccacaaaatcctgaaatcatccctgggttccaatagttacaacccagtaaatctcttgaatgaagcctctatgttattgacaaatactgactggccaagttagcagggtgatagggtctgtctattttgaatctgaaatccatctcaaagacaggccaagagcttattagtggacttaactggattctgctggcccaagcgcagtaaagtcaaacaaccatatcgaggttttgcattggggaaaggaggacatttatttgcagggcatccaagcaagaaggaccaggcggctaactatcaaagtccctcactgaatgggggcaataatcatatctcttacagatgaaatcatgaatgaaatggtttatggaaaagcagcaatggttgataatcctaaatgttaagtatgtttatattttttccctgactttaaagtgcttctccttcattcctatacacaggtccagactgatggcttattttttaaaattctcttagtcacttcattggttctaacaataattttagaaactggatgactttgcaatgtagaaaggctatactttattcagatagagtacactcacatattggcttgtctatggcacatcgatatcatgccaagaatgtaagcactaagagagaataagaggaaaatccaggctttatccctattgaattatttatcccactattagaatactagtgaggtaggtgtggccacactgtgatggcaaattgagcttcggtcacaaacatgccttactgttccccccagtctactgacatcagcttcctttacatagcggtagatgcacaaaagtttgcacagttgagggtattgtcatcatgttttggtatgtactggaatcctggcagcttcttctctgattcggagaggcgcaaacattaaagacaaaaagaacaactcgagtctgtcctttggggtgatttagggtggctgtttaaatttgtagtggttgaaaagtcttgagattgtcacacctagcaactcttatacttttcttctctcagctgcagcttgttcttttcacctgtgtaacaagctgtcttctcttctcacagaagcttagcatttcttcctctgccccatagcattttttcaatacttaatttaccaggtgctgtttatgttgtaggcacctaagtacttatacaagtgagataacatgtccgaagttcttagaacagtgcttggcctatggtaaatgctccatacatgttacctcctatgatacctcattttcatttttccaacaactcttgcgatgcggttattattatcatttctattttgtagatgaggaagttgaaactcagagacgctaggtaatttgctaaggttcacacggctaataagtggcagaaccacttacaagctttgcaaataattttcaatgcagctcttagttcccctgtaataggagctgaatgatgacaatttggctttgtgtgcattgtatcttactttctaacttgaacaggacctgtagagcagtgagctccacttccctctgagaatcccacgcttctggagctcctggctgtaccagctctgggcatccccagggtttatgctcaccggtcagtgctggtgtgacatgatggctgagcaccggcactgtgtccagcgcattgctaggcactagacacgtgctctttcatttattcctcaaattgctttgtgctgtaaacgctacccagaaaggctcatgttcattactcaagtcacttcaccagaaagtgacagagccagaattcaaacccaggtctgccagattccaggtcccttgcttcttctgttgttgctcattgcaagggagtcttcttcaaggttattctcaggactttgattaagatacaggctcacagctgggcatggtgtctcatgctgtaatctcagcactttgggaggccaaggtgggtggatcacttgagctcagaagttcgagaccagcctggccaacatggtgaaaccctgtctctactaaaaatacaaaaattaaccaggcatggggacgggcatctatgatcccagctactctgaaggctgaggcaggagaatcacttgactccaggaggtggagtttgcagtgagccaagatcacaccactgcactgcactccagcctgggcaacagagtgagacttcatctcaaaaaaaaaaaaaaaaaggaaaaaggctcaccatttcagattctctagattttgcccctgaaaaagcatttacgtgatgcagtccgaggtcttgtatggaggagcttggtgtggggagatgtgtggctcacgaacctatgtaggtgaataaaggaaagaggttactttctccccaagtacatcgcgcatattgggtgagggtctaggtcatctgcttatttctttgactaccttcttccatggaaccagttttccctgacagccttgggattctagcatagatcattttggagtttgtcatttaaatttattttcacagcctgctttggacattttttcagctagagctgttaggatttcagtacatttaagacagtgatgacatgctccagtcctttcatctctctctcctcagttaatagaaaggaaacatagctcatctatctggacctgtacagaagaatttggagggaaaaaaaagaacaagcaagaaatgttcccttattttgtgagctacctttattctgtcccattgttctacagcaaaaggcttgtataaaaatatttcagttttcctcatctaataaggcatatttaataaaattatttagagcagtacttcttaaacttttactctgagacagtctttgaggctgaaaaaaagcttgccacattttacttccataaagataccaaaaaggcgatggactgggagtcagtgcaccttagtttaatgtataaaatgaaggacttgaaccagaaatggaaatggtcatctactgtgaatctaaaaacactcaaggctgggcgcgctggctcatgcctgtaatcccagcactttaagaggccaagacaggcagatcgcttgagcccctggagttcaagttcagcctgggcaacaaagtgagaccccaatctctacaaaaagacttttaaaaagtggaaacataaatataaataaataaaaacactcatatcatttggtttgtggaaaagagttgctgtagagtcctcaaacttgagccgttgagccagttcccactcagtctctccatggcccaggcacaaccttagtcaagaaaagaatgccttagaacaggaggaaaagaggataatatcgaatggccctatattttgatttcattagggacaaatgcaaagatcctaatgtcagctggagaagagcttcctagttcagaggtaatgctgagctcaaggctatggatgagctatcaagaaagagggaaggttggagagtgagagaattttggaggaaagataacaaactttgccaagttgtttggctacatactgccttacagtcattatttttggtgtttagaaaaaaatagaaacagggtctcactttgttacccaggctggtctcaaactcctgggctcaagctttccttctgctttggcctcccaaagtgctgagattacaggcttgagatgctgtgcccagcctacattcatttttaatagctgggaggaaagtgggcagaggaagatatagaatgaaggggtagccgactttgtacagagcccaccagtggtcttacaagttttcatgccaaaaaaaatcacgaaggatatttaaagccctagtttgagaatccatacttaaccagtcatgtggcactcacattctttctctttgtaacatcatcttattgaatattagtgttacaaaacaagttaatggcactgaaaaaccatctggaataggaaagaggagggggatcacaaggcaggacaagctgtgtggctcccagcctcgccactgactcactctgatcttggtcaagggagaatgaatcttcactcctcttttttccatctgccagcatgtttggtcttctggcacctggtgttctatacagtacaacatgcttctttgtgttacattgagacttgatccacgtaccatcaacgcagtattataaagtgtacaattcagtggtggttagtatattctcaaggttgtatagcaaacaatcaccattatctaaccccagaacattttcatcatcccaaaaagaaacatggtacccattagccatcactccccagtgctgtcttcccgcaggcccaggtaactactaatctactttgagtccctatggatttgcctattctagatctttcatataaacgaatcatacagtatgtggccttttgtgtctagtttcttttcacgaagcatgttgtttctaaggtcctcccatgctgcagcatggatcattcctttgcaaggctgagtgatattccattgtatggagccatcactatatccgttcatccattcatcacttagtggacatgtggttgtttctactttattttggcttttatgaataatgctgctatggacatgcatgtactactttttgcgtggacatgtttttaattctagggtgcatccctagcagaattgctagatcgtatggcaactcttatgtttaactttttgaggacctgtcaggctgatttccacagtggctgctccattttacacttccatctgcaatgtttgagggtttcaatttctccgggtctttgtcaacactgtcgttgtctgtctcttctcatagccatcccagtgagtgtaaagtagtatctcgctgcagtttttgatggacatttccctaatgatttaagacattcaacatttttatgtgtatatgagccatttatatatcttctttgaagaaatatttattcacatcctctgcccatttaaaaaattgatttgtctttttattgaattataggaatttctctatatcttctggatactctggatattagaccttaacagataatttgccaatattttctctcatcctgtgagttctgtgactttcttgccagtgtcctttgatgcacaaaagtttttaattttgataaaatctaatgtatctatttttcctttggttgtttgtgcttttggtgtcatgtgtgtgtataaaatgtcttattcttctttaaaaaggttcagtgtttggttttaaatcaggctgtgtccctttcatctgtctgacattcttgtcaccatgtcaggctgccttcagctagtaatacttcattaaattcaaaagacaaaattgttttaaaagaaaaaaaatccagtttggagaagaaaaaactgttgtctaatttaaggtcatgaaatttactcccatgtttttgtgtaagagtcttatcgttttggctcttacatttaggtatttgacatattttgcatcaattcttataatcgtgtgagatgtagggggtccaccttcattattttgcacatagatgttcaggtgacgccattacactcaagcctgggcaacagagtgagactccaatggagacggggtttcagcacgtttatcaggctgctctcgaactcctaacctcagatgatccacctgcttcagcctcccaaaatgctgggattacaggcatgagctaccatgcccagccaataaatgaaaactttttcactcaaaaaaacaacaattgtagtgaaaccatagatcagtttggagaatcatgctattattatctgcttcatgtttacagaatactccgttgaatttggtttgccagattttgtcaagcatttttccatctacattcataagaaatactggtctgtaattttttgtgtgtgatgtctttagtttggataccaggttaatatcaccctcatagaataagttaggaaatgttctttcctcatctgtattttgaaagactttatgaaggattggtgttaattcttctttaagtatttggtagattcaccagtgaggctgcctgctggtcttcagcttttcttagtggaaagttttttgattactacctcaatctctttacttgacataggtctgtctattcagattttctgtttttttctcaagtcagattcagtagttcatatctttctggtaatgtgtctttcatccagcttatccaattattagcatatattgtttatatgtataatcctttttattcatattataatcctttttatgtctctaagaacaatagtaatgtcccctctcatttctagttttaataatttggtcttctgtatttttgcagtgcagtggctcacacctgtcatcctagcactttgggaggctgcggtgggaggattgcttgaccccaggagttcgaggccagccagggcaacatactgagagcttatctctacaaaaaaaatgtaaaagttagctgaacgtggtggcacatgcctgtagtcacagctactcaggtggctaaggcaggaggatcacttgagcccgggagatcggtgctgcagtgagccatgattgttccactgcactccagcctgggaaacagagtgaaaacctgtcttgaaaaatgaacagtaagaaaacaaaatgtttgtggccagatgcagtggtgcatacctataatccctgtactttgggaggccaaggaaggaggattgcttgaggccaggagtttgagaccagcctgggcaacatagtgagaccctatctctaaaaattttttttagttagccgagtgtggtggtgcgcacctgtagtctcagctacatcttaattttataacgttgtagttcagattaattccaactttgtttcaatggtatacaaaaactttgcttctctaaagctccactctcaccccctcctttatactgttattgtcacacattacatctttatataccttatgttcatcaactagatttataattattgcattatgtaagtatctttttcttttttttttttttctttattttgggacagagtctcactctgttgcccaggctagagtgcagtggcacaatctttactcgccgcaacctctgcctcccaggttcaagcgattctagtgcctcagcctcctgagtagctgggactgcaggcacgtaacaccacacccagctaatttttgtatttttagtagagacagggtttcaccatgtttgccaggctggtctcaacctcttgacctcaagtgatcctccagcctcagcctcccaaagtgctgggattacaggcctgagccactgcgcccagccagtgctttttatttctttgtgcagattcacgttagtactccttatagggcaggtcttctagcaacaaagtctctcagtttttatttatctagaatatcttaatttctcttcaatttcaaaggtagttttgccaggtatagaattattggttgacagtttcttcagcactttgaatatgccatttcattgccttttgtcctccagtgttgtgtgtggttgctttgtttttagacagggtcttgctctgttacccaggctggagtgcagtggtgcaaccactcacaacgttgcagcctccacctcccaggcttaagcaatgctgtcacctcagcctcctgggtagctgagactacaggcatgcaccaccatgcccagttttttttgtttttgtttttgttttttttaatttttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgactcttaacgagcatgctgctttcaagcatctgtttaacaaagcacatcttgcaccgcccttaatccattcaaccctgagtggacacagcacatgtttcagagagcactgggttgggggtaaggtcatagatcaacagcatcccaaggcagaagaatttttcttagtacagaacaaaatggagtcttctatgtctacttctttctacacagacacagcaacaatctgatttctgtatcttttccccacatttcccccttttctattcaacaaaaccaccatcgtcatcatggcccgttctcaatgagctgttgggtacacctcccagacggggtggcggccgggcagaggggctcctcacttcccagaaggggcagccgggcagaggcgcccccccacctcccggagggggcggctggccaggcgggggctggcccccacctccctcccagacagggcggctgccgggcagaggggctcctcacttctcagacggggcggctgctgggcggaggggctcctcacttctcagatggggcggctgccaggcgtaggggctcctcacttctcagacggggcggccaggcagagatgctcctcacctcccagacagggtcgcggccgggcagaggcgctcctcacatcccagacgggcatgcccagttattttcaaattttttgtagagacagggttttactctattgccagtgctggtatccaactcctggcttcaagcaattcttgagcctcaagcctcccaaggtactgggagtacaggtgtgagcaaccatgtccagcacctgcattgtttttgaagagaaattagctattaatcttattgaggatcccttgtatgtgatgagttgcttttctcttgctgctttcaagatattctgtctttggcttctgtcagtttgattacagtatgtttagatgtggatccctcagtttttcctacttgtagttccttgagcttcttgaatatgcagattgtttttcatcatgtttgggaagtttggggccatcatttcttcaaatattctttctccttttttctgtttttcttctcctgggacgctcattatgtgtatgttagtaagcttgatgatgtgttccacaaacaggtctctgagattccattcactttcattcatttttatttctgttcctcagagtcaacaatctcaattaaccttcaagttccccattctgtcttcagcctgctgtaatgtgccattgagaacctctaataatttttccatttcagttaccatacttttcaactctagaatttctatttgactcctttttatggtttctatctctttattgatattctctatttgatgagacattgctttcatactttcctttagttctctagtctacagaactgaatcgtttctcttatctctttgaacatattttaaatagctgaattaaatccttctctaggccaggcatggtcgctcgtgcctataatcccagcactttgggaggctgagactgaggttgaggctgaggccaggagttcaagaccaccctgggtaacttcgcaagaccccacctataaaaaataaaaaaatctttgtctagtaagtctaacatctggtccttctcagggacaatttctgcttatttctcccccaaccacgtgtttgggccatactttgtttccttgcatctttcataaatgtttgttaaaaattgaatattttaaataatataatgtagcaattctgaaaatcagatccatgctgccagggtttggtgttactcctgcttgtgttagtagttgctatttatttagtgacttttctgaacttcttctgtaaagtctcgcattatatgtcatgtgttcccactaaagtccctcctcggttagcttaccgatcaggtaatgattaaatgaagatttacttaaattcttggaactgataagtctcctagtttttgccaaggggctctgtgtacatgttggggcataccttcagcactcagctagacaatttacagccatgccttagctttcacttcttgcttgtgcagaacctcaaggtgtcagccaggggtgagagtttatgaacttagtaggtctttcctgaccatgctgacagtctgccctatgcatgcgcgtgacattccaaattgccaggaatatgtcttatggacttctagtttcccaagcatatatcagagtgtttcaaattcctgtggacatcttattcctcagcttttcctattaagctttttgattaggcttttttcccccaaactgttattcattgccgaatacagttgccatgttaaaacacttgtctgtaattgttttccaaaaacaccctctgtggagaggctttagcactagacagctttcattctggtcaaataaagacaaacctttcaaatgaggtcttccagggaaccaccagacagatgacatcatgacagttaactgagaataaggctttgaaggagctccagctccattctgctccctctggttggggatgtgggctgttttccaaggcgactactgagctagagggtgaggaatggtctaaggcaagttaacacaaatctcactgttcttacagaaattttttttgaataaatgctccttgggttgctgcaagactttggttacatttctagagttctgaaaaagtttattgtggtcaatttttttttttttttttttttttttttttgctattttttttggtatttgttgcttttatgaagggatgaatttttggatgtctctttttttttttttttttttttttttgagacagagtctcactctgttgtccaggctggagtgtagtggcataatctcatctcactgcaagctccacctcccgggttcacacaattctcctgcctcagcctcccgagtagctgggactacaggcgcctgccaccacgcccagctaatttttgtatatttagtacagacggggtttcactttgttagccaggatggtctcgatcccctgacctcgtgatccgcctgcctcagcctcccaaagtgctgggattacaggtgtgagccactgcgcccagcctgcatgtctttattccaccattttcactgatgtcacttacgacatgattttaaatctctgaaggctcactgggcacatgcctgtagtcccagatactcgggaggcaaaggaagaaggatcctttgagtccaggaattctgggctgtagcatgctatgctgattgggtgtccgcactaagttcagcatcagtatggtgacctcccgggaaaaggagaccaccaggttgcctaaaaaggggtgtaccagcccagttcaggaatagagcaggtcaaaactcccatgctgatcactagtgggatcatggctgtgaatagccactgctctccagcctgggcaacacagtgagtgagaatgtgtctcttaaaaaaaaaaaaaaaagtctcattgaccatagactaataaactatttaatcatgggaaatgattaggggaaagacataaaaagagaaactgtaatccacttttttttgctctgtcgcccaggctggagtagagtggcttgatcttggctcactgcaacctccgcctcctgggttcaagcaattctcctgcctcagcctctgaaacagctggaattacaggcaagcactgccgtgccctgctaatgagaaattgtaattctcatagaggtcctcccagaggagtagaagaaggttgaaaggcacttctgtatttagtcttctcacaattaaggctgggcccagtggctcacaccagcactttgggaggccaaggcaggcggatcacttgagatcaggagttcaagaccagcctggcaaacatggtgaaactcccatctctactaaaaacacaaaaaatagccaggcgtggtggtgcgtgcctatagtcccagctatttgggagactgaggaaggaggattacctgagcttgggaagaggacgttgcagtgagccaagatcacgccactgcactccagcctggtcaatggagcaagaccctgtttgggtggggaggggaggggagtggaggggagaggagaaaggaaagaaaggaaaggaaagaaaatagaaagaaggaagggggagggaaggaaggaaggaaaaagagagagaaaaagaatgaagaacaaaaatgaaaattttttaaaaacctaaggttaaaataaaccctttttcttcatacagattaaacacgagttcaaattacagctttgctgcttaatagcttggtgacctaggacaagttatctaacctctctgtgcctcagtttcctcatttaaaaatagggcaataataatatctaccacataaggtatttgctgatcacaaatacctggcaacccagtagatactcactgtaataattattatttttataatttctgcctaagtacaaagatgattcttgggttaacctaaaggtagattttcttttatttcttcctgtttcttttatttttcttgttcaccttaaagaattaaaaagaaaatcgattccagcattttggaataaaaatttgcatcaaaatcaatttattcattttattgacatatgaacaaaatgtcatttgtttattcaataaacatttgttaaatgcctaatacatttcagacatcatgccaggcacggggatgacagggcatggtggcaggcacctgtaatcccagctacttgggaggctaaggcaggagaattgcttgaacctgggaggcggagattgcagtgagccaagattgcaccactgcactccagcctgggtgacagagtgagactccatctcagaaaaaaaaaaaaaaaaaaaaaatgtggtctctgccctcaaagcgctcatagtccaggagcctgacaagtggacaggtgattacatgcaatgtaagaaaggctgtgatgtcatacaagaagacaagtgggagtatggttttgaccagttcctcctcttagatttattccttcttctttggctataaagcaaaagaattggtcctatttttttttaactgtgcaaattaaaccataaattttaaaaactttataaagataaaagacaagcagccagccgcagtggctcatgccagtaatcctatcagtttgggaggctgaggcaggtagatcacctgaggtcaagagttcaaaaccagcctgaccaacatggtaaaaccccgactctactaaaaatacaaaaattagctgggcgtggtggtgggtgcctgtaatcccagctactcggaaggctgaggcagaacaggagaatcacttgaacctgggaggcggaggttgcagtgagccaagatcgagccattgcactccagcctgggcaacaagagcgagactccatctcaaaaaaaaaaaaaaaaaaaaaatagatgaacaacttgaattatgatgagcaacttgaattatggaggatgctagaaatactgtttcctccacagtcagggcttcctaccaacatagtcacttttagggtttttgacctgaaaagttctgtggcatattttttctttgctatccactttttttttccttgtagttcttccccgcgttctatcctttatcttctagagaccttggtagttcccataggaatagtgctttacggagtctaatggtgatttcttaggtaaagacaggaaacatttttttcttttttacctacaagttccatatcaaaaaatgaatgtaaacttttcatgcagttttacacattgaaaatgcaggttattttaattccattccatttttcagaattctcaatcacaatcctctgacaactgttgaagatccgtatctctttaaattgccagcattaaaatatctgtaagtactatagtactctcatgagtcaagagatgatttatgctttttaaatttttcatcaaagcttaagtattttgcatttaggctaaaatgtcataatttaaattttaactgggttattgaaaaaaagttattggcgaagaaaaaaactaagaggatgtataatggtcaagacagccagcaggggaagagaacagcattgaagaacccatatagatttggaacatgtagacacatggaggaatattatttaaccaagaaagcaaaggggaaaaggtgttcattattctaaaaataaagaaaagagtaaataagatggtgagtgcaatatgaaaatgagaagataatggtaaaaaaaaaaagtgtcagttctgctcttgagtatcattaatttgatgatgcaaatcaacttttaatttctttaataagagctccctggaattctacagcaaataaagtcttgagctggcttgtttaatagagaagccaaaattgaattgttaagtacagaattttttattggggctcatatcatgaatgtttcggctttcttcttcagagacatgggaacaacgctagtcccacttacaacacttaagaacattctcatgatgactgttgaactggaaaaactgtaagttatttttttctgagatttatttttacttagttggttctttaggtttgttttattattttcttaagtcaggttcattgaggtataattttcatatagtaacattcacgctttttaagtgtacagtttgatgagtctgacaaatgtatagttacataaccaccaccacattcccaatataaagcatttctgatgcctcaaaaaggcccctactgtccctttgtaggcaatcccatcctcccaccatcagcccctgttagctactaatctgatttctgttcctatacttttgccttttccagaatgtcttataaatgaaatcatatagcacatagcctcttgtgtttggctcctttcacaaagcctaatttttttttttgtttttgaaatggaatctcactctgtcgcccaggctgcagtgcagcggcatgacctaggctcactgcaacctccacctcccaggttcaagtggttctcctgcctcagccttccgagtagctgggattacaggcgcatgccaccacacctggctaatttttgtatttttagtagagacaaggtttcgccatgttggccagggtggtttcgaactcctgacctcaagtgatccgcctgcctcagcctcccaaagtgctaggattacagataagatccaccttgcctggcctcactcagcagaattttttttgagattatgctaccatccatgttgttgcacctatcactacagctggccctccatatctgcaggttcctcatccatagattcaacgaaccatggatggggaatatttggaaaaaataaaatatataaaacaacaatacaacaataaaagcagtagaaaatttaaaatacagtataattatgtacataccatttacactgtattaggtacttagagtatacctgaggctgtatacaaacattatgtcatttcataaaaaagaactcagcatctgtggactttggtatctgcagggggtcctggagccaatcccctgcagacaccgagggacaactgttcactcctttttattgctgagtagtattccggttgtgtggaaatgccatctctactaaaaatgcacaaactaggcaggtgtggtggcacatgcctgtaatcccagctactcaggaggctgaggcacgagaagtgcttgaacttgagaggtggaggttgcaatgagccgagattgcaccactgcactctaacctgggcgacagagtgggactctgtctaaaaaaaaaagtaagaaataaaaatgttttctgaagagcagaagtttttaattttgaccagctttaagttagcatttttttcttaaatggcttgtgattttttgtttcttacctaagaaatctttaagaacctgttgtctaatccagcgtctaaaagattttctcctatgtcttctcccagaaatgatacacatttaggtctatgatccattttgagttaatttgcatatgtgatgtatcttttttattttttatttttttgtagaaatgaggtctcagtatgttccccaggctggtctcggactcctggtctcaagtgatcctcctgcctcacctcccagagtgctgagattacaggcatgagacaccgtgcctggccttctttgcaggatatatatatagatatagatatatatataaatcagccaggtgtggtggcacacgcctgtagtcccagctactagggaacctgagtcaggaggatcacttgaacccaggaggtggaggttgcagtgagccaagatggcaccactgcactccagcttgggtgacagagcaagaccctgtctaaaatatatatatatttatatatatgtacgtgtatatatgtatatgtatgcctgcggggccctattgtgagtttgttacacaatttactgcaacttcaattgtgccaccagcccccacaatatggcaagctaaatagagactcagttatgctagggctggttgagggcattttgcaagattagcatggaaagggcccttcatttagcactctgctccgttcatttttgtcaggtcactttcttatcttgaccaggttgtcagatctcttttactgctctagcctcactttcctcagcctcctgcagcatcttccccatcagctggatcccttcctctctggatgaagtccccttcatcgaccagctttctcacttagttctctaagatagtgaggatctgtctgcttttttcttgaccattattggataggaaaaatgctctcatcctctgtaatgatttgtcaccaaggccataaagacattgaactaaatgtcttatgggagttcattattggaagtcttcaggagtttacacatttatgtacaaagtaagtaggccagctcatttgagtcttggctcatgtgtaatgatctttcatgtgtattgaaaaattattctcaagtatacctcaggtcatttacagtctcaaagatttgtcagtatactttaaaacaatcctgggaacagttctagattgaaggagactaaagaatcatgtactaagtgtaatgtctgatgtttgattggattgtgaattttttaagccatgttatgattgggacaattgtgaaaatgtgtatacggaccgcatagtagacaatgataatatgaagttccattgagtgatgatagtcctctggttatgtcagagaatgccttggttcttaggggctgcacactgaagtcttcaatggtgaagggtcattatgtctgcaactgactctcaaatggttttgtccagaaaatgtatagacatacacacacggaaagctaatgtggcaaagtattagcaactactgattccagatgaaagttatacaggtgttcattataccatttgaaaatgtttcccagccatcctaaggcttaaaggaaaaaaagaaaatgtttaaaataaaaacttgggggcagaaaaagaataccaaaaattttgggctcatgcctgtaatcccagcactttgggaggccaaagagagagggttgcttgtgcccaggagttcgagaccagcctggacaacatggtgaaaccccatttctacaaaatatacaaaaattagccaggtgtggtggcacacacctgtagttctaggtactcaggaggctgaggtgggaggatcacttgagcacaggagacagaggctgcagtgagccaagattgcaccactgcactcagcctgtgtaacagagcgagacccggcctcaaaataaacaaaagaaacacctttgtggcagaggtaaggttgctatacaacaaaatgctgggttacggttccgggtccattccatatgaagatcagaggcttccactggacccaaaggaatactactagtcacttgtgattgttcctttataggtttgaaagatgtctcaggccaacttattggatgcagttttaatctaaaactctatacattgtacccccaactcacagacttcttgtatccatgaaaccctcttctgttttcatagtcttaatatggccccaataaagccatccttttggaggactcagaaaaggccccccacaacctctgcaacacaataattatagttaactcttattgagcactcactgtgcaccaggcatttttcaggtattgattcatttgatcctcaaaattcattagaggtaggtactattataatgacaaggccaaggaacagagattaaacaatttgcccaaattcacattattagcagagctgagattgaagcatagtctggctatggaatctgtattcttaatgaccatgctatactgcctaagattaaccttttacttcagttacagggattgtttttatctctctgaaagtgcccccaataagccacaacaataaattaatcaattgtctcggtcacctcttttgcccaaatttacgtattggaaaaaattcaaacaagccagaaagatgaaagaatagtacagaatccaatcaaagatcaggcactgcatgtcatgtcttcatttcctttaatctaaaacatgcctctactttctttgatctttcatgacactggcattttttaagagtcaaagatagttgtcttgtaaattgtcccacaatccagatttgtctgtttcctcatgatgaaattcaagttaagcatttttgggaaaaatactgcataggtgatgtatccttcctgcctcgtaaccgcagatggcctgtaatactaagtttgatcacttgactaaggtgatcttccaggtctctccattgtaattattttgctggctacagtggctcccacttgtaatcccagcactttggaaggccgaggtgggaggattgcttgagcccaggagttctacaccagcctgagcaacatggggaaactctgtcactactgaaaatacaaaagtacaaaaaaaaaaaaaaaattagctgggcatggtggtgcaagcctatactcccagctactcaggaggctgaatttggaggatcccttgagcccaggggggttgaggctgcattgaggtataattttgccactgtatttcagcctgggtgacaaaataaaaataaaaataaaaaataataattttccccttggtaattaataaataatctgtgggttgttactttgagttcagtgaagatcctgttctcaaatgttttttcacccaaatgtgcatcaatgataatccttgtctgaatgaatttgtattacactgacggttgcaaagtgacacttttaaaaattctgtcattccttctacatttactagctggcattatttcattgaagaagaactcctcctctttctttttcaatatcactcttcgtggattcttctttatattaaatatgtggtaacttattgttgttattcttttgaatgctcaaattgtccagatttgaccaatgcagtctttgttattttttaactccgcaatccaggttaaactaagctatttttaatgcccagagtaatttataatatttcccactcccaacaggaattgagaaagggactccagaagttgggggcttattcagacttcttaaaagtctaccttcttcctctgtactttcagcccaaagtgagacttttgaattgggaagagatacttctgaaactactaatcactgtcacccaattctaatcccaaccatctttattctaggcataccatactcactgccatgcttacccttcagttgggcacttttgtcctccttcctattggccttctggttcctacccaactgtccagtccataggcttcaatgacacctttttcccacacctgtggtagcgttggctgcctcctttacctactcaagtaaccgctttaccgctaatttattgctctctgttttcatctataggatcttacctagccatatggcctgctgcctctgccaatttaaaaacagcattgaggctgtctgcaagacagtcaagctgcattgcaacagtgcatgtctgacaaacaccacacattgtcgtgagtccaaattgcgcggtgataaattgttacattaagtatttgtttttaaactttttatttttaatgatgataaaattttaagctaatgacataattgctttatttttatttactcattcagagttaaactccctcaatttccgaactactcccttgctgaaagtcaggttctcagttactattacaaaatttaataatagaactgttccatatgcagaaaggaccaagacaaaggaatgggaaggctagggaataacattaacatccacacactgtatactgtgctctctgcttgatgctttgcccacagtgataatttcttcatatagtgcaatgtagtttgtaagctggttttaaatccatgagatctcaagtactctctgccttataggacagatgtagatacggttttggtctttctgtttttacagttttataagagtacaagtgatgctgttttatttgaagcctgagagcttctggttccataaccagaaattgctacctggctcttctaatggaatggagggcttttccattcttagaccatccaactctgaacttgctccgaatctcaaacctttctgttcacagaacaaacgctcaagggctttcaagagtgtttctgtagattaggcttattagcatcaacttcatgacttctaaaatgtgactgctttcatgtccagatagcttgaatacaggtatctaccagtgatatggggtggagaattaataatgcttggttacataaagtcagtgttgcttatttttcaaaactttttttttttttttttttttttaccaattatgttattcccttctccccaagaagtgggcagaaaagctttgttaacctccttttacagatgaggaaaaacaagatcagaggtgctaagtgctgtagcctagtgccaggtcttctggccccaattctgggttctccccaagcccatgtttcttcccctttctcacaatctttacttcttcctctgaccctcaccaccacccaaagtacttttaattccagaaaagaaacccagctgcacactggcacacctgaccttcatgcagtcagaagctttggatgattccccatccaaaatattagagatgaaatgaaagcaaagtaggcatctgacaaaagttgctttttcccttctgcattttaggacctcaagtaatgtttatccagaaactgctatcataccagggattcattgtgtatttaacaacataggcatacaatctggcaaatttgaaaaactcttaacatacaccccaaatccctgcccaaatttaagaactagggtggacacagtgcgtttttccatgtcgcatcttctgtgatggggctacgatacgtgggagcagagaatggggagggtggagcgcatgccagatgaggatctatcagcaatgggacggggcctccactttagcatctccaccctgctcctctcagaggaccgcctttcattgcattcagctgtgatggtagcacgaacacaggtgcaccgaggacgaggagagcaggagccttgtgctctctctgcatctgaggcaggacagcacagggtacggagcagtctgcagagaggccagctcatcagggaagcacttgtcttccaccttgggctttgactgagcactgggcaattggcctctggggatcaacgaaataatcctaaacagagttactctatgtcacactatggaatgttccaagtaggtggccgtgttttcaaaagatgtattttctccttttgttgttgccatttcataggtttaggattgggtgtgtgtttctcctctctgaatggcactcgaatgtttgctgactcctactctgtgtgactggggtgtacagctatggactgatgcatcccatcccatcatctttcatgatcaaagcagtctcttcttttttgacagctgaagaagcatcggtagggaatccagaaggagcgttcatgaaggtgttacaagcccggaagaactacacaagcactgagctgattgttgagccagaggagccctcagacagcagtggcatcaacttgtcaggctttgggagtgagcagctagacaccaatgacgagagtgattttatcagtacactaagttacatcttgccttatttctcagcggtaaacctagatgtgaaatcactgttactaccgttcattaaactgccaaccacaggaaacagcctggcaaagattcaaactgtaggccaaaaccggcagagagtgaagagagtcctcatgggcccaaggagcatccagaaaaggcacttcaaagaggtaggaaggcagagcatcaggagggaacagggtgcccaggcatctgtggagaacgctgccgaagaaaaaaggctcgggagtccagccccaagggaggtggaacagccccacacacagcaggggcctgagaagttagcgggaaacgccgtctacaccaagccttccttcacccaagagcataaggcagcagtctctgtgctgaaacccttctccaagggcgcgccttctacctccagccctgcaaaagccctaccacaggtgagagacagatggaaagacttaacccacgctatttccattttagaaagtgcaaaggctagagttacaaatacgaagacgtctaaaccaatcgtacatgccagaaaaaaataccgctttcacaaaactcgctcccacgtgacccacagaacacccaaagtcaaaaagagtccaaaggtcagaaagaaaagttatctgagtagactgatgctcgcaaacaggcttccattctctgcagcgaagagcctcataaattccccttcacaaggggctttttcatccttaggagacctgagtcctcaagaaaacccttttctggaagtatctgctccttcagaacattttatagaaaacaataatacaaaacacacaactgcaagaaatgcctttgaagaaaatgattttatggaaaacactaacatgccagaaggaaccatctctgaaaacacaaactacaatcatcctcatgaggcagattccgctgggactgcattcaacttagggccaactgttaaacaaactgagacaaaatgggaatacaacaacgtgggcactgacctgtcccccgagcccaaaagcttcaattacccattgctctcgtccccaggtgatcagtttgaaattcagctaacccagcagctacagtcccttatccccaacaacaatgtgagaaggctcattgctcatgttatccggaccttgaagatggactgctctggggcccatgtgcaagtgacctgtgccaagctcatctccaggacaggccacctgatgaagcttctcagtgggcagcaggaagtaaaggcatccaagatagaatgggatacggaccaatggaagattgagaactacattaatgagagcacagaagcccagagtgaacagaaagagaagtcgcttgaggtgaggaccacacagaaacatgagacccagatttcccatcatttagcatatcccaggaaagtgcccacacagaagagtctgggactcccaggccatagcttatcttggccatgtaactttggtcatgacagtgatctcccactttgctcatgtagagagagaaatagattagggcacaagatgaactgtaggccgggggtggtagctcacgcctgtaatctcagcactttgggaggcgaaggtgggtggattacttgaagtcaggagtttgagaccagcttggccaacatagtgaaagcctgtctccacaaaaaataagaaaattagctgggttgatgacacgtgcctgtagtcccagctacttggaaggctgaggtgggaggatcacctgagcccagggaggtcgagtctagtgaacggtgattgcaccacggtacccaagcctgggtgacagagtgagaccctctttcaaaaaaataaaaaagaacctgtcagctactcacctggaatactggggttttgaatagttagctctcattctggttttttttttgtgtgtttttttttttagctcaaaaaagaagttccaggatatggctatactgacaaactcatcttggcattaattgttactggaatactaacgattttgattatacttttctgcctcattgtggtaaggacaataattaattcaggttttcagaatgcagtcctgtctttgtgtggattcagagctcacaaactgaaaaccaaagccactttcccacctgctgctacttgacatacttcttcagtcatttaaggctgaggtgtatgctttgttcttttactgcagtgtatatttcaggatttttaaaggatcctcgctttcagatctctgtgaattgaaaccatgtgaatcccactagactattttaagaagtcgaaaatttctcccacccaaaactatgtcaacaattggatgtactcatcaagtcacccttactctgccactaatttatttccttgttgctgaaatgatgagagaggtataatctccaccctcacggagttgtcatcaccctggagaggaaggagagagccaaaagacatacgtattgtcttgtagacttattagatttacacagtatcgtcctccagtgtgtaaggcattgtctaaataggtccagttaaagcactacagagtagccatcttttacaaaaatttttggccacatttttaagttcactggtgagggggaacgtctcatactctagccctcctgagcctagaccctctgtgagatgtgtcaccatttcttggacaccatgtgagacattccccctcagattagagatgctcagcttgcatcaacttacctaaagcctacatctggctactctgggacaagtcctgtttacagtgcccattcctggagcttgcctctgtcttttgttcgattacatgatgtattacttttcccaacaggccagtgctagcatattggaagagtgatttaataaagctggcaaccttgacgctatgccaccagtccaaccttacttgcctcatttaccatttccattattgtggcagccctccattccagccacagcagcccctcaccaaaccccagtcacaccacccacatttctgcttttgtctgtgtgtttgtccatctaaaatgcccttatttcactctgcctgtgggagtcctatgcatctctcaaaagccaactcaagttcatctttcttcttgacaccttccctgaatattccagccctgctgagcctagtccctttgtgagatttgtcaccatttcttggacaccatatgagagacttcagaggctgaagtgggaggatcgcttgagcctgggaggtcgaggatgcagtgagctgtggtcgtaccactgcactctagcctgggcaacacagctaggccctgtcttaaaaacagccaccaccaaaaactatcttgggatttgaataggattacgttaaatttgtagattaatttgagaatttacatctgtacgacattctaggaacgtgctatctcatgtcatgtattcatttcttgttaatgtctttcagaagagctttagtgtttccatatatagatcttatacatcttttgttagataaaagatctttgtatttttgttcctaaattcttcatacatttgtattgccattgtaaatgggatctttcttccattttctaattagttattggtggtacatgggaaaagtatttgaggtttgtgtgctgatttcttgattttgtagatagccactgtattgaattctcattacttccagtaaaatcttagttgattctcttaggcttctttggctaacatttatcatttaatatgcaaataatgatagttttgtctcttcctttccaatacttctactctttccttcctttcccttttcctttttcctttcctttcctttccttttttttcccttctcagggccttgttgtcacccaggctggagagcaatggtgtgacctagctcactgtaacatcaaactcctgggcttaagggatcctcctgcctcagcttcctgagtggctgggactacaggcaggcagctaatttaaaaaatgtgttcgtagagacaaggtcttgctatgttgcccaggctggttttcctgccacttcagaggaaggactcaggtttcctttttctcctacttttaagagtttttattaggaattatctgttgaatgttatctaaaacagtcaataaaatgtattaagtgccagctgcatgcaagaccctaagttagatacagtcagccctcttcatcagcaggtccacatcttcagattcaactagatcaggctgaatatttgaagaaaaaaaaaaccaataaaaatacaaacagaaagtacaatataacaactgtcaacaatgtacaatatgtatacattttattagtgatgacttaaattacatggggccaggcatggtggctcacacttgtaatcccaacacattgggaggccaacctgggcagcatagtgagaccttgtctttattaaaaattaaaaaaaaaaatagccaggtgtggtagtatgcacctgtagtctcagctactcaagaggctgaggtgggcggatcactggagcccaggaggttgaggctacagtgagctgtgatcgtgacaccgcactccatcctgagtaacagaggatgacactgcactccagcgtaagcaacagagggcaatcctgtcgctaagtaaataaagtataggggggatgcgtgttggttataagcaaatattacaccattatatgtaagggattgagcatccacagattctggtatggtgtgggggcggtatcctagaaccaatcccccgcaagatagcaaggatgactgaactatggaagaatcaaagcagtgttacacagcatacaattcctgtcttcaaaaaagttacctcatcaggtagatgagacttataatgaataaaaggaatcaatacagatttggagacggtggttgttgtcatagataatcttaattgcgttttcttctaaaacagatatgttgtcaccgaaggtcattacaagaagatgaagaaggattctcaaggtaaatattagtctggtgattttttttttcttctcttttgagacggagtttccctcttgttgccaggctggagtgcaatgacacgatctcggctcacggcaacctccacttcccaggttcaagcgattctcctgcctcagcctcccgagtagctgggattacaggcatgcaccactagtctcgcgacgttttaattagaattttagaattagaggagggcttagaactctgccctcatttttcagtgaggaaactgcccaagacaggacaaatacttaccctaatgcttagcctggctccagtgaaattagctccccagccaaagctgagctggatggaactaacaaggacacacctgctgtccccagccctttcgggaggtggggagggataggaaggagaaaggttttggtgcctattgctgctgatggtgggcatcaggccaggccaggggccttcttggaggctctgggaaaggggaagggaaggccaccgggtgtgagagagagggcacttgtctccttcaaggctgatggaaggtaggatatgtgagtccttcctcttaagtggcaggaaacagtattttctcttttatttcttttttttttcccctggatcctagaactgaggaaacactattttctcatcttactggtttttgggcccctactctattccttttatgcaaacctcacagaattttaaccagaaaggccaggcaggatggctcacgcctgtaatcacagcactttgggatcacttgaggttaggagctcgtgaccagcctgaccaacatggtgaaaccccatctctactaaaaatactaaattagctgggtgtggtggcgcaggcgtgtaatcccagctacttgggaggctgaggcaggagaactgcttgagcccaggaggcgcaggttgcagggagccaagatagcaccattgcactccagcctggggaatgagccaaactgtctcaaataaaaaaaaaacaacaaaaaagaattttaactacggagaccttagatagtagtttgtccttttatgacaggaaaactgagaaggagaaagggagagtgtcttacttaccccatggtcacacaatgcactctgccttttcctattttattcaaattcaaaaataacatgttgtgctttaagctgatttcgtagctcactcactcatcagcgacagccagccatatgaagactgtgagatagagaacttggctagctgcactcacgcatttgcttgaggtgatccaacttatagaataaagtatctagaaaacgaagaaccacttcatctcccatcccccatcaaatgatgcctgtgagactaagtccgaaggggactgatataaaatgcttctgcccagcatggttgtgcagtttgttcactgcacaagggcacttggccaagggagtgagtgggactgaaaatcctgcccctgctccatgctgagccacatacaaagtccccccagtatattgtggggcccttctgggcagacatggagagcttctgaaagtcccacatgcatggaattattttcaagaccccgggtatgtggtctgtggtggtggttctccctgtgattatggactgagatactcatttagtcctaataagaccagagaagtacattgtgagatacgtgggaaacggctgcatcactcactgtcttgtgcatgtgtctccccaggggcattttcagatttctgccatggaggggatgctcttcgcgaagggagagtcaggtacattggaggattcattgctgtggccagggaaagcagaggacatgcaaaattaatatttccctttctatcttctaggatggactttcctcatttggacagccgctctggtttaaagatatgtacaaacctctcagtgccacaagaataaataatcatgcatggaagctgcacaagaagtcatctaatgaggacaagatcctcaacagggaccctgggtaaatgatggggccctcacagttcccatctaaaatgaggagggggtgagaagcttaattgctcctttcaagaatgaaaaccttggcattgttattcttatcccagggacagcgaagccccaacggaggaggaggagagtgaagccctgccataggaggagaacacagcccacctcaggcctcctgcaaaaatacatagaataaacaacaacagttactaaatgaatgaaaattgtgattccgatgaagcctgccagagaaacaaagcattttttaaaagaggaaataaggtgatatctgattagggcaaacatgatgcagacaagaaatgcaccggttcagaggagggaaggtcaggccgcctggggagagtccatgaaaaagatggaacgtgccagatgctgtacctggtgctgggaaagagttgactaggccagcatccctttcctcaaagggggggctcctagactggggggagggctggacatctgaatacatcctgaggagacagtgtgggacagcatggtggcagtggaaccagccgtggttctgctcttggtcggctggaaaggagtagatgtaagggatggtttagaagaagggaagtggaagaaaagttttctgagctgacaagaggaaggaaaggccgcctagaaggacactaaaaaggcaagagaagccctaagcagagtgagcaccagactccacaggttaagggctcagtcacacaggaccatccgcatgtcagaccccaggtgcaaggccaagcatcacctatgcatctgaccaactggctgtaaattggaggtccccacaactccctcctcaggtttgaacatttgctagaacagctcatggaacccaggaaaacagttttcttactagtgctgatttattacaaaggatattttaaaggacacaaatgatgaagccagttgaagagatacacagggtgaggtttggaagggtccttgtggagttggggtgcaccactctcctggaacatggatgtgttcgccaacccggaagctctccaagtcctgtcttttaaggagttttctggaggctttatcacgtaggcatgattgagctccagctctactccccacgccagaggatggggaatggggctgacagcacaacgcttccaaccataggtctttttggtgaccagtccccaaataaggagcccaccaagagtcacctcatgagaacaaaggacgcttctatcacccagaaaattccaagggatttaggagctctgtgtcaggaaccaggtttaaggaccaaatgttagaacaaaagatgtgcaaccataaaaaacagcgagatcatgtcttttgcaggaacacagatggagctagaggccattatcctcagcaaactaagacaggaacagaaaaccaaatactgtatgttcttttaagtgggagcaaaatgatgagaactcataaacaacagacactgggccctacctgagggtggagggtgggaggagggagaggagcagaaaaaactattgggtactaggcttggtacctgggtgatgaaataatctgtacaacaaacccccatgacacaagtttagctatataacgaacgtgcatatgtaccccctaacctaaaagaaaagtttaaaaaggaaaaaacacctaggagaaaagaaaaatgataaattaacaaaggacaatgctcttagcaccgccatcattcaggaatttccaagggttttaggagctttgtgttaggaactgggggcagagaccaaatatatatttcttcttatgttacactaccccagataggaaaacagaaattactctagatatttcaaacaaaaaagggttgtatataggcaattagtgcttatcactggaggtgctagaggtggtgaaggttgtggggatggggttgcaccactggctttcaggctactttaccacagctgatttccagaggatggaagaagtcaggaaacttgggaaaccgctgctgaggtccttgcagccccacggtccccaggctggtgactggtgggggagtatggagtccagctgaccaccagagcctgcacacctgctgctatgggggaggaaaggatgacttctacctcctttccacattccaaattccacgtgactacattttattggcagcaccccgctggcaagtgagccttgatgtgtgcttcctgggcttctggcacctgcacagaaaggggtgaaatgagtgtcacgagcagccaccactctgcatcacacctccacatccaggtgtgctggagagccccacttacacttggagtgtcctggtgccctacccacttttggtaggtgtttgggtgtctgaggctttgcaaaagaagaaggtggggagtctatggtggagtcacatggtggagacctagctaagtcagaggcctggagaggtgtcactggctgggcagcaggtaacacacaatcatcctgagctgattggagaaacacctgggattgattcagagttttttctggaatgttttcactggaatgaaagctgagcggtctgcaggccatatagtattggagaaaacttagccctcattgaaaaaggctgccagagaaaagatatccacagggaaattcaggagttttgtttgtttttttttcttttaaggtggagttttgctcttgttgctcagtctggaatgcaatggcacgatctcagctcactgcatcctccgcctcctgggttcaagcaagtctcctgcctcagcctccctagtagctggggttacaggcatgcaccaccatgcccggctaatttttgtatttttagtagagatggggtttcaccatgttggtcaggctggtctcgaactcctgacctcaggtaatccacccgccctggcctcccaaagggctgagattacaggtgcgagctaccgcgcctggcttgttttgggttttggggttttttttgtgttttgtttgtttgtttgtttttggagacagtctctgtcacccaggctggagtgcagcagcgtgatctcggttgactgcaacctctgccttccaggttcaagtgattctcctgcctcagcctcccgaatagctgggattacaggcacccaccaccatgcccggccaattttttttttttttttttttctaaaaacagtttcaccatgttggccaggctagtcttgaactcctgacctcaagtgatccgctcaccttggcctcccaaagtgctgggattacaggcatgagtcactgtgccccgccaggaaattcagtttctgaaaatacacctgtggatctctagccttgaacacccttggatgctgctttaaatgactgatcctcgatgcctcccttctaactcacactcccctatatcaatctcccagaaaaagggacctcttttattcttttttttttttttttttttttttcagagacgggcctcactttgttgcccaggctggttttgaactcctggcctcaagtgatcctcccgccttggtctctcaacgtactgggattacaggtgggagtccccgcgcccggcaaagcctatattaaacccttttatgcacactcggcggtactgcagagagggcagggaggaagcagaggtgccctggcatcttcagctggaggtgagcagggcgctgagggtgggagaggcccggcgcctggggatgggaggcaggactgcaccttcacagggacgcttccaccctaccccggaggtcagggcctctcgcccagctctggctctgaggtcctggagggagggagatgctgttgcgactcagaagattgggggagggccacccccattcgagaagagtgaaaatcctgagcctgaagaagtggaaccggttggagccgaggctttagaggatggcgttcgaaagagggtctggcgccgccctgtggaccgttcgggctcgcagggccgaaggctccgaagactgagacctgtgaaccatggggaggctccatgcggatgggggccacagcccccgccggagcccccacactagccctggacttctccactggcttacgacatgagagctcaatatgctccttatttaacgcactgttgtatcaggtccctgtgggagccactggctctatagcctaataaaggagcgggtgcacgcactggattggtgagctaccgccactgcaacgcgtcctaatcaaccatcctaaacggcggctggaacaaggttctcgcaggcctgtgcttgggcttgaacgctggtccagccgctgcgctctgtggctccctgtaggcctgcggatcggccagggggctccgttccttttgggcggaggctgaagaagcagcggctgcaccagagaaggccctctgggtgaaggtgggagcgcacggggcccgcggaaccacctaaggcgacttcagacgtgggctcggaactggcagcctttcgtttctgcttcattccaaggccagagcaagccacgtgggcaaacccaaagccaggggacaggaaagtatcctccacccacaacgaaaccatggcaagcggtggatgcaggtacggccaatagtctatctatcccggtgagtgaggagacctgctttgagggttgcacaacctggatctgcttttacagtggtgtctgtcactatgaagactccaccatgggtcgccatcaggtcagggaccctgacaaggcaagaactgcatcttcctctgcacacagctctgctcccttccccgccatgcctaacaccaagcctagccctgagggatgactcaggaatattactgagagcattttaggccattccttcattatccccatgtgacttgttatgaaatatagactgacttcctgaagatcagcacatagtgctaagtatttggcttgtaatctgtagagactctgccatttggagctgggatctgtccccagagctgtcagacaccaaatcccgtatctactgccacccaaagggacctccagaagaaaggggttatacagggtcaaacaccaaggcaggttagtgaaatttctctagaggccatttaaagctggagtctcaccacctgaactgccctcagaggaaggctgtctagggcacaaacctagtcaggggtccacatggacttaaggacaatttttttttttttttttttttgagacagtctcattctgtcatcaaggctcgagtgcagtggtgtgaactcagctcactgcaagtctcaacctcctgggctcaggtgatcctcccacctcagcctcccgagtagcgggaaccacaggctcgtgccatgatgcccaattaattttcttttaaattttttgtagagatgaggtctccccgtgttgctcagtctaatcttgaactcctggactcaaatgatcctcctgcctctgctcctcaaagtcctgggactacaggtgtgagccaatgcacctggcctcttatgaataattttaaaaacaatgaggttcaccgtcagagcccctgctgctctaccaagtcccttggcccctctcaacagggcaaaagcaagatgagccccagatgttctgcttaatgaccacctttcccaggagactttgctctttaaaggagaaccacttagagatatgagcaaccttaaagaatgccaccagcactagtgaatgccaggcacgggccacgtgggtggagagtatactttagggcagtcactcatggtaaattatttccaccagcccccagaagtgactattcaatgtccaactatgtcaggcccaggctaataaaagtagaggcatgaggaacctagggttgttctgaagtgccttgattatggtacatgtggaagattttagagcttgttgtaaaaagtgatgacccatggccccccaggctgggtctgggattccctttgtggattacaagaggatattatacagcagtttttaaaaatgaggcagactgggacaatctatctccaagatgcataggtgctgttaagggaacaaagcaagatttagtagggcgtgtatagtatgctactgtgcgctgtgcgttatctgtacagaactgtgaggtctgatacagtagccactagccacatatggctatttacatataaatttaggttggccacagtggctcatgcctgtaatcctagcactttgggaggccaagtgggaggatagcttgaggccaatagttcaagaacaccctgggcaacatagtgaagccccttttctacaaaaaatttatttatttatttatttttattttttttgagacgggtctcactctgtcacccaggctggagtgcagtggcgcagtctcagcttattacaacatctgcctcctgggttcaagcgattatcgtgcctcagcctccaagtagctgggactacaggcacgcaccaccatacccagcaaatttttgtatttttggtagagacaaggttttgccatgttggccaggctggtcttgaactcctgacctcaggtgatctgcccgcctcagcctcccaaagtgctgagattacaggcatgagccactgcgcccaggcaaaaaatttaaaattgtaaaaatcagccaaacatggtggcattcatctgtagtcccagcaacttaggaggctgaggtgggaggatttcttgagcccaggaggtcaaggttgcagtgacctatgactgcaccactgcactccagcctggacaacagagtgaggccctgtctcaaaaaataaataaataggagtttgaggccatgttcacacatcactgcagtccagtctggtaaacagagcaagacgctgagtctttaacaaaaaaaaaaaaaattttaaagtcagctgctaagacacactagccacatatcaagtgctcaactgccccgtgtggctaatggcttccaaactggcagcacaggcaactgttttcatcactgaagttctgttggacaagaatacctctggaagcacacacgagaaactggtaatggcggttgccttccgggagggaaactgggagagtgcagggctgtatgcccttttgtacctcttgaatttcatatcatgcgtttgtactaggtgtttacaaattattttaaaaacatactgggaattaggaatccccatatggaatcactgcagtgggacactgattcccaaaaaattactttgcaatttgcctaaaacaaattaagctaatagctatcatgatttcatatttaatattttttcacagcttagagtttttttagctcctgttgctatctctctgctcttatgagctcacagggtgacaaagtgaattagtaagtagcaggagaacattaaaggaaaaactcctgggcaacagggcaaaacgccggctctacagaaaatacaaaacattagccaggcatggtggcatgcacctatggtcttagcgacttgggaggctgaggtgggaggatcgcttgagcccggaaggcggtaactcaatcccagcagaatcccagggagcgaaggtggctcatcccaaaagaaaaacaagaaggaaattctattaccagaagacaaagggatgaaatgagggatggagaatcaaagactgaagctactagggtttgtttttattaatatttaattttttcagaggcgagggtctcagtatgttgcccaggctggccttgaactcctggcctcaagcaatcctcctgcctgagccttccgagttgttgggattacagatatgagccactgcatccaactttggttcttgtttgtctgttttgttttgttttggtttgtttttttgacagagttttgctgtgccacccaggcagtgactcagcctcggctcactgcagccttgaccttctggcctcgagtgatcctcccacctcagcgccaccccccactgccctccaatatctgggactacaggtgcgcgtgaccgcacacagctaatttttaaattttttgtagagatagggtttcactatgtggctcaggctggtctccaactcctggactaagcgatctgcctgccttggccacctcccaaagtgtgagccaccatgcccacccattgaacattgaagctagactgggcaaacccttaagcctaaaccagtaacagtttttcacaagttcatagatgttactgtggttaataacacacaaattcatttaaaagcatgtgtgtccacatagtaatttttggtccttatttttatttttatttttcagttaatggatattaaagatacaactttattttgttttttttgagacagggtctcactctgtcacccaggctggagtgcagtggcatgatcagagctcattgcaacctccacctcctgggttcaagagattctcctccctcagcttcctgagtagctgggattgcaggtacatgcaaccacacctggctaatttttgtactttttgtagagatagggttttaccatgttgctcaggctggttttgaactcctgagctcaagtgatccacctgcctcggcctcccaaactgctgggattacacaagtgagccaccacacccggcctaaagatataatttctatcatgaggaggtccaagaactattctctttttctttttttaatgttagaaagggattaactgggtatgtgctgcagcaaagggaggggaaattaagcaagaagagaagggagccaggaaataaaggccccaacccaggaagcagttaagcaaagttccaggatgacccatgtgacaagtttaggggataacttgagcacatggaggacagaacttggagagggcactgtgggcctgggcgccacctgctccgccagagcactggaagagaacgagggcacgataatggcagatggcactgaaagaaaaggagagagcttgaggcacccttgggggaagcagccatcatcagagtgtattttatttttattttattatattttgagatagagtctcactctgttgcccaggctggagtgcagtggcatgatctcggctcactgcaacctccacctcccaggttcaagtgattctctgcctcagcctcccaagtagctgagactacaggggggcaccaccacacccggctaatttttgtatttttagtagagatggggtttctccatgttggccaggttggtcttgaactcccgacctcaggtgatccgcccaccttggcctcccgaagtgctgggattacaggcgtgagccaccatgcctgacctcacagcacattattaagctctgtggtgaataatatttatatagtcacaattctgtaaacactgttcattttctacaaattgtggcaaacccaaacctcaagaatggacagggctagggtgtaaaagagctaagtccttgccaggtttaccaggaaggcaacagacagtgtctaaaactatgagacagctgggcgcggtggctcacgcctgtaatcccagcactttgggaggccgaggcgggtggatcacgtgaggtcaggagtttgagatcagccttgacaacatggtgaaaccccgcgtctactaaaaatatcaaattagctgggcatggtggcaggtgcctgtaatcccagctattagggaggctgaggcaggagcattgcttgaacccaggaggcggaggttgcagtgagccaagatggcaccatgcataggttttatgccaatactacaccattttatatcaaagccttgaatatccaaggattttggtatctatgggaggtcctggaactaatcccccacagataccaaaggatgagtatacaccttttcttactttcgaattttgaaccagacagatacgctgcaattcaacaaattaaaataactgaacctacaatcaaggagaaaaatatttatccctaataactaatggaccatcttacgccgtctataaaaatatcaattaagaaatcacggccgggcacagtggctcacgtctgtaatcccagcactttgggaggccgaggcgggcaaatcacttgaggtcaggagtttaagactagcctggcaaacgtggtgaaaccccatctctactgaaaatataaacaaattagccaggcatggtgacgggcacctgtaatcccagctactcgggaggctgaggcaggagaattgcttgacccaggaggtggaggttgcagtgagccgagatcacaccacttcactccagcctgggtgacagcaagactccgcctcaaaaaacaacaacaaca

SEQ ID NO: 1284 - DNA, 170858 bp, Homo sapiens
gtgcaaacccactgcaaacccctccacatgtgtgtgcaaactcctcagtgtgtgaacccactgcaaactcctccgtgtgtgtaaacccactgcaaaccctccacgtgtgcatgtaaacccactgcaaacccctttgtgtgtgtgcaaacccactggaaacccctccactgtgtgtgcaaacccactgcaaacccctccacatgtgtgtgcaaactcctcagtgtgtgaacccactgcaaaccccagtgtgtgcaaacccactgcaaacccctccacatgtgtgtgcaaactcctccgtgtgtgtaaacccactgcaaaccccttcgtgtgtgtgcaaacccactgcaaacccctccactgtgtgtgcaaacccctccacacttccttttttgtcctgcctgctgggaaaatgagttccctaggtttagattaatgggtggaacttcttgcgtctggcccacacccagagctggctagagcaacccgggagtggagatgtgtggtttccagccggacactgtcttctctccccagctcaggattttattagcctgtgtggacaaacattttgtaggatcagtgttcccaaggaaccatctgtgacaacaccccaggttcctgggacatctctagggacccaaactcttccttttatttcactagtctgtcctatttatatacaaatgtagtcccttgtttgcacttcttccagcgggaacagactcaaacgcttcccctcaccttgggccttggttggggcctttgtgtggctctcttttgagattcttaaagatgctgtgaagggatgggcctggcttccatccccaaacagatgttcttgaccagtctatgtggaattggggtcctgtccccctcccacctcagtcctgctttgtagtccatccctgactctcagcaaatactccaaggcgtctgcacttgtgagtgaagcctgtccattagccttcccccttatccctgtggctggcttcgccttcagcggacatcagtaattgttggccatgaaacccctttgcagaaattgcatttcctccctctagtggcctgtttgcatttgagttctgtgagcccctgcttcatcacttcttacacctgcccctccagggacaggcagccagggctggggtcaccagggtcccctcttgggccctccaacagcaacagtactggcaacagctgggatttgctgagcacagactctgcagcaggctcggttgagctctctatgcctgttccttcataccatcctcacgcccatccatgagatgggtccagctgttttcagatgagaaaatggcacaggaagctggtaagtgacagtcagaaatgaatgctggcagcttagtccttggacccaccgcagtgcaggaccttgctcaacagggatcacccttgtccgccacctgttcatgaggccacccagggtttgcgtggtcatttgtctcctttcatctgctgccttcaaccagctgggtcattagggctggggaacccagaccccacacagtcctcctcccagacgccagacacagcctcacgccacagcaaggactccagtccccgaagcaaatgtccctgggcgtagaagctgcagggcccccaatccctggtgtgtactgctttgcactggtgattcaccctcattgcaaccttccctcttgccaccctaacagtgcttttggctccttaacaccccctcgcctggcacagagcagggcttggtgaggactcactggacacagcccatgtgtcctcctgccagttagcctccatcgggacttttttgaatgtctgttttttaggcccttggcctatattttctcaaggcttttgataaaatatttaaaaataattcacaaggagcctagaaactgcctggaaaaccaatttctgtcttcagttgtctctaattaatgtcttcatgttgcaagaagttccccttttttaatgctggagcatcgtgcgggggattccatggttttccccgtccccggccacctggactgggctggcttctggccgcccacccacgggcccctccgggagctgtttctgtgcgggtctcaggatggagcctgaaattcctcttcctcctgggagcctttcttctgaataaaaatgatatagtaaccaaaaaatctacgcaatagagatatggaaagtcaaggcttccctccctgaccttcagtcccatttgttagaggtaaacgttgttccatcattcatttgctcattcattcttttgttcacttggcaaatacttcttgagcatctttgattcaccaggcatgatgctaggctctgagcatactgcagtgaacaacacagccaccagtccctgtgcctcctgacattctggtgaggtttaacaggagtaaggctgggctcctggatagctttgaactgcaaagtggttgagactggctgagaatccattgaggagatgtcccactgggttgaataagagcagcaagaatttgaaccaggacagcaacttcagaaatgaaagaatgagaggagctctgtattgattcttaaaggaatgctgtaatcctactgcatgtgttagttatgtgttaattcaatctgatttcatcactttgtttgcgtttcttttctttactaacttgataaataattattggctttgaatttttacaatgcaacattgtattctcacttttagagtgtattgtgcattttatttgcatacaatggatttatatatgtgtgttcttttctgttttcaaatgaaatgggagcaagctacatttcgttattgagactgggttttggatatccttccgttctttttattgatgatctcccatgaggaacttttgtgtatttccaaggggttctgctattacaaaccatgctgatgtacttccttgtgcatacaagtggaagtatacacttgtgggagattgttttcagaataaattactaaaattgagtaatctgccacatgaaaaatgggctcaccactgttttggttacatttctttaatcatgatggcattgagcaccattttcacacttattggtaattcatatttctttttctgaaaactaactattcctgtcctttgttgatttttccatttgggtatttgtgtttttcttgttggtttgcaagagctctttgtatattaaggaaaatcacactctgattttcacacagtgttgtaaattttttttctagtttgtcatttgggagtttttaatggagtctctgctctacaaaaatagaatttagcattctgtttatggcttttatgttttgtgttttatttaggaaagattataaaataattcacttattttcatgggttctggaactatttgttttaggaaatgacctaaaaatctcaatggcacctaccattcattttctgcctaacacatagtaggggctctacatgattatctgtaattgttataattacaaggaggtgatggttttcctatttgatagttgatgaagttgaggctcagggaaggcaaagaacttacctaagcaacatagttctaagccagtggttctccaacttgagtatgcatcagaatcacttggaggacttgttaaaatacagatgtcggccgggcgcggtggctcacgcctgtaatcccagcactttgggaggccgaggcgggcggatcacgaggtcaggagatcgagaccatcctggctaacaaggtgaaaccccgtctctactaaaaatacaaaaaattagccgggcgtggcagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaatacagatgtctgggccccaccatagagtttctgattcagtaagtttattagtcttttattgctcctgcaagaagttaccataacatcagtggcttaaataacataaatctattatcttatagttctgtaggataaaaatctgacacaggtctccctgagctaaaatcaagggcttcattcctttttggaggttctcaggagagaatctacttccttgccttttccatcctctagaggctgctcgcattcctaggctggtggccccatcctccatcttcaaagccagcactgctgctctctgaacctgtttctataatctcattttgctctgcctctcttcttctgccagttttggggacccttgtgattacactgggtctgcctggatgatccaggagagtctccctcttttaaagtcaattgattagtaacttgaattccatctgcaacattaattcttcactctgtagcccaacatattcacaggtttgggggatccaattttggatacctggggagatccttattctgcctacgatagtagggctgggggaggcctgagaatctacatttctagcaagttcagaggtgaggctgatgctgctggtctggggaccacactttgagaaccattgatctaagggaggagatgggattctgtcacaggtctttttaactacagagactccagtggccacctctaccttcatctcttcctaaacaagcacacatttttcttcacctgacagcagatcaagcgcttagaaggatttaaatctctccaaagctgcctcttgggtcttggaagggaagctaccctgaagacggcccatggtgccagggaaggatcacctgagccctgcaagatttaaagaaaggaactataccaaggatgtgaacccaaaagctgtggcctccccatgtccactctgtgctaacgtctgcttctctcatgccccctaggctggcctcactgcctgacagctggtccccagctgtgcactctgaggccagcttcaggcccttggtgttcttcccactggtcctctggccacatccccagccaatagctttgggcctctgcctcttctgtctcctcttcaagcagctcccaattgccatctaaaagttatcaacccagtgtaatttctgcccctccctcgttcacagacaccccaccgtccaccaggctctctcgttttgctctctattgccaccccagggaattcacctctttactttttttaaaatccccttcattctctaaagggaaacccttagtcctggccatttcaaaagcatcacacagaagaagaccttgatatttacatttaagtcacatatgcagctactgacacttactagtgctgttatagtcctggctattattccatgaggtcgtcacattttaaccttttgcataagcctccaacggcctgatggaatgatgaagcctcagaacagtttctacacaatggctaagggatgtacccattttgaattttcctcttttctgtgatcacagaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcgctttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttggggatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttgccttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgagaaacattgtgctttttcatttaaagaccaaagtcatttgaattcgatggcaggcctttctctttctgagacctgtacgaaatggctgatattaaagcaggatcaataatgtaagcataaaattacatttgctcagtcagtcgggcccagtgctttgcctgagtgtgaaacccatttctgtgggcttgggggttgaccaggcaaggagctgggcctcagaggttccatgtcatagctggctgagtttcagctgttatctaagctgcctgagtctccttttatcataaagtagtgatggtgtcagtgtgcgaaatggtggggaggactgcatgaggattgacggacagcattgtgcccctgacggtgagcacaagtgtctgtttttgtcaccttttcctctagagaaatctagaggatctagagaaaggatcaatttgggttttactgacctcaagtttctaaagcttctaaccaagaagcctcaatcaccccgttgtgagctgacgctgccattggctcaagatcattgctggtactggggtatgtcctccaagctcatcccttgcatttgatgtggaaagcccagatcattttgacatgggtggcaaagcaccaccactttaacaaaaaagggaggctgggatcagatctctcgtaacatatgcacttatgttaagagaatttagacacattatttagagacatcccatttctcaatccaaatgtgagcaggaaactgtaggagaaggatattttccctcatttggtgtcccggaacatgactccctgaagggagccattctggggacaattggagggtgtggtatgcgtgtgcacacatgcatttgtgtgcctggtgtgcgtgtgggggttggcacctctctagaagtggaccctttgggatgtcctagcttctcctgctggtggatgaagcctttctaatggctttgctccttgctcctaggcatgagcttgaagggggataatgaagggcgtttaggaagttgctcaaggaagactgtctgaggaaactgcgtactgggctgaagaaagacaaccggaaaacactgaaggagcgctcagccactgcaccttcaaaaaggcagaaaagtcagttcagggaggtgcctcccagctaccccacccacctcaggaggggtcattccaacctagggtgctgagaatctgggtgggattaccagcaaaagctagagaaccatgggtcagcgacccttaggaagaagtggaaaggagtcttaacttacctgcaataaccttcctatgcgaagttgtggctaacgcatgcctaatggctagaattaaatgctgggaatataacgagctcagcacaggttatccgcgtgtcagatgttcctgctgtcttctacagtggggacatttcctagcctattcccaggctcctttagaagggaagtggaggtgccccatcttcacctgccgcgtcccctccagcgtctgcccgggccctgggcctgcgctccctcgcggtggcgccaggtggcggggctgcgcgccctggaggagctgcaccgccgtcgcggggctctctcagcactgaggacaccacgccctgcaaattgttgggaacttgtcggtggcaatcacactgctggctcctgcaaactggtgtgaggccctcaggggtgagaacaggattgcagaactgcgctcacccttttggaaagtcgtccagtggcagaagtagcctcccaggagcagagcgaagctgctcggtggtcccctctccaaccagggacccaagaagccgctcaagggaacacggccccgcggcgtccgggaggtcctgcaggagccctgcggctgccccggttctgtgaaatggcagtgagggtgggggagatgtgcgctaaatcctgggaacgtgcgagtcataactttccaggagaggggcccagggcgctggtcctgcagggcgtggaaccctctgctcttcctgagcaggctttgtccccgggtcgacacggggagctcagcgtgaggcccgcctgcagcgtggacgcagatcttttttatggtctgcgtttctgtattagcctcagcagcctggtgacgcctttataaaaggtcgaaacacgataaattgccaatattccacgttttatgtattccccccaaagccgacaattaacaatgactcaccgagcagcagattctttgcacacatccataattgaatcagtaaaatccatgtgttggaggatatgcaaattgcaggtcgttaacgctttagaacgacacatttctgtatcgccccgtgaagagctctacgcacatgaatgttccccgtctgtttaactgttacggccgcagtgtgtgggccgcaggcgcgctgggggctcatctgctgattttgctgcccctggagcagagggatagcgaaagcggggctgagcgcagcacggaccgatcccatcgccgcgctcgccccgcgtggaggcagccgggtgcccgaacctgaaggaggacccggtgccggaagggcccgcggaccccggcgtctcccggggcatcgagcgccatcgcccgcgttttacggccagggaaactgaggcggccgccgaggggacgcctcgcgacggttcctgggagagctggcggcggccttgctctgcgcgctcttcgcgccgccctccccgcccgcccgcctcaggattgaggaagtgcgtctgggcccggccccggcgcggggggcagacggcggtgggacggccaggccccggccccgccagtgtgtccgcccggccccgcgtcccggagcgcccgcacccggccccgccgccgcctcaggtaagcgccgctcctgccggcgccccccggcggcctggctgcctcccggccccgcccggggaacccagagcccgcgcccggcgcccgcggggagcctcggcctctgcctgcccgcgggcccctgcgctccgggcggccgcgtggtcgggcacggggggccgttgcgcaggggccgcggcccgaggggcgcggagggcgtgtggggcgaccccggtctcacgtccccgctgcctcccgccgcgcccggagcccagccagcctgtgggaggggagcgcgcggggcccgagcagggaaccccgaaaccccgtccgggcagggtcgggaaagctgggaagcggaggcaagagacacgagtcgggagacacgagccggggagcccataggtttcctctgcctttggagcgaacccagtcccttagcggggagcgggcggagtgtgagcgcgcgggtgagcccgtgccggggtgtcggcaagagaccgcccgggagcctctcgctggtccggggcttcctggggttgcggggcggcccagcgaggcttcaccctcctcgatgtctgggtcacgcttcttgcccaggtggtctctggctggcgcagatacaactgctctgtctaccatggtctctgcaagctacaggggaccttcctggcaggcagggacgcgggaaggaagcctaggaaggccggggtcagcgaggagacgctggtggagaatctgagaacccccgtggccatctcaacctaccccttcacagtatgaggccgcgaagtttttctcccacgaacacttcccctgcaacaggtagagaaacgggggcatatagctttcagcaaacctctcaccgtgtacactaatgatagagtttgccagccactcacagggtatcaaaatgcccagacattaaagggatagctagaacatgcacaattttggaaaatgttaacattaaacgccttttatgatttgattctcttcatctttgcctatgtcctgaaagagaaaataatataacaaactaacctcacacctaatttgttcctaaaggaggttttgcggtcagccaaacctttccctctcccaaaagtcgatgtctctggcagtgacctcgcagtcaactcggatcctcagataaaaaacattcagtctgttgaatctatgtctaaaatgtgtcctgatctgtcccctttttcttatgcccccaccccccaccctgccccttgtccagggtaccagcatctctttactgtaggatttcagttcccccttcctccattctctatatagcagcgtgcgtctgtgtgtgtctgtgtgtttaaatgggtaaatcagaccatatcagtcctctttatggagtccttcagtagcttctccttgcaactggcacgcaatccaggagacctccttctcctcacacccccagctgatccagcctctgctgtctcggaccaccaggccattgccccaggccacactggctgagcttgctgtccagcactggtcccctgcactgctgcctcctgactcttcacacagcctcagaaagtcttccctggtcaccctctgaaaacccacgctccctctcacatccctcactctgcagcctccctgcagtccccattctgtactccttctttatctgtttaatttctccttaattatcttgtggtctccactggagctcttggggtcagagactgatctgtcttgcttattgctgtgccctcattcccataactgtacagggagataccccgtgcatggtggtagagtgactggatggggaatggacaaccctaacttacctgtggtttcagactcatggagcatttctctcctccaccctttttgggctcatctgggattgagaacaacatatttctctggcctgcagctccaagatatttggatgcccccaaacccattaaacacattttataggcaaaagccaatgctagtaagggatgcaaatagcactcaagagatttctagaatcatgggctaaccattttgaccaggattttgtttcaaaaaggaactaggtgatatgaatgagcatgtctagcatgctttgcttgcaagggacttctaacttctaactgatatcgacagtccttcccaagcctcctaaaatatctgggcttctctgctgtcagaagctttatagcaattacttagctgtctgctcccccaccagcttcacaaactcatgaagttccctcttcatagaaagaactcaataagacatttgtagaatgaatgacaggttcttctcttttcttttctctagagtcttgctctgtcacccaggttggagtgcagtggtgcaatcttggctcactgcaacctccacctcccccagtttaagtgattctcatgcctcggcctcccaagtagctgggattacaggcgcccaccagcatgcccagctaatttttgtaattttagtagagatgggtttttaccatattggccagggtgatctcgaactcctgacctcaagtgatccactctcctcggcctcccaaagagctgggattacaagcgtgaaccaccgcacccatctattttcttttccattaaatgtttaggtttattcattaatgcaggtataaatagttggcaaaaggaaattgatgaggttttgaaaaatcatttaaaccatcattactgctgaaaacctcttgatgccctctttagggtgtataatgaagacatgtaacttgtaatcatcacttgttggcacctctctggacccaaaagaagcaggaggaagcaaagatccgtttgagggcaaagattgagcaaaatttgaattacctcatcttaaaacttctaccttagaatataagccaaaatagtaactagaattttaaaactgctccaggggcagagtcttccactggtaaagtgattttcaaaaggaaactgaaaatgaaaaggggaacaaaatgtgctgggtgagggttagcctgaaataattttaagatttttttttttttagaacttaaaaacattgtatggtaagacacttctgttttcaggaagaatgtctagcgtttggatttttgaaatgctgttggttatgtgcggtagctgttttggagaggtgtctgaaagcagatggcaactgtgcttctcagtttctggatgtgaatgtgtgatcggaacgtttattttaaaacagattctgtcttgctggctcttcctctctctgtcacaagttgattttccaaatcaggttttgctatttataaggctttcatcatcccctaaattttgcccagattgatcgtttttcctttcctccttcgacttttcaggcttcccaacttcaaacacaggtgtttcccacacgtggtttgtgtcgaccatcccttttgcctctgaaacatgtgcagcttgcacaaggctgctggagcctggcttttctagctccacctttccctgccttgacgagtccagtccacctgggccaggtgcctgagttctaggcttttaggtgagaaattcccacagccttgtcctgtaccttacttcgtgcccctactgctcacggcatcttctagaacctacccgctggtgaggctggcatctgccctccagcattgatattctgatcttattaattagcagggaagtgggagacccgctggcctccaagtctgtgcgctggtactacaggtaatgaccaccccagccctgtcgtagagagaggctgcagaaacttcactttggttgaattcacacagtaaccccactagcaggcccgggcataagggtggatgtctatttttaacaggtgaaaactgagacacacatacctttcagctgggagtcacactgcgaacatgtgacacaggcagtccacacctttaacgtccacgctatgcttttgcctgtacagattctcttaggcattatttttatataaccttgatttaaaaaatatatttttggctgcactatcactccccatttcagagttgtctatctgagagaacacagacaagaggtgctaattacctcgtacttcatcacatgtaggatatgctataagaacaaggataggcgcacatgcattacttatggtagtacctcatgtcaggcctgagctaggcatgggtcttaccctccctctggtccttcaatcaccataccaggatgggcacttatgcccatggggggactctaagctcagtgggggcccagcatagaagagcagcacttggtctcagtttatcatagtcattagtttcagagattagtctaactccaccctggaacttttggggccagataattctttgttgcaaatagcagtcctgtacattgtaggatgtttagcagcatcattgacctctacccattagaggcctgtagcactctcccccagccaagttgtggcaaccaaaaatgtctccagacattgccaaatgtcccctgggaaaggggcagaatttttgaggctcatgtctgctaacctccgtcatttagctttctgctaaagctcatgctaacttgacttcataaccagtaataattccatgtctttggaactgttgcctgaccacccccttgggatgacgtgctcacctctggcttccagaagaactggccccgggcaaaaggagagccttgtatcgtgactaaccttaactatgtctgccctacccccactggagtgtgcccctgagggcaagagcctccttgagccatcttggtgccactgagcctcacacagagcctggctaccttgcatgtgacagtaggtgtgcgttgactgaacaatgattgaagctgttaccagtatgtgttttccaattgtctggggtttgtttgagactcttctcaggtagacaatacctgagccccgcatcaagatgggatggggggagctgtgccttcccactgaccacacctgatgggtttggctggatagatggactacaaaaaggaatgttgcagagggaaaactaaatgaacccatgcaaatatttgcaggggaggaggacaggaattataaaggctttctgttttgattgtttttcgccaccagagcaagaaagctttctgctcagccatggctacgagtccacgccttaatgcaccccacagccagcggcagtggcagtgacaacagcgggacctgcctttgaagatcggctgctgcaagggttgatggctggcatgtcgcaaagaccccccagcatgtactggtgtgtggggccggaggagtcagctgtgtgtccagaacgtgccatggagacgcttaacggtaaggacagggctgtgcttatgcctgcctgggtgtgacctgccatgctcatcctgcagggtgtctaggctatgtaagaacaaggagttctcaaccagtggaaatcaaatgtccatcatttggtgctctttcatcatataatatatcttgggactcttaaattctaaaaattgaggaacagtgtacaaaatttattgtggactcacagatcttaacaattgggacatcacttcatgctgggttaaagaacttttaagaaaaaggatgtagttttgttttttcattataaaaataatacatgtttattaaggaaaaattgaaaaaaataatttaaaaaaaaggaagaagggaaaggaatcatccagaatcccgctatctcaaacacaagtacaatgagcatcttggcatgttctctcctagtctctgcttctctgtgtttaggggactttgttttaaccttattgtacttacaaggtgtatgtaatgttgcatgttgcttttttctcttcaccgtccatcagtgacatttgcttagggcaccacctggctcccgcaatcaagtgaaacatcatttcatttattttattttatttttttacgatttaataattggatcaaaaaatgattcataaattgggcagtactccgaaccaaaacaaacatcattatctgcgggagtgctatgtgcagttattgacctaatccttattctcctgtgggacatttgggttgcttctagttgtttactcctactgagagcatttccttcccatctcttcatacctggtttcaaggttatttctgtaatgcaggtttacagaagttgaatgattggtcttgaacatcgttaagctcttggcacgtattttgccagattttccgctacacttgcaccacctttaagaccaataggatatcatcgtttacaaatatttgtcaatcccttagtatgtaccaggcactacatgtacaaagttcagaactttacgaaataatgtcataaaatcctcacgacaacctggcacatggtacttttatttccgttttatagctgaggaacatgagggtaagagaagcctggaaacgtgttcaaggtcaacaactcagaaatcacagaattgccatctgaaccctgtcttaatgctgcaacactcattcttaaatgctaggccacactatgggaggtgaaagggtcaacaggttgggtctgagaggcccacgtttgtacccttaaccgtgttaactaacgatcggccactgtacctggcttggcagacactttgttcagttgtttgagtgttttcactccatctgaaatgtccagcagctgaccagggtgatgtttctggaaggtgtcgtttcacatccatcacattatgaaatgggaaacgaatttgcttcttgacattgcccagcactaaatctttccagagtgttcaacttgcatctttgtaaattttctttttctttgtattagacgtgtgtcttttttcagttgtgtggtaggaagaccttgctctgttggtgtgagatcgaggtggcgtgggtgatagaacgcagtccccgatttgggggtagcacctccacctttccagtgcacgtgaggctcccttatcctcctgctgctcctcttcgcagccctgagggacgagggtggggacagggaccttgggtctgtttggggcctgtagggtaggtgactgtgtcatctgaaaaagcccacaggaggcgctgctccctcccctcctggtcaacagttggtgatctaaaggagtgcttctcaaccacggcccacacagtcactgggtagtggctcaaaccggcagggccctggcaccacctggacccactggagcagcatcttggggcaggggggcggggagtgaacaagcatgggtaattttttctttttcattttctttctttcttttctttttcttttctttttttcttttttttttttttttttttttgagacagtgtcttgctctgtcacccaggctggagtgcagtagcatgacctcagctcactgcaacttccacctcccaggttcaagtgattctcctgcctcagcctcctgagtagctggtactacaggcgtgcgccaccacgcccagctaatttttgtatttttagtagagacgaagtttcaccatgttggccaggctggtctagaattcctgacctcaagtgatccacccacctcagcctcccaaaggggtgggattacaggtgtgagccacggcgcccggccagcatggctaatttttcaaagttccctagtgattctaacgtgtagctaaagttgagaatcaggccatctaaatggtttgagtcccatagagcagcacttctcaaattatcaggtgcacatgtcccctggggatcctgatgaaatgcagaatctcattcaggaggcctggggcacagacagcctgcgtttctaggtccccagggatcccccgttgattcttacaggtcccagggaccggggcgcaatgggctttggacaaacccatccccacctccaagctcgtggcaggacagataaccagaaaatgttaaggtgttccgaaaggccaaagtgtggcactccccagcccccatgattctccctaaaggcctgcatctgagcttggcactgctccttaggaggtgtcctctcctgactctgctctgatggcctctttccccagtgggatctcaggaatccctgctatccctgttctgtataacccaagggacacacacaagggccaaggaccctgacgtgacctcagcagccttcactgtgtactgttcaaggagcttgaagtagggacaggacagggaagtgacaccctgggaacccctgagaatgagggaggtgtttgtgcagtgacctaatacagagaacacagagttgaagaggagaggaagatagcctgaaacaccccagaaagttctgtcccctgtttagcattaagaaaattatgttacatgttaatgaattacaataataaccaaatcctcataaggaatctggtgagaagctactaatttatacccatactcagagttttaaggtcccacaggtggtaccagcagaactgagcctgtgagccccagccctggagctcactaacagaagttattaattccagggactaaagcctacagtgctccctctgtaaagcccaattttaacgcattgcatgttggatttcattttcgcagaatatattaataaatgtgtacactaagactacagccaaggagcaggtaatgctcaaagggtggcgtgtggccacgtctgtgtgctgggattgcagtcactgtgctttgctcatcggtgctgtttatgtttcctgcaatatctacacattgctttttgttttgttttgccttcttttgcatccagacgaataatattgcaagttatttttaaattattgtttatttaagtactgatgatttgtgtttagaatctaaacggtaaacctcctgtgcttacatccaaagttagatctgcctccactggcctctttgccttgaagtctttctggaataaatgcggaatacttgacttactatgactgcagctgatccccccgcaggactcaccctctgcacatgtccccagagcctaagctggatttgtcccatcccaccttctcctagacttcctgggatgatagggagccctgtttcccctctcccaccccccaaatccaccagcctcactcagggaacactgttcaggcctaatttccagctccggctgagaaaagttggccgccagaaggaaaactaacgacactcaaaattatgtagggacagctttctcatgctttaaaaatccttggaagataacgtgattgaaaacgacgacgttcttattatacttccacgtgtgcgttagaaaaagacccacactttaaaaaagagtgtctactcttgggtgttggggtaatggtatttttaattttttatttgtgtactaggcacgccttttcacaccccctacctgttgtgacttgcgtgacctcagctcatgtttgtttacaatggttaatcctttcaaagcccctggatgtggggggctttgcccagctggtgtgaggctggggtctgtgtgtgtctgccctgccgtgcggcccgctgtgtgtttgtgcaacacaattgtgtcccaggaaggtgtgtgacaatctcaacctcattagcaccagcagcagtcagctcgcctgcggtgcaagaggaatggttggaaagctttgatgggcgtagagtttgccagctgacagagcagctgtcaatgagatgctgggcatgggctgcaggacgcgcattactttgacaaacatgtcattagatgttcattcttctgagtatgtctgacaccagccagagtggaaaaaccagtcccgccagccaaggagagctgtcctggaaagtagagaagtcaggaaacttccacataattcaggtggagaatacttgggaagacttctggattgcggagggtgggtggaacttgagcagacatcacccaggcagtggctcgcccccccagctctctgtgagtggccgtcgcttcggtcctgaaagccctgccacagtcacacacctctcagagcactgcccaccaccggacccagcatggaccaaaggaggagaaggaacattccagaagttcttcaaatcccaggttgtttcatggctacttccaatgtcttgtttttttctcctttggcttttgcgaatctgtatttgaaatacaactccttaatataggagctaagaggtttgctcaagtagggtctcttcctgccttccagaaatagaactaggaaatagatcaaattaggaagagcctctagggtggcagccagccttcttgtcaggccacagcaggaaagtctacgagggacagatccccagtgatgagccagcccacatctctgacctgttcctcctgttggattcctgcctgaacgtgctgggctgtgttcacaccgtgagagccacaggaaacagggcaggcagggccttgcagggaaggagattccagcctggctgcaggagttcaccagcccctccagggagcacagccacgtctggtcaggaatcttttaatgagtgaggagaaggacagggaagctgattggtggcccaggtggcaggcgaggtggctgtgtgcgtccatccatgcaggtggcagttagcacagctgtgcttcatgcttacaaagcagaggccagctacagatgctccaggcccttgatgagcctttgaacattcgttttaacctgaggcttagatcttctcctggttacttgtctggaatgtgcttgcttacttctagcaatggggagctgactccctagcaaacaacgccagcctttctgtgggcagctctggtaggaagtggatgctgtggggctctctttgcaccaggctttattcatttagacagatcggaatcccttaacccatttcttggagtcactaaaagcagatgtgttgccctccctgcagattcctttttaggctgagtaagccatcccacggacaggccgccggcaactttacacgttccgcttggatatccaagagttttttgacttctcagtctgtctgtgggctaattattaggccatacacacctgggtccacagggagagctgcccctacctgcttccccaccctgccgtggaccggctttcaggagcacccccactgatccaccccatcctaggtggcccaagcctgaatgtggtagctcaccagagccccagtcctcaccccctccctggcctcccccaccccacacttgctcctgacttggcctcctttatgtggggtgtgcagggcagccctatctggtggcctctgtgcttgctagggagcagcccaggctcacttggcatgcattcagccaccaagagagaagattttcttaccagccatctgccctggcccccatgaagagatcagtagcctgagagcagggagatgtccatgtgggcctccccaggcccctgtgcagagcgacaaggattttcacccctcctggtttgcctgagtcagactttgaaggagccatcactagggatttttatgaaattctttagttctctgggaatggagccctcccaccactcccaatgccatgtaagtctaaacttgagtgtgtgaattgcacgcacatttttggaaagtttgatgaatgaaaataagaagctgctattattctttggaagtcccaattctgagtcccttcactattcaggccacccttgggttcagtttgtccagattccacttagccatcttgctacttattgggtgacatttgtcataaaaaagaaacgagaaaaccgaacagaaacacatatctcaagcaatagagtccttcctgagctcatcacccccatgctgcacaaagaagcacacattaatcagaacttgtattttcaactgtaaagaacttttgaggattgcagttccttttgctaatgctgctggggttgtgcctggcgacatcctctcatcctccattcaacatccagcacccaggggccgtggcacattgccaaatgttggcttaaaatcacctacctggtcgtttcaggagaaccgagaacaaaaataacttacgtgacactttgaacttttcagtgactcagagatatttaaaggcagagaacatcttaatcgattattttaaatatgaagccatgttacgatgcaaatttgaggttagaaattgaatgtaagtggacaggaatggctctctgaagttcctgttagcagcttagtttggacttgacacagccgtgtgaactcagagaggcaagtgggtggtcacaggtggcccacacctgcagggttagagatggaaggttcagggcctcgatctgctggtggggctggcgcgggaggccagggcagggctcctccagtcattctgcccccaccccagcttccaggcaaaaatggctccagtgggccgtcactccagtctctgtgcaaccttcaccagcacccacgggttcaaaaataagaagcaagcgaagaaccgctgcctgacagtgcactatgagcattctcctggtgcctgactcctccctgaaggttaagaaaaaagttatttatatggaattccacaattcacacagtggattgacatgataagagaaagccacagttattcttggccccctttccatcatgcccatgggtaatcactgttagctgagtgtgttttctttttgtttgtttgtttgttttgagacggagtttcattcttgtcattcaggctggagtgcaatggcgcaacctcggctcactgcaacctccacctccagggttcaagcgattctcctgcctcagcctcctgagtagctgggattacaggcactcgccaccacgcccagcaaatttttgtatttttagtagagatggtgtttcaccatgttggccgggctggtctggaactcctgacctcaagtgatccactcgtctcggcctcccaaagtgctgagattacaggcgtgagccacagcacctggcctgagtgtgttttcttcctaacctcttccaaagcacatgtatggttatctttgtatatatttctggttttacatgcatattcagttgtacatactattgtacaacttttttcccttgaggatgtctcagagttccctctatatgcaccacatctggtgtgaatccaaccatctttcatcaatgtcttattaaagggtctttagattctttctaccttttgcttctaagagttgaatattactgcatatgccccagcagaatggcgggatcacagaacaagcacattaaaaattatcaaaggaaggcatacccctggttaatgaaggctgtcagacagaagggactataatataggaaaagcaacaaggccctgccccagtgtcaacttcccaaaagagttgttatttcctgtttctggttttagttcttcaggtaattatcatttctcaatgtaaagaagatgcctgcacctctctattgctgatccgttgaaacagtgcctgttgacttcctgccataataaatgaatatttccttcccttttgcaccccatctatctgctgctccctctgcatttcattcttttggggctgactcatccctaggttacatttgtgactttaaatgacatgttcccttcgtgatgacgagtgcctggagacccagtgttctgtggagccctggagatgagaatcacccccttccctgctacctccatcggcctcccgcctcccacccaggactcttactttgcacctttatttaattggaatgcatcagcaagaaaatgcctaagaaaggcctcctgggaggctcctgcaggagactctgtgttcctgagggcatctttattttgccctctcctgcgatctcaattggaatcctctgcctttggaaccttctcccttgtcctctgatgtggtgtgattctcactgccctgtggtgacctggttttccctttcagaagctttcagaatcttccctgtgtgcttggtcttccaaaattttccaacgaaagacctgggtgagggtcctcttccattcctgctgcttggcactgggtgggccaagcatgtatccctttcatgcatgggacatttcttgtattttctttgataatatttttctcttctgctttcgctatagttttgttttgtttgtttttctggaactcctattaattaagatacaggttgcttatcttttcgctcacattttccaactgttgttctttttcttaatgtttataaacttttgaccaggtccagtaacacactggtaatcacagctctttgagaggctgaggtgggcagatcacttgaagtcaggagttccagaccagcctggccaacgtggcgaaaccccgtctttactaaaaatacaaaaattagccgggtatggtggcacacacctgtagtcccagctactcaggaggctgaggcatgagaatcgcttgaacctgggaagcagaggttgcagtgagctgagatcacaccactccactccagcctgggccacagtgccagactccatctcaaaaaaaaaaaaaaaaaaaaaaaaaaaaaaaagatttgcttgacttcatcttctaacctgtctattgaacatttcattttggaactcagtcttaatttccaaaactctttcctgttcttggttgtttattttcatagcgttgtgctcctgtgttttgtacacagtattttcttgaatttcccagaggatcctaattgccatttattttattttattttggtgtcagtcttatcttctcagttaatttttatttatttatttaagatgtcaaaatcatgtattgaaaccaatattttacagtgaattccagacaaatcaataattatatgattcaaagcattattagggaaatttgcagtcagctgactttataggcaaagaatgtctataaattacatagaaagcaacttcctaggatactaagtcagtgaaaatgctggcagaaaaatatttttcactggcacttatttttgaagttctttttaatgacctctgcattctctacatttcttctaagccccagctttgtgtttgtctttattaattcagcatgattatttcaaccattcttaggcatccacttgtggaggacactgttccagatgctggggacacagcaggagtgtggcctctgcccttacagggcttccagttgtagcaggaaaagtagacagcaaagaacaagagagctgagcaaggtagctcatgcctgtaatcccagcactctgggaggccaagcaagtggatcacttgacttcaggagtttgagaccagcctggccaacatggcaaaaccccatctctacaaaaaaaaaaaaaaaaaaaaaaaaaattagccggtcgtggaggcacacacctgtggtcccagctacttgggggtgctgaggtgggaggattgtttgagcctaggaggcagagactgcagtgagcagagatcacaccactgcatttcagcctgggtgacacagcaagaaactgtctcaaaaaaaaaaaaaaaaaaaaggaaggaagaagaaaaccagagagtgatgctcaatgaagcattagagtaagatcatgtacaaaagaggcacagtgtggccattttgatttattattaggtaagacattgatgttgaatctcaggtctgctcagttgaccagaaggaggcagccacaggaaggctgggaagaagagggtttattgaacatactgaaaataacagagaatgatctgctcagccctccctcttgtgcctggtcttagtcctacactccaggctatgtcagagcctgctatggtcagggctctgggaagccaggaaaatgtcctcatgatgtttctattccagcaggggaaacacagtaaataaacctgcactctactgtcaggagtgaacagggccatgacagaaatcaaccaggttgcagggatggagagtgacaggcatagggcactactgctggtcagagatcagggaaggtgtctggggggaggtggcatttacacagaatgaagtgaatggaatcaggtcagtcctgtaaaggagctggggaaatggtgctcctggcaaggcatcagtgagtgcaaaggctgggcagcgggaatgagctcggtaggtttgactgaccgcaagatggcctgtgcagttggggcagagtgagagaagcaccaaatggggctggagaggtaaagccttcacagcaggagtgtagattttgttccaaggctgatggacacatctgaggagctgcatggttttatttagggaattagaaggctattgccagagccctggagagaaggcaccaggagggccaggatggtggggtagcagtgggaggaagagaatgcactgggaataggtctcaaaataaagctatcaggacttgtgtgggtatccacacacaagtatgtaacaaaccaccctatcacttgctggcttaaaagaacaacgaatgatcatttcccaggtttctgtgggtcaggaatctaggcagggcccagctggtggttcttcttgcttcactcccatgtctggcccctccgtgctcctccacatgacttctctctcttccacacaccttctcatccaccgcatgtctagcccaagcttctttacagcctactgccgaattcttggagtttagcagcagaagcctctaggcctcccaaggcataggcctagacctggtacagcatcacttcggccactacctgtgggtcaaaacaagtcaaaggccagtccagatttaggccggcacaggaaatagactctacctcctggtgagaggagcaggctttgatacgggttaggtgagtgacgagtaaaggaaggagggatcaaagatgtacccatcactcagatttaaccaacattcgttattttgtcatttttgctacaaagaaaatattttaagaagtcaaaccttacaggtacagccagaacgcctttggatctctccctgatcactgctctccttcaactccaggggtagccattattctgaagttagtctgaaccctttatggctgtatgtgtgtgtgtgtctgtaaatacatggtatcatttctgccttgccaggtggattccccctgggctaccatctattgcgcaggggttggcatgaactccacaatgtcatccactgagattagggaataggctttattaagagaaagaaaatcacaaagcctgaatctgcaagatggcatggcatgtggcccccagcctctcctttaacaagaagctatgccagggcatctactggatagggctggatggggctgggttctactccagccaagggtccagcctgggtcttccctctcagagcccagcctgtcaatagcatgctagctgtgggtgctggctgcttctatggggcaacttggggtctgtgggatgtgcagtcctctatgatgagccactagacccatgggaaactgagcttgggtgctatcacttcagctgggagaaggaggcatctcagctggctcattgtccagctgtggtagggatggggtaaccagagtcctgttttgtcaatcctgctcctttcagaacagtttccatactaaaaatgttggattaaatattttcatactatgccagtctttttgcatcttgcttcttcaaccaacataagtttgataatataagtatgtcctatattttccaagaagcagaatacatcactttgcctataaaaccatacaggcctggtgctttttaatgggtagatgtctcactattgattctctgtctttaaaggttataggtttatgtaaatgttctatttcttcttgagttattttatgcaatacaatttttagatagttatccatttaatctagattttcgaatattttagcatgaagttgataatggttcaggattttaaaatatatttttaaactatcttattcatttttaatagatgaatcatatacttacacacaatttaaaagaagtacaaaagggaatacaataaaaagtacccattcccgccccctacccaaacttactaccaattgccgtctcttccaaagaatcagggctactatttagttccccttttttattggcctcagaaaccacagtttttaggcctggactcaaaatggcacatttttctcttttcataagtctttagctacgtggaactttaaaatgttatatttttgtcttagatttctttttttaaaatgtttatttatttatttattattttattttatttatttattttgaggcggagtctcactctgtcccccaggctggagtgcagtggcgcgatctcagctcactgcaagctctgcctcccaggttgatgccattctcctgcctccacctcccaagcagctgggactacaggcgcccgccaccacgcccggctaatttttttgtatttttagtagagacggggtttcaccgtgttagccaggatggtctcgatctcctgacctcgtgatccgcccgtctcggcctcccaaagtgctgggattaccggcgtgagccactgcgcccagcctatttatttctttatttatttacttacttacttagagacagggtctcactctgtcacccaagcaggagtgcagtggcgacctctcggctcactacagccttgacagcctgggctttagcgatcctcctacctcatcctcctaagtagctgggactacaggcgcacaccaccatgcttggctaatttttgtattttttttttttttgtagagatgggggttcaccatgttgcccaggttggtctcgaactcctgagctcaagcaatccacttgcctcagcctcccaaggtgctgggattacagatgtgagccaccacacccggccactttttaaaattttttattacagaaacttttgaacacagtacacaagtagagagaatattaaaatgcacccctttgtacccattacccaatttcagtaattatcacacatgggcaatcttttttttaaccctcttgtttttagttgacatgtaataattgtgcttgtctatgggatacagagtgatacttggatacatgtatacaatgtgtaatgatcaaataaggataattagcatatctatcaccgcaaacatttttcatttcttggtgttgggaacatgcaaaagccactcttctagctttttgaaaacagaccacaaactattgttaactcgattccccctccagtgctctggtgcactggaacttactcctcccatgcaggtaacccaccttctgccatcctccctccttcccccacatggccaatctgcatccatgtaaacccccttctctctctttccagatgatttagaacccaattccatacttatagcttaagaagtctagaaaagaaaaaacaaaatacatttaacatacgtttaaatgtatgtttaaaagtgtatgttaatgtatgcccacaatagcatgctgttgacaggctaggcttctgagaggggagacccaggctggacccttggctggagagggccgggtgtggtggctcatgcctgtaatcctaggactttaggaggctgaggtgggtggatcacctgaggtcaggagtttgggaccaacctgactaacatggagaaaccccatctctactaaaaatacaaaaaactagcgaggcatggtggcgggcacctgtaatcccagctactcgggagactgagacaggagaatcgcttgaacccaggagatggacgttacagtgagcccagatcatgccattgcactccagcctgggcaacaagagtgaaactccatctcaaaataaataaaaaagtcaaaatatcaaatatctagtcagtgttcaaatgtcctgcattgtctctgtttttatcactggtttgtttggggcaggtttgttgagtcagtgcccttgcatgctgggacatgggacagtacagttcctaagtctcttaatttctatctttctccctcaatttctttttcattgcagtttcttttgttgataaagccatattgtttgtcctttgcaattttccacagtctggatttttggcaattgcatttctatgtgtggcctgacatgttcccaccttccctatgtttttgtagatccagaggcctgattagatttagtaagatgttttggcaaaaatgcccaatagatggtgggttcttcctcctgcatcacctagtcacagaatgtctaattgtctctctctgatgtttagagttttttaatgattttcagtggtgtcagcgcaatcactctttataaacgtcctaatggtttttcgacttttcacacaatggttttatcagtcattgatggttgcttagatcaattatttaatttgaggttgcaaagtggtgttattttaagtctatcttaccttcttcatttatcagctgaaagtgatctctaaagaagaaatttcttccattaactctgtggtaccctgagttacagtttgtacagcaaagtcggggtaaatagttgggtttttttctcttagttttcttattcattctactgaaaataagtcaattccctagcaccttttgaaggcggccaatgaaggtggggttttttttccttagtatcattatgaactcatgaattttaatttatttgattcttgatgctaacgctgttcctcttttgccagtaggccccctgagtaggttcctctatcttttggcatgaccccagaagtctttgataacttccttgctttctgatgtgacaagacatccagggccagattgtccatatcctgccccggatgcacgatgcactgtttctccaagaatccctgtgtcctttgctgatgatgccatgattttaagttctctaatatagttttatctctttgtttcagataatgcttttgtgttctcacatgtcctgctctctctctctctctcattttgttgttgatcagtctttccataagattgtttatttcactagtccttcattcttcttttttctaaatttactcttcttgactagtatcctgtcacttctgaggactcatatttttgcaacttgaaaattattcttatttatttaagtatatgtttctgaaactctcattagacacattttgaaaaacttcaaaaaatatcttcaatgtctctcactcttttatctctgctcccggcctccttgtcttttggtgctgcatcctcctcttggtcttccagattcctgatttgtccttcaacggtgtctctgctctgcagctcacccactgtgcttcacagtgcaactcttctcgttttaattcccaagagttttagttgattcttgtttgtggatgctgcatcctcctgtttctctccaagacatcagtaatatttattctgaattcattctcgctctgctaacattaattctgtgtagagaggggccctggaggtgctggaaagctggagcctgagattctgcttagggaagctcccatgctaactcagtcttttcctccaagataaggatgaacagttgacaataccaagctgtgttgtgaatcaggaaagcccaaagctgtcttatctcagtgactgtgtgatttgtgtaggtttgccccgaacagtaatgtgaggatgcagcaagatgtgcaggccctctgacctggctagaccctgccttgcagagacattgtcactgtcagctgctcacttcctcctggggactctgaggcccaagggggacagtggtgaaatatgacacagcttctcccctaggtgatcagactgcttccaatgagcctgtgcccttggctacataaagaggaaacataaatattttctgtgtgtgtgtgtctgtgtgtgtctctttgtatgtgtgtctgtgtgtctgcatatctatgtgtgtgtctgtgtgtctttgtgcatgtgtgtttctgtgtgtgtctgtatgtgtctgtgtgtgtgtctgtgtgtgtctgtctgtgtgtgtgtctgtgtctctgtgtgtgtccgtgtgtgtgtctgtgtgtgtctatgtgtgtgtgtctgtgtgtgtgtgtctgtgtctctgtgtgtgtctttgtgtgtgtgtgtgtgtgcctgtatgtgtgtgtctgtgtctctgtgtgtgtctgtgtgtgtctctgtgtgtgtgtgtgtctgtgtgtgtgtgtgtgtctgtgtgtgtctatgtctctgtgtgtgtgtgtgtgtgtgtgtgtgtgtgtgtgtgtgtaaggtgggatgtctcttcctgctgatcggtggcctgcctgtgtgctggcttggttagaggagtttcgtgcttctctttatggcgctgctcttcctcagatgcttgcgggtgcctgggtggatgctgactgttctgctcgggattccccgtagctgtctgtgaacacagcatttgtcacaatagcctgcgaagaggagggccaggggactgtagcaggctgccttggggacatccagagcatggcttccgggtggtgggctccgtgtgcctcctgggagttgcccagcacactttctctttagcccacatcgagtgtagacccatcagtcccaggctgcctggcacaagctggagaggggccagatccacaggagtctgcccactatggctccccactcctcccagtcgccctgctggtgacctggggaccctcttgcttcccatgtcccccagcagcctcggagctctcccaagccttctccacctcacgcacagtggattccggtcttctcaggtcacttcttttcccatgctaataaggcttgttgatatttgtaataatttctaaggatttggagcaggaggtggtggctgcagccgggctcagcctactgtcttgatctcatcttccagcgtctcctgggcatctccaaggtgtgcacttgcaggaaatactgagtgagaatgtcaagaaccggctctacagtcggaaggaaccgggttcaaatcctgatgcttccacagctagtcctatctgtgacaggggcagggttagaatctgtttgcggaatggttagcaccatactaagtgcacatgctaggcagaccctcaaaaaaaatggcctgttctttttctctttctctgttgggcaaattatgtagcctcaactggactctatttctattagggaaaatgataataatattacaatgattaaaaagtagggtccttacaaaatggtgagtccgattttatttggctctaagctagagaaggcatggctcacagttatggaagacatggatttaaaatgtggccagtcttcatttccaaatgtgtgtacacgaaagtgtgatgaccctcaaatctaatcatcaaaattaaagctgtttaattaacattttaaattaaaatgtttcaattaaagtccaaatctttccttgccttatcttcagaatgctttttcttttcttttttttccaaattacaaaacctgtatgtctcactgaagaaaactggtacagtgtgaagttcgacaattcacggagtaagcaaggctgacgatgggtgcccggagtccccctctggttctgttggtagcagccttgggtcctcatgaggcctctctgctcacagtgggcgggtggggtgtgcactcacccggagacggcctccatgtccatgctgaacaactcccagggttctccatccgccagtgcttactgatcaacccgtagtgctggccatcccttttcaacaagtttggaaggtgcttttttcccggttttcacagagtaactcagaagtgacttaataaaaatatgcacaaactgtcttggtatgttccaaattgggatcttatataaagactcctgggcctaaggcaacagtctatgtaaagtgaattatttcactttcttaaaatagggacaagatggcctgcctttccttcaagtgtaattttaatctttctgttttactccaagggggtgtaacagcttgctgagtcattgttttctgcctttttaataaaaattaattcagtgatttagagtggaaattctgccccctcccttgggcaagtcactgactctctggggacctctttctttatctgtaagcagagctaatactagcatctgatggggttaaatgaattaacctaagtgtttcctttgaatatttactcactgcctttacaaaataatgtttctattctcactttctcccccaaatttctacaaaacaacaaatttctatctttgttgttattgccatatgatttctaaaaatttaaataaacaagcagtagctttaggaagttacaaagataaactatcagaaacttactgaattggatcttagataatgtccctttttacttggttctttttttttttttaagctaaaaataagtttagttcctcctcagttcttggcatttttgtgatcatttgtttgcaagtgatcgtatcttttttttttttttgtcactcaggcaggagtgcgatggtgtgatctcggctcactgcaacatccgcctcctgggttcaagcgattctcctgcctcagcctcccaagcagctgggattacaggcgcccaccagtatgcccagctaatttttgtatttttggtagagacagggtttcaccatgttagtcaggctggtctcgaactcctgacctcaggtgacctgcccacctcggcctcccaaagtgctgggattacaggtgtgagccaccacacccggtcgtgatcccttatcttaaatgttcagcctccagccattcataatgaatgccttgaacacaggtcagagaaaaatcatgaagcggggctgttagtgaggtttgggtgggcatggggcctcacagtggggcccagacattctcagagtgtttcagttgctgaggaatcatggagcttcttgctttaatatcaggatattgctcatgaaaaaaaggaggagacctattgttgttcagccagagcttgtactaaatggaagtagtttgcaccatacacaagcaggcttctccatccaggaaaaagatctgtgactgcaacaaccacagcgcagcattgatctaactcagctatgcaccaaaaacccagctgcagagcagtgcagcacccaggaaatgttaactctcgctgcagactgaggatcttctcagagtttgtatcttaggtcgaaggggtggggtaggcaagctttcacttctgttcagcattatcttttacaaggatgggtttgtggcatttgctttaacctttcggaggctacactgtaatcactcactgggttcacctcaaatcctcacatgatagacaccagcctacaattctaccagctacggaggactcctgatcttggcttttttgcttctattttgtgtgcttgcttttgtgtttggaaggcagatggcagtcctagtattgagacaaatcagctggagtcaatttctgttgtttgaacttgagggtatatatctcagcctggaagacatgcagaggaaaaggaagaaaacatgacctcatatttgttcccttgccaatatgttaaaactttagttgtttgaaaatgtcatacggtcttatggttcaaaaatcataagtatcgatctacaatcctgagattcttacatccttccagaatcttttttataagtaaagaagcaaaacaaagatagagtctgatttttcccctcttttacacaaaatgtagctgatcgcagatgctgttctgtgccttgcctgtttctttcacacattaagggtgtcattggcctccttttagtcaactgcatagtgttctgtgacatggatgcaactcagttatacaggcggtctcctcttcacgggcatttgggcgattcctaacatgtgctgtaacaaataatgccagatgtctgttcccatgtatagaagctcatctatacaacacattcccaaagtgatgggtcacggggcatatatgcttcgaaaaatctgacagatgttgctaagcagcccttcaggagagtttttcctgtttatgccccaatccctgaaaacatgtgtgcgtgtctgtttcccagtggctgacaagtatttattaccaaatgtttgctttttcctaatgtgatatgtgaaaaatggtacctcagcctagttagaatatgcacttctcttacgatgagtgtgaccaagcatgttttagcatgcgtaagaagtagctatatttacttttttaaaaactatctctgcagagcctctttttttttttttttttttttttttttttttgacagagtcttgctctgtcactcaggctggagtgcaatggcacaacctcggctcactgcaacctccgcctcctgggttcaaatgattatcctgcctcagcctcccgagtagctgggatcacaggcgcccaccaacacactggctaatttttgtatttttagaaaagaaggggtttcaccatgttggccaggctggtctcaaactcctaatctcaggtgatccacctgcctcggcttcccaaagtgctgggattacaggcatgagccacagtgcccagccttcatattctttattaatcaatttttgaggaactctgattttccttatcaatttctaggcgctgttagtgtcggcacggtatctattcgttgttaacctataattagatgctctatcaagatctatctaagaacacagaaaactgaaatgaaaactttgaatattcaaagaggctatagaggaaatacgctgcttttttctcttaattattaaatgaatatgttaaatataaaatacttaggggaaatagcggtaaatatatcaggcctacctaagaacaccttaaactcttgacataaaggatatttgagtaagaaaaataacatatcatcttcttgtgtaggaggacttaatattgtaaatatatcaattctccacaaattgatcctatcatttaatgcattctcaattagaatacaaacaggatttctttttggaacatggaaaaagtataataaattttacctagagaaataaacctatgagaatacaggaaagttcaggtggggaggggatggggtgagaggaggggaggagattagttgcagcgtatgctaaaatttattccaatgccaccataatgactggggttggagactagcgagacaatgcacagagaaagcaatggaacagtgtggcaatctgaaaataggccaaaatgcacattgattttgccttgctagttagaattataattagtccaggaaaggtttatttgggaatagcataggggtaacatattgctttctcactcccactccaacatcattttcagatggatcaaatctatagcatggatgcaactcagctatacaggcagtctcctcttcacgggcatttgggcgattcctaatatgtgctgtaacaaataacgctagatgtcttaagcataaaaatcaacaccactaaaagtctaggaaaatgatgaaactaaacagttttggagtaaaggatatttttctaagcacagcaccaaacctagacatcataaatttaggagaacttgaatgaatgttgaacaacataccaattagaactattcagtagcaaagcccttcttaagtgccagtcaacgaataggtagaaaactattttcaacacagattccaaagagctcttttccttcatttgcaaagagcattaacaaaaagaacattccaattttctttctttcttttttctttttctttttttttgagacggagtcctgctctgtcaccaggctggagtgcagtgtcacgatctcagctcactgcaacctccgcctcccagcttcaagcgattcctctgcctcagctgggattacaggcccgcaccaccataactggctaatttttttgtattttagtagaggcggggtttcaccatgttggccaagatggtctccatctcctgacctcgtgatccgcccgcctcggcctcccaaagtgctgggattacaggtgtgagccaccatgcccaggctccagttttcaaatcaaacaaaacacaggattaggcagtttaatttagttaatagaaaaaaatagaaacaattgataaacatagaaaatacactgtgcccattcctatggaaagaaatgcaaatgaaaaccaattatgagatatcttattctgttttacagattggaaaaatcagaaagtttggtattatttaatgtagtaagactatcgttttgttctactttatatatattttttattctcaatattttaactcaatattggagttaataattgaggctatcttgaaaagaacttattgagcagaaattggcaatatttattaaaattaggactgagtatatcctctgctccttccgctgctggagattttatagttgctacgtgggcagaaacgcatatgcatttcccaggatgtttatgtcagcattgcagagactaaggaaaaactggaaatgccctaaatgttcatccatgaagacaggaagctatcatgaagaagagtgtgctagatctccatgtgcctatgcagaagaactttcaagcaggaaaaacaagatgcagaacatgattatcgtataatccatttgttaaaaaagtagaggaggagaaatgaatatttatgtgagatccagggaaacgtgagctgctccatgacctttgtctgcacagtgatgtattcaaaggaaactccagcctggaatcttaaaatcaacaagcagctgaagtctttaagacagttgcttgacaaggcatccacggggaattccactgaaagcacacagacacactgctgaactcctttgcccagctcttcccaaaaagctcacaaaatacagtctctgtcatcaatcttaaacctcgttctctcaagaaagctcccaggtgctacccccaaagccagcttgtcttgttatgcatgtaggtttctgtttctgagtctgtcttcctccacatctgccctttccaatgcagacacctcagcccctcggcaccccttccctgcctgcccagcaccaggaaggtgcacttggacttccttagggtaaaggaggaggcagaggcggccagatgggacacctcctcatgggtttcgtccccgccgtttgaatgtgacttatgaatgcacggaggtcatgaaagggatgtagttttgctaagtattggtaaattcccctccctgtgggttgtaccattttgcattctctccaccaattaaagagcatgtttgtttcctcatattaaccctttgtctatacgttgcaaatttttttttctaagtcgccatttgtctttttaccttgtttctgtgttttgagatgtggagttggagtttttatccttatatgtttaaatgttatgtttggccataaaacaagcctccataaatgtaaaagaatggaaatcatacaaaatatattcggtgaccacaatagaaagaagttagaaatcaataacagaaagaaatttgggaaattcacaaatatgtagaaattaaacaacacactattaaagaacgaatgtgttaaagaagaaatcacaaaaaaacagaatatactttgcgatgaattaaaacaaaaacacatcacgctaacacttaagggatacagctaaagcagtgctcagagtaaaatttatagcagcagctacctatatgtaaaaaagaagaaagatctcaaatcaataacctaaacttccaccttaagaaactagaaaaagaatagactaaaccgaaagcaagtagaaggaaggaaataacaaaaattagagcagaaaaaaataaaatagagaatataaaagcagtagggaaaatcagtgaaatcaaaagttagttctttgaaaaaaccaacgatttttgttgacaaacctttagttagaatgaccttaaaaataaaaaggagaaggctcaaattaccaagatcaggaatgaaagaggaacatcgctggcaaccttatagaaataaaaaaagattataggaaaatactgtgaacaatttgcaccaacaaattcaataacctagatgaaataaagtcctagaaagacacaaactatccaaactgactcaagaagaagtagaaaatctaattacacttaaaacaagtagagagactgaattagtaataaataaataagtaattccccacaaagaaaagccaggcccagatagtttcactggtgaattctaccaaacatttaaagaagagttaacatcaacttcacaaactcttccaaacaataaaatatggaagaatacttcccaattcagtctatgaaaccagtattaccctgaagccaaaaccagaaaaagatctcacaggaaaactacagaccactacctctttcaaatatagatgcaaaatctcaacaagacactagcaaaccgaatttagtaacacataaaaaggattatacgccatgaccaagtggaatttatcttaggattccaagcttggtttaacatcaatcaatataataatccatattaatagaataaaggagaaaaaatatatgatcatctcaatagacacagaaaagcatttaacaaaattcactaccctttgatgagaaacactcagtaaactagtaatagaaggaaacttcctcaatctgataaactgcatctgttaacaaaaaaaaaacccataactaacatcatacttaatagtgaaagactgactgctttctccctaacatcaggaacaaaacaaggatgtccactctcactacttctattcaacattacactggaggttcttgccagggcaaagacaagaaaaagaaatgaaatccaaattggagaggtaaaactatattttccggtgacatcatactgtacgtagaatattctaaacaacacacaaaagacaattagaactaatagttcagcaaatttgcaggatgcaagatcaaaatgtaaaaatcaattgtggttgtatgaattatcacttaacaatctgaaaatttaattaagaaaacacatttacaatagtatccaaaagaataaaaaatttgggaataaatgtaacaaaagaagcgtaagatttatacaccaaaaactgcaaaacattgtggaaagaagttaaaaagaacctgaataaatgaaaaaacattctgtattcatggattggaagacttaataatggtaagatggcaatactccccaaattgacttatgcattcaatgcagtctctttaaaatcctagctgaaattcttacaaaaatggcaagatgattctaatattcaaataaaatacaagagaatggctaaacctataaaactcttaaaagaaaacaggattaaatctttatgaccttggattaggcaatagtttctcagatactacaccaaaaacacaagcgacaaaaggaaaaataggtagtaagttggacttcatcagttaaaaatttttgttcttcaatagacataatcaagaaagtgaaaagaacctgtgaaatgggagaaaatatttccaaattatttatctttaaaggacttgtatctgattatataaagaactctcacaattcagcaacaaaaaaacaacccaatttaaaaaagagcaggccgggcgcggtggctcgcgcctgtcatcccagcactttgggaggccaaggcgggcagatcacgaggtcaggagatcgagaccatcctggctaacacggtgaaacgccatctctactaaaaatacaaaaaattagccgggcgtggtggcgggcgcctgtagtcccagctatttgggaggctgaggcaggagaatggcgtgaacccgggaggcggagcttgcagggagcagaggttgcgccaccgcactccagcctgggctacagagtgagactccgtctcagaaaaaaagagcaaagggtctaaacagactaaatagacatttatccaaagaagatgtgaaaatggccaatcagcacatgaaaagatgctcaacatcattaatcattatggaaatgcgaagcaaaaccaccatgagataccacttcacacccaacagaaaggacaacagaaagacagatggaaaatggcaagcggtagtcaggatatggagaaattggagcgttcattcattgaaggtgggactggaacatgctgcaggcagtttggaaaatggtttggcagtttctcaacattttgaacatgcaattaccatatgacccagcaattccactcctgagtatatacacaagagaactgagggcagatattcacagaaaaacttgcacataagtgatcacggtagcattattcctaataaccaaaaagtggaaaaacccaagctcccatcagctgatgaataaataaacaaatgtggtctattcatacagtggaatattacgcagcaatagcaaggaaataatagcattactagcaagtatgaattaatacttaataattaaataataaggccgggcatagtggctcacacctgtaatcccagcactttgggaggccgagacaggtggatcatctcaggtcaggagtttgagaccagcctggccaacatggtgaaatcctgtttctactaaaaatacaaatattagccaggcatggtggcatgcgtctgtaatcccagctacttaggaggctgaggcaggagaatggcttgaacgcgggaggcagaggttgcaagtgagctgagatcgcaccattgcactcccacttgggcaacaagagcgaaactccatctcagaaaaaaaaaaataataataataataataataaaataatagtattattaagagtaagtactaatatatgctacaacatgaataagtcttgaaaacatgctgagtgaaagaactaagtcacaaaaaccatattgtattattccacgtatatgacatgttcagaagaggcaaactgtagagatagaaagtagattagtggttggcagggacctggaggaggaagtgggaactgactggtataagcgtatatttgcagggtggtacaaatgttttaaaattagaaagcggtgatagttacacaactctgtgaatatattcaaacccactgaattgtacacttttaaatggtgaattttatgatacgtgaattatctctcaataaagctgtgatcttttaaatgtgaccgatgtatccatcttttattacttctgggttgtgagccacagttaaaggggttatacactcccaggctaaaaaggaatttgcctgtgttttcttctaatgcctacatcgttttatttttttacattatatctctaattcatttggaattatcttggtgtttcacgggagtaacggatctgatcatatatttttccatgtggctatccagttggacaaacaccattgattagcccactcttctttgtggggcccttctcacaggacctgactcctgccctggcccactctttcctctgatggagacagcattcaatcccagcatacctttccctggaaatggtatcaaatgcttgtcaggctttcaggtacatccacgttttatcacagtaatcattcccatcagtgatttttatggtgattaaccagacaattaactcggctgcctccaggttttaagtctgcgtcataaagcttacatcttacttgggaatattactgggcattccttatgctttaagcaagatcttttaacagaatctattgaccaaaattaactctagggccactcatttgaatgttggctaatctcattaagcagcatttttattcacttactttacagttttattgaggtataattgccaaataaaaattatatatttcatgtatataatgtgattatttgatatacataaatgttgcaaaatgatgagcataatcaagttaatgaacacatctaccatttcacataattacctttgtgtgcccgtgtgtattaacaacacttaagatctactcttttagtaaatttcaagtatacaattcagtattattaactatatactcaacaggctgtacattagatccccgaacttactcatcttataactaaaagtttgtacccttcaaccaacacctccctatttctcccatgccccagctcttggcaaccaccattcactctcggcttctttaatttggactttttaagattccacatataagtgagatcatagagtatttgtcttctgtgtctggcctatttcacttagcataatgttctccaggttcacccatgttgcaaatgacagaatttacttccttttaaaggttgtatagtattccattgtgtgtgtgtatgtgtgtgtctatatatatatatatatatatatatacacacatatgtatatgtatataagccatattttctctctccatctgtcaaaggacacaggttgtttccatatcttggctcttgtgaataatgctacataccgttaatatggggttacagatatctcttcgagatactgatttcctttcctttgggtaaatacccagcagtgggatttctgaatcatagggtagttctatttttaattttttgaggagccttcatactttttcccataatggctgctaccttacattcccagcaacactgtatgagtgttcccttctccttgtcaacatgtgttatccttgtcttttttataataatcaccctaacaggtgtgaggtaataacacataggtttttttgtttgtttgtttgttttgttgttgttgttgtttgagacacagtctcactgtgtcccccaggctggagggcagtggcacaatctcggctcactgcaacctctgtctcccaggttcaagcaattcttctgcctcagcctcaccagtacctgggtctacaggcacacaccaccacgcctggctaatttttgtatttttagtagaaatgaggtttcatcatattggccaggctggtctcgaactcctgacctcgtgatctgcccgcctcggcctcccaaagtgctgggattacaggtgtgagtcaccgtgcccggcctaactcatgtttttaatttccatttccctgatgattagacgtgccgacaaccttttcctatacctttggtcatttgtatgtcttcttcggaaaatttttattcaggtcctttgcccattttaaaaatcaagttatttagctttttttgctattaaatcatatgggttctttacacattttgaatattaaccccttatcagatatatggtttgcaatattttctctcattccataggttgccttttcattttgttgattgtttcctttgctgtggtttttagtttgatgtaatcccatttgtttatttgtgctttggttgcctgtactttcagtgtcatataggaaagatcattgccaagaataatgtcaaggagattttttcctatgttttctcctaggagttttactgtttcatatgttttaagtctttaatttatttctagttaatttctgtgcatggcataagatatgggtccaatttcattgtcttgcatgtagatgtccagtttttttcgacactatttattgaaaaggccattcttctccattgtgcattttaggcacctttctcaaagattagttatttgtatatgcatacatttatttctggactctccattctgtttcactggcctatgtgtctattttaacacatagaccaatgcatacaattagaaccatactgttttgcttataatttgtaacacagttttaaatcaggaagtgtgatgcttctagctatgttctttctcaagattgctttggctaattgggggtcgtctgtggttccatacaaattttaggatttttttttctatttttgtgaaaaatgccattggaattttgacaggaattgcattgagtctgtggatcactttgagtagtatggacattttaacagtattaatgcttccaatccatggagacaggatatctttccatttatttgtgtctttttcaatttctttcatcaatgtcttatagtttttagtgtatagatctttctgcttcttggttaaatttactcctaagtattttctgtagctattgtaaaagggattgttttcttaatttctttttctaaaagcttattgttggtgtatagaactgcaaatgattttttgtatgttgattttgtgtcctgcaactttactgaatttatttattagttctaggagttttctggtggagtctttaggttttctgcatataagatcatgtcatctgcaaacagagaccaattgacttcttcttttcttatttggatgtcttttatttctttttcttacctaatttctctggctaggacttctagtagaagtggcaagagtgggcatacttgtcttgttcctgatcttggagaaaatgctttcagcttttcaccattaagtatgatcatagctgtaggcttgttttatatggcctttatgatattaaagtacattcctgctataaccaacttgttgagaatttttattttgaaaggatgttgaatttttactaatgtttttttctgcatttattgagttcattatatgatttttatcctttattctgttaatgtggtgtatcgtgtctgttgatttgcatatgctgaaccatccttgcttcccaggcttaaactgaacttcataatggtgtatgatttttttaatgtgctgttgaaatgagtttgcctgtatcctcttgaggatttttgcacctaagttcagcagggatattggtctgtaattttcttttcttatggtgtttttatctggctgtggtaggaggtattgctaatcttgtaaaacaagttcgaaagtctttattgtcttcaatatttggaagagtttaggaaggactggcattcactcttctttaaacgtttggtagaattcacctgtgaagccatctatctgattctgggctttttattgttaggaggtttttgattacttcctcagtctctttactcattattggcctgttcagattttctatttctgtatgacttatttttgataggtagtatgtttctaagaatttatccatttcttccaggttatctaatttgtttgtgtataattgttatagtagtctcataatactttgtacttctattataccaattgtaatgccccctatttcatttataattgtatttatttgagttctctttcttttttttcttagtctagctaacgatttgtcaattaaaaaaaaaaactcttactttcgcttttctttccttttttttttcttttttttttttttttttgagacagaatctcactctgtcacccccaggctggagggctggagtgcagtggcacgatcttggctcactgcagcctccacctcccgggttcaagcaactctctgcctcagcctcctgagtagctgggattacaggcgcccacaaccacgcctggctaatttttgtgtttttagtagagacagggtttcaccatcttgaccaggctggtcttgaactcctgaccccatgatctgcactccttggcctcccaaagtgctgggattgcaggcgtgagccaccatgaccagcctgatcttttctattatctatttagtctctatttcgtttatttctgctctaatacttattttctttcttctaactttgggctcagtttgctctttttctagttccttaaagtgtaaagttagtttgtctaattaagatatttctttttgcttaatgtaggcatttctggctgtcaactttcatcttagaactgcttttgctgtatcccgtaagttttggtatgttgtgtttccttttcgacttgtctgaagatactttctgatttcctttttgatttcttctatgacccattggttgttcaggagtatgtggtttaatttccacatatatgtggatttttccattttcttcttgttattgacttctagttttacaccattatgataagaaaagaaacttgataatatttccatcatcttaaatatgttaagacttgttttatggcccaacatatgacatttcttggggaatgtcccacgtgtgcttgagaaaaaattatattctctcgctgttgaaggcattgttctgcatatgtctgttaggtctatttggtctatagtattattcaaattcactgttttcttattaattttctgtctggatgatctatctattattgaaagtagggtattgaagtcccctactattattatattgctatatatttctcccttcagttctgttaatatttgctttacttatttatgtgctccaatgttaggtacatacatatttaaaattagtacactcttttaatgaattgacccctttatcattatatagtgaccttctttgtcacttctgacagattttgactgaaagtctattcagtctggtataagtatcgccattctttagctcttttggtttcatttgcatgaaatatcttttgtcattccttcactttccatctatgtgtatgtttaaagcaaaagtggatctcttataggtagcatattgctggttcttggattttttaatctattcagctactgtgtgtcttttgattggaaaagtcaatccatttatatttaaagtagttactgacaagtaaggacatacttttgccaattttttaattattttcggattgttctgtagttggctgttgttgttgttgctgagacggagtctcactctgtcaccctggctggagtgcagtggcgtgatctctgctcactgcaacctccgcctcccaggttcaagtgattctcctgcctcagcctcctgagtagctgggattacaggcagccaccaccacacccaactaatttttgtgtgacagggtttcaccatgttggccaggctggtctcaaactcctgaccgcaagtgatctgcccgccttagcctcccaaagttctgggattacaggcatgaacccccacacccagcctgttctgtagttcttttgttcttttctttctctctttgtatcttcctttttaatttgttgtttttctgtagtaggttaagcagcatttttaaataagggaactatcagagtaaacaattggggcccttcattttggcacaaacatgtatactgaatatttattgagcttcagctgtatgctgggcagcatgcaggaatatggctgtttccactggtatatactgtcctgtctggagttgatgtttgggtgttttggatacgtctgtacctctgctccccagcaagcccagcaagggtgctaaagcaaggcttttgtcttccacttcttggcctcactaacatttgacccatagctaagtaaataagattccaatacccactgacttattcatttgaataggcatgattcatcccagatggctaaggaataagatagaaaccccagacttcacagttttcagagaggggccaaatttctaacttaacttcaaataacaataatagtagctagcatttatctagagcctctcggggtcaggcagtgttctaagcacttctcgtgcttccatccacttgaccctcacaataacccctctgaagtaggtgccaccatccgaagtggagaggacggaaatgtgcagggcctggaggtgggcccaggaagcagcgcggggtcagcatggtggtcacacttctccgtttctctcccgggctctctgtgctctgggacttccttccctgccaacgttttgcagtcatgtatttctgggcagtgtgtatgactaaggtctcagatacttttatgacttggaaagcccccacatattatcttgaaagagtttacattttgacctgatatgaaccctaccactgttgtgctgaagtgaccagaccttagggaagggttggagggggatgtgtggctgagtggccaaaagaaaatcattcttggaaaggaaaatttagaagtgcctgaaggcatcattctcctcctcttttgctgggagaattctgtacccctgtggccgtaactgtagatgggcaaaattatagacgacccccttactaatatgcagagagctctggacggtcaacaaattgaagtggagaggctttcagtgatacagtctagataggcacccacggcagtgagtaagcagaacccagcctgcgggcagccctgggcagagcaggaggctggcagacctactctgcaggggacagtccaggacccaggtcagaccacgtgcaggcggagaaaggagaggcagcccgctgggaaattctgcaagtcctttctggggtgcacccctgcgctaggctagaaggaggagaatttcgagaagcatggaaagcgtaagggctccttccagataaggcagacacaggaacaaaagctaagggaagcttggtccatagaggaaatgagagtgcagtctggcagcctcacaggcacctggagtagggaggaaggggccaggcctcctggaaatcacccccatttgtgtgctcaccgcttctctttgtgtatgtatttttttattcatatgcattgtgcaatatcttttatatgtgccattttcttttacaagaagatgataatattcagacatcttaaatacttgccaaacaccatgctatgtcaaatagcacagctggggcttgaaaccaagtcttccaatgtacagagttcagttcttcctgtaactgcgggttttcacacagttctcagtagatggcatgattggaaaactctcggtgcctcatcctaaatgttcctttcagattgagacattttcttcctttccttgcactcatttttgttgggaggaagttaaatccagttagcaaatgtactttgtcaacctgaaaagcattttttttaatataacaatgttgttatagtagtaatagagaaataactggaaaatagagaaaagggtctcgagaagttcaccttgaattccgccacgtaagaaaaaccagagttatcgttttgggggcttcctccttgacagttttcctgtttgtgtagttccagggtctgtgcattataattgtcaaaatcaccgttctttgctctactgaacagtgctgcaatcagcatctacgttcatattgcttttttttttttttttgcatagtgctttttaaatgtgtagaactattcttttggaatcagtttcccagaagcaacgtggcaatgtcaaagggtgtcctaatcctccagtatttataatcacaatcatcttccccaaaatcggagtaggactgactgtgtgtgtgtgtttatcttcgaattgtaccattttctatagtattactgagtattaaataaatgaactgtcctatttatgtgatttttaattttccaaaaagatggttctcctttttttaccaggtcagtttttgtctgttggctctcccaagtccctcaagcatccccttttgggtaaagggcatggtttctgttgtgggtgtttgaaagtaaactctggaaatactgtagcagcgcacttgagctctttctgtgtgtctcagcaagctgtgtccccagggtccagctcagcacataggaggtactaaatatttgtagaacgaatgagcaataaataaatgaatttttggaagaggaacaaaatctaggaaagaattcatcttcatagctttgtatttctgtgtttctcttcttctacagcagaaaattaatggagggattggtttccatttcctctccgttttttccatctaatgagacagggtcatctcatgttttcgttcccacatttctgccatgcatgttaggtgctgaataagagtctcatgtttggctgttgtcttagttcgttttctgttgctataactggatgccagagactgggtaatttataaagaaaatgaatttgtttcttacagttctgaaagctgggaggtctatggctgaggggctgcatctggtcagggcttcttgctggtggggactggctgcagagtcctgaggtggtgccgggcatcacatggcaaagggcctgagtgtgctggctcaggtctcttttcctattcttataaagccaccagtcttattacagggtccccaccatagtgaccttatccaatcttgattatgtcccaaaggctgcaactcctaataccattacaatggggattaagtttcaacatgaattttggaggggacattaaaaccatagcagttggtggctgggcgcggtggctcacgcctgtaatcccagcactttgggaggccaaggcgggcagatcacgaggtcaagcgatcaagaccatactggccaacatggtgaaaccctgtctctactaaaaatacaaaaattagccgggcatggtggtgcgtgcctgtaatcccagctactcgggaggctgaggcaggagaatcacttgaatctgggaggcagaggttgcagttagccgagatcgcgccaccgcactccagcctagcaacagagtgagactccgtcaaaaaaaaaaaaaaaaaccatagcagttgggaacacacaacctaggaagcagaggatgagctttgatggcaggtgctgggggtccaaatctcagctctgttgttgggagctgggtgggggaagtttctctaaccactcagggcactggtcaccttgtggtgagtgatgatgagaagcctagccttgtatgggtgttgggaggaagtcaaatgcacgcaggacactttctacagcatccggcaggactcaataaatggcaccaatgaccaatacatgaaacattattataaaccattttattttatctttcaaaatctgggacacctgtgccaatttttgttccatgagacttccttgctctccatccttttttctagagcaactgagtcaagattcggtagattgagagcaaacagttgcttcaatatagataataccactgaagaactggttcactaagccagggtgaaacacagttaacattttgctggacatacttcatcttttaatttttttttcttaatttcagcagcaatacaagttactgcaaaaaatatattgaaaaacacagaaaaatagaaatatttttaaaactccaggctgggcatggtggcttatgtctgtaatcccagcactttgggaggccaaggcgggtggatcacttgaggtcaggagttcgagaccagcctggccaatgtggcgaaaccctgtctccattaaaaatacaaaaatcggctgggcgtggtggcaaacacctgtaatcccagttactcgggagactgaagcataataatttcttgaacctgggaggcagaggttgtagtgagctgagatcacagcactgcactccagcctgggtgacagagtgagaccttgtcttaaataaataaataaataaaattttaaaactccagtcatttcatctgctgaaggggacggctactgtaatttttgtgtgtcctttagattttctttctaaacagagacagggagagggaggagaaaagagtgtcaggttcaggttttacaaacaaaaataatagactgtatgtattatctatattcatagactcattagggaccttttctcaaaggattttaatcacaaataatcagagaacctagaataaattatttcattttgcatatatatatatatatatatatatatatatttttttttttttttttgagatggagtttcactcttattgcccaggctggggtgcaatggcgcaatctcggctcaccacaacctctacctcccgagttcaagcaattctcctgcctcagcctcctgagtaactgcgattacaggcatgcaccaccatgcctggctaattttgtatttttagtagagatggggtttcgccatgttagccaggctggtcttgaactcccgacctcaggtaatctgccggcctcggcctcccaaagtgctgggattacaggcatgagccaccacgcccagcccattttgcgtacttttaaatggtgtccatctgtgttctgtgtttttcctgtggtttgtcacggcctctgtcctatgttctacttttagcttgatagctggtaagcattttttcacccttctccttagtcttcattgtcataggttctgatggccgcatccgagccccttattctgaagcaccagcaggtattaacttagaaagccgagtagcagcgactctgtgggccccagcgtcaggatgcttcccctccggctgctcgttgccagcgctgttgttctgtgaacctgtgtcactgtcttggccttgttcctctgtaaaatggcagcagagtcacctccttcctagcgctgctgtagacgttaagtgacgtgagtccagtccccaggcctgtgctggcccttgggcaccaccctgctctacaccactccctaatccttggcctgggccgcttgtctgcagagttgctcttacctcggctgtggcagggacctctgcagaagtcctggctcgggagtagtcttttagtgtgcaccgtgtcatttctgtagggaaatgcctagaagagaaaaccgtgggagaacaggccgacttcccgcttttgttatgtagtactgccctcccgctttctgaaatgaccatccggttggcaaggcctcccacgatggccaatggaccagaggatgcacccatttccccacactcatgacagcaaggaatgttataagcctttcaatgttttactgtgtcaggtggacataacatagcatcttgtgattaattatatttttattactaaagcaaatagcacttttccatgcaattttcccccaggagaccaacctgtctatatgtataaccatccatctccctcttattaacaaaaattcctagtgatttggtgagtatatccacaaaatggtaatctatgccgtgaagcatttctgcagtgagaaatgctagcctctgggccagaactgttagtgagagcccgcagagcccggccctggcttttgctttcctgtctgatgcgggtggagggcctgggtgatgggtgcaatggccctgagcacccaccatctggagaggaattatcaccgcagatcaccccggggctgggtgaccctccctcctctgcacacccccaacctccacatctttcccaaagacgtcaagggttggatttcaccgtaatatgacccagagatgtaaacggctgctgatgctgaaacgctagagtgatatctggtgaaaaaagaagcatccttccagtggaaggctggcaaagctagggcaacagagggcgagcccccaaagtgccaggagggtgtcacctcccgggaaggccagccccgtttccctggtgctttggccacatggggactcagtggcacaggaaggtcgttaaacaactatgaccaggtcagtagcatcctgaagtttacttttgtttgttctgcaatgagctgtgggctggtagatcattttcactttttgctgctctattgacggaggcaaatgcaataaaataaagtcatggatatgcaaatcaaacggcagtgtcttttctaagatttacagaggatgtcacacacttcagattgaccaaaaacatttgccttttattctaagtgttttccttggtggggagaagagaaatacacacacacacacgtgcacacgcatgcgcgcacacacacatgaggccaacatttagaacttacataattaaagccatttttttcatttcattttctctattttcctagatttgtagggaaaaaaaacagtacaaagagaattttattccaatgattgggacaggagtgatgacttaacaattattgctctggaacaaaatgtaagactgtctccttggaacataaggacagacagaaccagggatggacagactggggcggtgtctttcaaggtgtacctgcagaacagtgagctgcctgccgtcagagacacggttgtcacagccagcattactctgtcatattcatggaattctgttttattactctttcagaatactgaaaaagaaaaataatttctgttagtttttctgtaattagaataatttgttttttctgaaacatgagttatggaaatgatgtttaaagactgagttattggcagctaaaatcacttcttcttgaaatggctgactgtgaaacacacagtatcactgaaggtatttctttaaaaatagtatgttaaattgaaagcaattatcaagaactaaatggtgttcaggtcctacaggtttttaaatattttatgttttttctaaccaaatgcttctttatgtaggaactttaacttaccatccatggccggcacattgaaataccagcatacagtgaagactaacacttatcaacaaccagaaatatgttcacttacaagctcagagcttattgtaaatgtttcttgtcatcttgaatggctgcacatgtgctgactccataaccctagctattcactgcatttataatttcattttccctaaccagttcctacttctaaccactgcctttaaaaatcaaactagcaacaccaaccaaacctgaaaaaaaaaatctccctggtgctattcatttatccttctcctcctttacttcgttaaatacttcattggaatgtattagctttacattaaaagcaagtaagatgcctgaaaatttggaaattttcatcaccatatatgaaaataatgacataaattataatttagagaaccaaaaggattttctaaaatttgaaactgcattatagcaatgttctactattattttcctactagctctagctacttatttgggacattaatgtgttattgaaatagaatgtttgctccattttattttttaatatgaatttgaaatctttatgaggaaaatatttagaactgagatattttactgtataaaagaatataattatggataatagttgatgaataagcacaagtaactgaataatctcaaatagtataaatgtgtttcctacattttaagtttaaatcaaaagttaccaattctcaaatacaaaacaatagtattttggagaaaaaaatgactaaataagtattatctctaggaaaaggtgcagaagttctaaattttgatgaagcctaatttaacaatttttcctttcctggttattgttttctgtggcggtgaggaggggcttttgcctttatatttatttctgaactatttaattttttttcagtgagaatgtgttctttcattacttttgtagtgtctgtaaagttttgaatgaagcagtcatatattcccatcacgcaggtcttgggaaataaagaagaaaaatcttttctagttctgtcatgaagtcccccatggcccatgcctaatactcactatggtcaaagcatttgggtcttttttctttcaatttaaataaaggttaaccattctctgtataatttcaggaaattaaatgagattggcagattaaattaaatgcatacgcattaactggtgccttttcctaatgtccttccaacaacttgattggaccagaccctcagcccacagggtcggtgagagtggatatggtgtcaccctgcaacttaagaaagtcagagtcgaaacagataaacaccacaacatttttataatgtaaagaaaactgagcaggttctagattcttattacatcatttactccacacacaaggcatgattgaaaaatcaagttaaatcacccttgtaatctcatgggcaccttatggcctacatatgccctaagttccaccttcaaaatgtcccttaacttgggcttaaaggtttagctgtttgtatgtatgttcctaacatggacagaagaggctacttcatacctgcttgtgcattcacacatacacatacctgcacatgtcttttactggataagcgggtatttgtttaattctgagagacaagcaatgacataattaagtgcccccatctgagggatgacagcagttgattctattccttctgggccctgctaatggcctttctccctctggcctgctctcacatgtcccaggggctctgcctgtaaataattaatggtgactgttaatgtgtgttgggaagtgaagctgccttattcacacgtataaccgcttacacaccaagccttttcccgattcctcttttcaaaagcacacagccaagacacaataatctccactcagacacagcaattctgtgttggcatctcaggaatgatacagattgtgtgtgatggtcatccatttacttggattttcaggacgattgcctttgaaatggagcaagtcatggcttagcgtgagttgtaaagaccctggattggtattaggggctttgctccgtaagcagcttgccttttttctttctgcagagcaggatttttcctgggagcaggattttccaaagggagctctttggtggcaagagctcataccttgtgtcatatggcaagccatgcatttggagtatagacattaggactcatattttctcccaacattttgttatgaaaaatttcaaacatacactaaagtagaaagaattgaaccatctatattcatatacctaccactcagatcacaccattaacactttccaaaatttctctcttgcctttctatccaaccatccactcatttttaatgcatttcaaagcatattgcaaacatctgtacacttcactcttaaatactgtagcatgcatagtatggactaaggttcaatattgtttgtagtttttttaggtaaaatatatataaagtaagatgcacatatcttaaatggactgcttgataagttttgacaaatacagcaactgtgtaatgaaaactccagtgagatatagaaccaccaaactgatgtccttgtgccccatccacaggaaaactcactgtctaccatatggccacgatccacccttctgattttttttcactatatcttagaacagcatataaatggaatcatttttgtacaaggtttctttcactcagcattattttttttgagattgctatcagtctttccatagatcaatcggtccttcctttttattgttgagtagttactgtaccacggtttgtttattcattctcctgtggatggacacttgggctatttacagtttggaaatatgaataaggctgctgtgaatattgttggatacatttctggacatatttctcttggttagataagaatggaatttatgggtcacagggtaggtatacatgtagttttataagaaaccaccagacctgtttccaaagtgattggaccattttgcactctagccagtaaggtatgaacattctggttgctccatgtcctcaccaagtagtgttggccttacagttttagccattctggtgagagcatagtggtatctcattgtggttttaatttgcatttccctgatgactaatgacattgagctttttgaatatttttttgctgtttaaatctttgccctctctctttctttcttccttttctttttctttctttctttctttttctttctttctttctttctttccttccttccttccttccttccttcctcccttcccttcccttcccttttcctttctttctttccttccttcccttcccctttccttcccctttccttccccttccccttccccttccccttcccttcctttcccttcccttccttctgttttgtttttttgagacagggtcttgttctgtcacccaggccagtggagtgcagtggtgtagtcacagctcattgaagccttgacctcctgggctcaagccatcctcctacatctcagcttcctgagtagctgggactacaggtgtgcaccaccatgcccggctaatttttaaaatgttttgtagagacagggtctacttgtttcccagactggtctcaaactcctaggctcaatggatacacccaccttggccttccaaattgctgggattacaggtgtgagccaccaggtccagcctgctcattttcaattggattgtttgtctttttattatggagttatacgagtttttatattctagataccatttattttcagatatgttttgaaaatacgttattgtagtctataatttgcctatttaactttaaatggggtcttttgaggggcagaagttttaaattttgatgaagcctaatttagcaatttttcctttcctggttattgttttctgtgtcccatgtaagaaagtaagtaaagacttactctcaagtcatgaagataatctccgctatgttttcctagaagcttcatagttttagcctttatgtttaggtccatgattcatctcagttattttttcttttttttcaagtttttttttcaagttcaggggtacatgagcaggatgtgcttgtttgttacataggtaaacatgtgccatggggatttactgcacagatcatcccatcagccaggtattaagcccagcatccattagctattcttccttatgctctttccccaccctccctcaccacaggtgcccagtgtgtgttgttcccctcttgtttccatgtattctcattggtcagctcccacttataagtgagaacatgtggtatttggttttctgttcctgtgttagcttgctgaggataatggcttccaactccatccatgtccctgcaaagtgataatcttattcctttttatggctgcatagtattctatggtgtatatatgtatcatattttctctgcttttttcttcttttttttttgagacagagttttgctcttgttgactaggctgaagtgcagtggtgctacctcagctcactgcaacctctgcctcccaggttcaagcgattctcctgcctcagccttcataatagctgagattacaggtgcccaccaccacgctgggctaattttttgtatttttagtagagacggggtttcaccatgttggcctggctggtctcgtactcctggcctcaggtgatccacctgccttggcctcccaaagtgctgggattataggcatgggccaccgcatgagccaccgcacccagccaccacattttctttatccggtccatcactgatgggcatttgggttgattccatgactttgctattgtaaatagtgctgtaatgaacatgtgtgtgccatctcaagatgatatttgtatatggtgagaagtaggggtcagggctgctttttattaaatgagggtgtccagttgttccagcactttttactgaaaagactttgcttttcccattgtactgctttggctcccttgtcaaaaatcaattgaatgtacaagcacaggtctatttttcaaccctctgttctgtcccttggagccatttgtctataccagtaccatactgtcttgattactatagctttgtagtttgttttttggaaggataatggcttccaactccatcctttccaagtcttgaaatcaggtagtgtacattctccaactctcttctttttcaagattgctttggctattctaggtctttcaaatttccatataaatttaagaatcagactgtcaatttctatcccgcaaaaatgaccctattggaatcatagttgggattattgaatctatagataaaatcaaagagaattaacatcttaacagtactgattcttccaatccttgaagatggatgtcttcccacttatttaggtcttgttcaatttctctcagcaatgttttatgttttcagcgtacagatcttgcccatcttttgttacatttttttctaagaatgtaattttatactatcataaactattttttcaatttttcaatgttaactgctattatgtgattcatttttgtgaggtgtatgtttgtgagccaaccgtgctatgcatttacatttaaaaagaaaaacaaggccaggcgcagcggctcacgcctgtaatcccagcactctgtgaggctgaggtgggtggatcacttgaggtcgagagtttgagaccagcctggccaacatggtgaaaccccatctctactaaaaatacaaaaattagctggacttggtggcgtgcacctgtaatcccagctactcaggaggttgaggcatgagaatcacttgaacccgggaggtggagattgcagtgagccgagatcgcgccactgcacaccagccttggaagcagagtgaaactgtgtctcaaaaaaaaaaaaaaagaaaagaaaaagaaaaagaaaaaagaagaagaaaatcaatccaaagcctgtcttattcatcctttcagagaggcagcacaaagatgggttgggtttagcttgagagctgggagaccaaacttctgtcccagtttgcctctactggctgcgtgaacttggccaaggatgatagtgttgaagtcaaaataaaaatgtagaggtgaatttttatttttattttttatttgtacacatttgtggggtgtatgtgacattttgttatgtgtatatagtatgtggtgatccagtcagggcatttagggtgtccatcacctgaatacagtacatttttgttaactatagtcaccctactctgctatcaaacattgaatttattccttcttactgtatgcttgtaccctttaacccacttctgttcgtcctccctgctccgacactcacccttctcagtctctgttagctgtttttcccatttttccagtctttgcctccatgggatcaaatttttagctcccacaaataagtgagaacatggaatgtttgtctttttgtgcctgcttatttcactcaagataatgacctccagttccatccctggctgttgcaaatgacaaaagaattttttttttttttagacagagtttcgctctgtcacccaggctggagtgcagtggtgcgatctcagctcactgctacctcaggctcctgggttcaagtgatcctcgtgcctcagccacctgagtagctgggattacaggcgcgtgccaccacacccggctaatttttgtgtcttcagtagagacggggtttcaccatgttggccaggctggtctcgaactcctgacctcaagtaatctgcctgcctcggactcccaaagtgctgggattacaggcataagccaccacacccagcctcaaaaggattttaaaatctaatgttttcttgggatataagaattgtaatttgggatatatatatatatatatgagagagagagagagagagagagagagagtgtgtgtgtgtgtgtgtgtgtgtgtgtgtgtgtgtgtgttttggtatgtttgaagaataaagagaaggttggcagttttgtaataaaaaggagaaatgttatgtgtgtttttcaagaaaacttattagtattagcaaggttttggagagttggcaagttatgatgggtgagtgacagttgtgggtaaagctagttttaaagtcgttttagtagttattagataaaactggttttagttgtggtaggcatttttagtagtcggacttgtagagaatcatgtttttggagtcatgttatatgccccgagtgctttttcttcttggcttctcagctccgttttagttgggtgtaaaaacaataacccaatttgcttggtcacctttcacaacagtattctttccctatttctgctatcactccacacagtcagaattcaactgctcatccatcgcagtctttccgtaatacctatggagagaaagctttttactgttgttccctaacctctttggaaatctggtagaagctttgaattttgtcctcgaaaaactgtacacacacacacacacacacccagttttgtgtacaattttagggtgttcagggaacttcggaagcctgtcagcctttcggggtccacaggccctcactgtgaaccccttctagagtggaagctcggggagggcgagaggccgccttcctttccctcggctcctcctgcacccagcgagggctcggcctgccgtggccgccccgtgagtgaccgccgcttttgctgaacggcccgggcgctgggtcgcggcctcccgcaaggctggcctctcctcccgagtggcagcaggtgctcggatgaccgggagcagcccacgctctggtgaagcagcgcgacccgaggcccggtgtcgtcccccatcgttacgcagcgcgttcgtgccagggcaggtctggagtgagggcggctgatttaaatcccacgcccttcgtggggttttctgggcagggcgggaaagcgtctggatgtccacacccccgggaggtggcctgtctttcccccgtgggcaccgcagcgggacagcgtggctgagacccgcggctctctcgccaaagcccctgcgcctccgctgctgtcggcgaggtcggcccggccgctcccccgcgggccgctgtccccggtgccctggaagggctccaggtggcggtctcgctgcagaatcctccgagctgcgctcgccgcccggtgccttcgcagcggccccggttgggttgcgggtcgcggggcggcgagcgcagggagcgtcgcggggccacccctctctcttcctgaagcccccgcgatcgtgcaacgggccgcgccgcctcctgctgtgttccacggtgattctcaagagcacgcgggcagtgggcggtgacgccgtgtgtgtgtgcttcctcccgcgcaggtgccggggacacgggcggcaagccgtccacgcggggcggtgaccctgcagcgcggtcccgcaggacggaaggcatccgcgccgcgtacaggcggggagaccgcggcggcgcccgggacctgctggaggaggcctgcgaccagtgcgcgtcccagctggaaaaggtaggggagcgcctgcccctgcggccacccatgcagccccgggctggacgaaggggaccgctcagatgattttctcgttattgtcataacggtaatgggcgtttttactgtgttctggaaacgcctcgctttgcgtataaacttgtgggcgcctttcctttccaactgacttctcagtctgatatcacctaagcaggcccctgccaccttttcatgggaggcctttgagggacgggggtgtggtcacttaaatgtaaagaacaaaatgccacccagaggcttaacctactctattcttttacgtttttgtcgttataaaaagtagcacatgctggaaaaataaaatttagaaaatatgtcaaagtaggaaaaatgggacaaaaaagttaccaaattcctgatacaccctaaaacccacttaacagttttgctgtattttcttccagcctgccgatctgagcatacatggttgttgttgttgtttctaatatagatgcagacagattgcatatatggtgatgcagctgctgctcgtacttttataacattattttaagaattttccagatgattaaaaattccttgtaggcgtctccttcaatggctacgtgacactccatctagagggaccgtgtctacctggctattcatcttggctgatattaggattgcttctcatctcttactaatataaacgatgctctattgaatgtttttgcctcattcttttcttatggtaatgttattttcttagcatagatctgcagggattgagaatgtggatatgaggacttttaaagttttggaatacatgccaagctgttttccaaaaatcttctacagattaaccctcccagcaaaagttggagtggaccatcaccacattttttgcccctgtgggggcttcttactggctattatcatgaaaataccttaaggatgttttatttgcatcactttgattaggacaggcttaacatgcctccatttaattgatagttagaattcattcaattcctaaaactccaacctgttctcagaagtgtaagagattgggagaggggcagtacagcatgcttgggaattgttaagcagaaggaaggcatttaagatccctctgattaggaattcatggtggatatggaaaaggatcattcttctgcacagagagagctgcgctgtgcacacgagcaggtcagagctgtgggctcctcgggtgcaccccagtggcctcaagcagggaggagctgggcagcaaacacagcctggcatccctgccaagtggccaagcagccagagatagtggctcattccagagctgtgcagattcagggatgtggcagcagcaggagatgctgacgggggaagatgatcatggagagacctgagagccaagggggatgtgacttcatcctgagggtggaaaagctgttaaaggcagtggcatcataatttggcaaagagcactctggcccatatttgaataaaggaaaacagagtccagggtgtgtgtctcttctctgtggcatcatggacagtggcaactcaaaatcgagaaggttcctagaaagctgcctctcccctgaatacaggactgatgaaatcccagctgattggactttgagaagacagtgaggaaaaggatggatacatctgtgttttcataaaaatgtaaaattatagttccaaaaaataccataaataagagtcaacggttgatgcaaaaggagaaagtatatggctaatacccttcattgacaaagagcttttacaaatcaatatgaaataataacataattttcaaaagggcagcaggacatggaaacagcaaaataaaggtaaagaaagtagaagccatgaaactgtaaaaataatttgaaagttttgaaatagaaagcaaagtagaaagaagtagaaatgaccactaaatcaaaaattggttctttgaagagattaataaaatagaaaatctctggtgagagtaaaagataaaaaagaagaaatagataaatcaggaatataaaagagaacttcatgacagtttatacaagcattaaaaacataataagagaatgtattatgaacaagtttatgttaaaacactcaaaaatttagatgaaatgaacaaataaaaagaaaaatttaactttaaaaagaaacagaaagcatgaatagtctttcaaccatgaaggaaataaatcaatcatgtaaaaccttctgacaaagcaaattctaggtctacatggttttactggtgtgttctaccaataatataatcacttgtccagaaaatagaaaaagagggtgcactcacctgttcctttaatgaagctaacacaacctcaataccaagagtaggtgagaacagtacctggaatgaaaatgactaaggatatgaataggcaaatagacacacacacatctgaaagatattcagatagatggtacacatatgtaaagttattcaacttcgttaatgcgtatagaaaggcaaataaaacaaaaatgaagcagcctttttaagctaatcagattgacaccttaaagtttgataaaaatcagaaggaaggctatgggaacttacacacctttattcaatgctactaggaaggtactaggaatgtgtgcagcctctttggaaggccatctgaaaatgcttgtcaaattttcaaatttcattatctttgacccagcaaaactactgctaggaacttacccctacagatttacttgaaaaaaaattaccaatttgtatgtgtaaggatgttcattcaagttgtgtttaagatagaacaaccttgaaaactgcctaactgttccatccacaggagaaggctgctacagaaatctcagtctgtcctggtcctagaataccacacagcactccaaaaggacaagataatctctagcagctgttttggaaagaactccagtgtaacttaatgtaataagtgcagaacttctgcttccgggaagatggagggaatatggaggttgtttactttgccctcttcttctcactaagtgcactgaagctctagacgttacatgtaaaacaaacgtaggattctaaaaggtagagaaaagaaggcagagtagctggtggcctcagtactcaaggaaatcacaatagtacgtttttgggttttatttgtatctcatacatcccaaaccagatactgaggaagttggcaatccagaaacacaaactggcacagagaaaaaaaaaaaaaattccaaggaaagcctgctctctccaaccaaagcaccaggaaaggaacagcaaagccaggcaggaaacttacaggcagtcaacaaccctcttcggcaaaacactgaagaaatatacttgcagcccagccccacccctcaccagcaagggccaggtggagagcttagatttccacccttgccaggctgtaacaggcaccccaatcatccccaccccacggtgtcagagaaggctgtgaggagctggggtgctaatccccaccaggtggtgacaacatcccccatcaccatcagtggacagcatgtggggagcctggacttctgtcaccacccagcctggcagtaatgagacatgcattccccatctaactagggcagaattgaagcaggcctagaggagaacctgaagtcccaacgctgcccagcaatagcaaggagcccctgcttactgggtgtcaactgattctaagtacagcccccagatttccaccccaccaggcagcaatgaaggggcatccctgtttacccaccagagtggcgtcagaggagacctgccaacacacaagattgaagtaagatccagagtcttaaaacataaagacccaaatatccaggccacaataaaaaattactcgtaattaccaagaccagaaagatcgcaaactcactgagacaagacaaccaagagatgccaacactaggatgactccaatgttagaatcatctaacaaggatttgaaggcagtcatcataaaaatgcttctgtgagcaattataaatacacttgaaacaaatggagtaatagaaagtttcggcaaagaaataaaagacatgaggagagccaaatgaaaattttagaacttaaaagtacaatacctgaaattttaaaattaaaaaaaaactcaatgaatgggctcaactgtagaatggagaagagaggacaggggaaagaatcagggagaatacagaacagtagaaattacccactctggaacaaaagccaaagcaaaagaaaatagactgaacaaaagaacagagcctcatggacatgtgaggattttaacagaagatccaacagtcatgtcatcagaatcccgggagactagacagaaggcaagactgaaggagaactcaaagaaacaatggctgaaagcttctcaaactggcagaagacataaatgttcagattcaagaagttgaaaacaaacaggatatgcccagagaaatccattccaagctcatcatagtcaagcttattaaaactaaagacaaaacaaaataaaaccttggaagtagtcaaagggaaacattgcctttaggggaaaaaaaatccaaaagacaaaaatcaccaacgtcagaagggaaacacagaacatcactacagatcctgcagatatcaaaaagataataaggggacattatgaacagctctaaacacatacattggacaacttagatgaaagggacaaatccttgaaaagtagaaattacctcaacttaataggaaatgcataatttgaatagccttttaactattaagaaaattcaattcataattttaaacttccccaaaaaataaatttacaggttcagatggcttcactggataattctacctaacatttaaagaattaataccaatgctacatagtcccttctagaaaatagaaaagggaacattttttaacacttttatgaaggctgtattaccctgacaccaaaaccaaagacagtgttaaaaaaagaaaagtacggaccaatgcccattatgaatgtggatgcaaaaattcttcacaaaatattagcaagtacaattctgctatatgtaaaaggaattataagccatgaccaagtggaatttattccagagatgcaaagttgcttcagtttcaatcatcaatcaatgtaatcctccttattaataaactaaaaaagaaaagttaccttatcatatcaattgatacagaaaaaaattgacaaaattcaataccatgtttttcaaaaactcttagaaaattaagaataggagggaacttcctcaattgggtaaagaatattgacaaaaacctacaactaacatcattcttgatgttgaagactgttttcccctgagatcaggaacaaggcaagaatgtccattctcaatataatactgcaagttctattcaagagcaactataatatcattgtatttaaaaaatactattcaatgtatttaatatattgctggcaattctagccaatgcaagaaggcaaggaaatgaaataaaaggcacacagatatgaaagaaataaattaaactgtctctatgtgtggatcacatgacaatctatacagaaaatccataaaagaaatgatttatgaaagaaaaattggtaaactggacctcaccaagattaaaaacttttctctgagaaatacctaagacagtgattctaaaaaaagctacagactgagagaggtatttacaaatcacttatctgacaaaggactcatagctagaatatataaagaactctcagaactcaacatgaaaaagcaaacaatccaaatagaaaatgtatgagatatgtgaagagacatttcactgaggaagatacacagatggcaaataagcacatgaaaagatgttcaacatcgttagccattaggaaaatgaaaattagagcaatgataagatgtcattgcacagctttatgaacagcaaaaataaaaaatagtgacagtaccaaattcagattgggatgcagagaaggggtatctctaatgtgttgccactgagaatgtaacatggtacaatcacgctggaaactagtttgtcagtttctttaaaaaaactagaaatacacttatgaaccagcaattgaactcctgaacatttagtctagagagaggaaacttacatgcacatgaaaacttgctcatgatgtgtcataccaactttatttgtaatggcccaaaactggatacaaccaaagactctcagtaagtggatacttaaacatatatggagtactactaagctatacaaaggagctctcctgaaacacgcagcaactcagatggatctcaggacattatgctgatttaaaaaaaaaaaaagccaatctcaaaagatcatattctctatgattccatttatgtaacattctcaaaatgacaaaattttacaggtggaagagagattagtgtttgtcaggggttagagatggtgaaaaggaagagaatgagtgagactaccatgggtgcgtggcatgagggagaccttttgatggaacaggtgatggaacaggttcgtatcttgattgtggtagtggctactcaagtctacatgtgtgacaaaatgcagaactatatacatacattgtactaacgtcaagtatcttgctacaattatgtaacatattgccatcgggggaaactggatgaaggatactagggttttctcagtactatctttgtaacttcctgtgaatctctgattatttcaaagcaaaaagttaaaaaaaaaataggtaaagtataattccacttttacagcacttaaaaactggcaatagttaatctgtggtgttagaagtcagtatagtggctacacaccatagggcagttactagaaggaacaaagagggcttctgggcacaggtgatgtcctggtctttggactgaggccagttacatgggtgtattcaaatgccttgcatgaaactgaacatttaaaatatttgcatttttctgcaggtgtgcaggtgtgttatattgttgattaaaaggtcataatgaattaagtgaaaaaagcatttggttgtatatgagattacctgtgagtactataaataaatatgttctggaaggcatcctttgcagagggcgactgggaggtaaaggcatagagagaggcctacttcctgttttatacttttctatgctgtttgaattttttcaaatactcactatggagcctccagccagaaagccagctttcaccttttccactgtctgggtccctcttggccttgggctggctcctatgacgtcacttaccacctctagaggatggggcttttaagcctctaaccgaccgagtctagacagctgttagttgtgggcagtgaagcatttaatcaatcactgtggcttttatccataatgcaaatgctttcctggaatgacagggctactgggcctcaccctgggcagagtggcaggtgggtgggcttttcttttctgatcatattgaatgtatgagtctaccgtccttcacctgatcccagccccttagactgttcctctcctcacgtgtcagacatacctcccactgccagcccattcactccactaacagaacctgagccttcctccaagtcccatgtttccaggaagtcttggatgcaacagagactcttgggctttagagctagacacatcccagttcaaactctgagtagttctgctgatgataaactccctaaccatgggcaagcttttatttcctcttccataacatagaaatacaggcacattcctggcatgactgttaggaggattgaatgtggccatgtgaataaagtactcagtccagcatctggcacctggtgagagctttgataaatgttcactccctttcctgggggctccattttacccattcctgcccaacttacctaaaatgatctccaaacacacttgtgttataaactattcagcaagtcaaatgtgcttgtcgggggctgtttatgcatattcccacctcaaacttaattgtaaatctgtggaggccagaaatggcccctggcatcctcagtgcccagtcccacctgtcacacacagtagatcctcagtaggtgttgatgggggcactcgccatccctggcatcctgagtgcccagtcccactctcacacacagtagatcctcagtaggtgttgatggggggcactcgccatccctgtcatcctgagtccccagtcccactctcacacacagtagatcctcagtaggtgttgatgggggacactggccatcccattccaataggggatccccatctacctgcttgaccacactgatgttcaagcccacaggaggcagccagcttccaaaggacttgacatttcagaaacgcaatcaaacacttgacatgccaatctagcagctatctgagcatccttttctcagacccagagagctcgtgataagtcaaggccacttttacactggtcaatgatagccacttactagctatgtggtcttgggcaagctctgaagcctctctgaacctccacatccttgttcatatattaacacatggccctcctcctgggacctttacataccagaaggactggaatgagcaggaactcaggcttaggtccagtttccaccatatcctttccttcctctgggccaccaagtcaagagtccctctgcatgctgctggaggatctttgtcccaggattcagatctgtgaagtcccctggtgtgtcacattccatttatgaatacattgcaggatggttcttcagagagctggttcccttcccccttcgcaaggctgacttaacatgtaccaagtggttactgagctctggctctatgccagaaggggctatgcacaccgtccccttcctcatgaagcaggtagtcgagagcagcaaatgcgagccacatgtatatatcatattttctagtagccacattaaagcagtaaacaagcacacacctataatcacaggtattccggttggaggatcagttgagctcagaagttcgagaccagccctggcaacatagcaagatctggtctctacaaaaaaaataaacaaaattagccggtgtggtggcatgtgcctgcagtcccagctacgcaggaagctgaggcagggggatcactttagcctgggaggtcaaggctgcagtgagctgagattgcactactgcactccagcttgggtaacagagagagaccctgtcaaaaaaaataaataaaataaaggagcaaacagaaacaaacaaataaaatgttaatattatttaacatgaatatattaaaatcattgtttcaacatgtaatcaacataaattattgatgagctagcttaccctttctgtactaggtctttgaattcacgtgtgattttatactctccacctctcacttctgaggagccacatttcaagtgctgcccagtcacacttggcaggtgctgccgttctggacaacacaactccagtcctgctccgggacctggtgaagggtttaacgtcagttgtcttggcagttcctaatagagccagtctcactggagccctgttctgttttgaccagggccagcttctgagcatcccggcagcctatggggatctggagatggtccgctacctactcagcaagagactggtggagctgcccaccgagcccacggatgacaacccagccgtggtggcagcgtattttggacacacggcagttgtgcaggaattgcttgagtccttaccaggtaaatcacagggcatgagctcttaaccgtgtctcagggcaccctcttcttaggcttcaccccaaaatgtttacttcttcatgctttcaccaataatgagatcaagaaatacagggtaggccattgacacccaaacaaagtgaagcttgcctgccagccacattccacctctcactcccatgaactcataagggaaattctcaaacaccatatttcataaagaatgtaattaacattgctttttaaaaaaataattaatagaccttggtctttttagagaagttttagatttatggaaaaaatcaattggaatgtacggagttccagaattaatgatttggaggtatgttaacagaaaacaggtgatcgctaaatcacttacacaagaatatctaggtaagagagacagtaatcatgctagtaacttctattgagatggggacgcatcagtctcaggaggcaggtgctatatttcagaaccatggttttaagatgacgaaaacaaagctcagagaggtgaccctccactgtgcgccctccacatggttttccctataactctgttttgtgttagtgtgggacatttgtgacaactgatcaactaatattgataccttcttactaactaaagtccatcgcttacgttgcaattcattcttgctgttgtatatcccatcggttttgacaaatggataatgacacgtgtccatcatgacagtattacatagagcagtttcactgccctaaaaatcctctgtgctccacccctcccctggccccatccctccctccctccctccctcccctggcccctggcaactactgatcttttttactatctttgccttttccagaacatcgctctagttggaatcccacagtctgtagccgtttcaaactcacttctttcccatagcgatatgcatttaaggtttctccatgcctttttgtgacttgatagctcatttcttttaatggctgaataatattccattgtattggtgtaccacactatgttgcttttgtaggaactatttttttctctggtgaactcaagatgtcctggtctcctgtaatttcccgtggtggtcttggctcagaaacactgcaccagtctaggcaggcatcgctacagctatagggtgaggcacaccctagccatggtctttgggatttgagattttgcttgggagccagggcccacctcttgggtgggagaacatgcagtcacccagggccctgcacctagaagggcccacgttacgtttaatactctgtactcactatcttaaaatgtttcatgatttttaaacaagaagccccattcttttcattttgcattgggcctcaccccttatatagtggtcttgtttgagggtttccagctgtgggctttgatagatctgtgctcagcgttggttccaagctagtgttcccctcatgtgtctgaacagaatgaggttatgggcagaaatcagggcaattttagggcccatgagaagcatactaagacaagacataggagggcagagaggagcttgggtgctcctgaggagccaaaggctgacctgcctcttctcggggagccccaagattagctctgttctagccctgaagagtctgcaccagctgactccgtcacctaatgttagctaatatttattgaatactgtcaagtgctgaaaactgtgtagaacgtgagagacagataatttttttaaagattttcccagccatttagtacctcctggccaagcaggggaaattgaggcagaaaggagtaacactgtgcaatgtaactacactgaggttgaagtatttttacgcagaggtctgggagcacacatcagggggcagggtagggtctccgaagggaggctgacatctgacctgggctttgcagagtgaataggagtttacttggcagacaagtgaaggaaggacttgggttgcctgcttttgcagagcaggaagtgtggctgaacctcgtcatggttttcaactgctcccaggagcatcgtatcttcagctcaactctgagcaaagctgctgaggactgaaggatttcagaccattgtggtgggctttgcagaaagtgcagagatgggcaaaacagtgtgtacccatccctgcacttcctgcaaaggagttcccaagctggaagggaagtcagccatggtcaggagtaagtcaagacaagaagacaaacaagagtcaggctggacatgctggctcatgcctgtaatcccaacaatttgggaggccaaggcaagaggatcacttgagcccaggatttcatgaccagcctgggtaacatagtgagaccctgtatctacaaaaaaaaaaaaaaatttaaattaaccaggcatggtggcacatgcctatattcccaggtacttgggagggtgaagtgggagaatggcttaagcccaggagtccaaggctgcagtcagctatgatcacattactgcactccaggctgagatagaaggagaccctgtctcaaacaaaaaacaaaaacaagaagcagctagagaacaaaggagggtttgagaagaagagggatgagaggttgatgggatgcattctttgaagcacgttgttatgtgattcctggtctctgaagctgagcagggaggaagaggggctcctctgagtgtcgttggccttaggctgtagagagtacctgtaggggttttgtgtggttaagagagcaccctttgattttagacaaagcaaggtttaagtcttgaccttgctatttactaactgtgggaccttcaagaagtttccctgccaggtgtgtcccacagaccctggctgatggatgaaatgagtactcagacacaggtgtacggtgtaagagcagctgagtcactgcctggctctgttggccagagagcagcccgaagaagctagagctgcttgctttcattcagtgcaggcacaatgccgaaaacctggagccaacacaacctgtaggtaattaacatttattgttcccctttcagggaacatcaagccagcagatgatcaaaggtcagttcctggtcaacataagtaaacaagcctgtttaagatacattcccctacactccttgccctctgccttcagctgttctcccccagggctctgcagaagcttccaaactttcagaaggtttgtgtcctttccctgtagtttttcctacgactctgaccaatctcctacatttccaaacctctctgagctttggtttcctcatcttaaaatcatggtcctgaaatataatgcctgcctccaaagactgacacatccccatctcaacagaagttactagcatggttactgtgtttctcttacccagatattcttgtgtaagtggattaggggtcacttattttctgttaacatacctacaaatcattaattctggttaacagtagagggagaagaagggatatttacttggcactggctccagcctcagccctatgctacatgctttatttggtgaatacagggccatcctgaccccggtttcctgatcaatgtcctgtcgcgaaggagagagtcactctctcctcacttgggagcactttgatccctaggactatgtgcctctggaaatgaggcagtgttatgatgcatttgggaagtgtccctgcagaagatgaggtcatttttccatggcaactagacccaaaagatattgcactattttgaacttgaagatattgtaacatttcagcccacactgcccccgtcaattcaatgtgctaagtgttatttcatcctggaattaagtaggtggttctactggggagaaattgtcacttttaggcctgacagatctttcaccaaagcttttattattattattcatgaaagtaatatatgtatattatagataattttaaaatgtgggaaagtgtcagtactttaataatacaatgacacaacatcatgagttagggtttattgatccaggcacttgacatgcattttgtgatgtagtcctcacattaaacttggaagaatgagtattattattccgattttaccaacaggcaaactgaaacagagagagattaagaaatgtgtccaaaattacatactaaattattttatttctaaaatgcctgtctccaaagttcatactcctgcatgtaatgttaccctaggggaggggtgagggcaggggagagcccagagaaaataccacaatgctggggtagttgtttctagtcttatttccacacacccattttttatttggctaagatcatgctggatacgccatttttaatcctccatttcatcactcggcattatctgacaagcaggtgggtgactgatgtggggaaatgtcatatgcaattcagagagactattccagaaaacactatcaactcaacagaagcaactttcagctggaaacaggacagctgggttttgttttgttttgtttaacttttactttaggttcaggggtacatatgcaggtttgttacgtgggtaaactgcatgttgccggggttcggtatgcagattatttcgtcacctgggtaataagcatgggactcaataggtaattttttaaccttcccccttttccctccctccaccatcaagtagtccccagtgtctattgttcccttctttgtgtccacgtgcattcaatgtttagctcccccttataagtgataacatgcagtatttggttttctgttgttgcgttagttcacttaggataatgacctccagctccatccatgatgctgcaaagtacatgatctcattcttttttatggctgtatagtattccatggtgcaaatgtaccacattttatttaaccagtccattgctactagcggtctaagggaagagcagagtgggaacaaacagcacccttcagtggcactttccctttgtcctgccatctcctgccaggtccctgcagtccccagcggcttctgaactggatgctggccttggcttgccagcgagggcacctgggggttgtgaagctcctggtcctgacgcacggggctgacccggagagctacgctgtcaggaagaatgagttccctgtcatcgtgcgcttgcccctgtatgcggccatcaagtcaggtgggtttccccactaccctgagtcaaccctgaccgtgcaaaccatctcagcctccagatgtgggactgtgtctttattctcactcttggctctcaaatcacctctgtgaggagacttttgcaactcctgttctatgtttctttttcaaaatatctgcacccttcctcatttcctccttacttgcccccgcaaggggatttcagtgacagagactgactgtggctaatgggactgttgtacgaggcactccaaagggcaaagccccacagaaattctcccactaacagaaacttgatgcaccaagggaagtaaatagagaagtccaacatgcacaagtaccttttcagtttccattccacatatcagagtctgcccttccaacgactgtgacactagcatctgcatgcccttagctttttggttttgttcctttagggaatgaagacattgcaatattcctgcttcggcatggggcctatttctgttcctacatcttgctggatagtcctgaccccagcaaacatctgctgagaaagtacttcattgaagccagtcccttgcccagcagttatccgggaaaaacagtgagtagtcactgcctgtggagtgtgttttagttccttttgtgctgctgtaacagaatcctgcagactgggtaatttataataaacagaaatatatttggcttacaggtctggagattgagaagtccaagagcatagtgctggtatctggtgagggccttcatgcagtgatatgaaggtggagggcaagagaccaacagactgagagagggaagaactcacttttataacaacccaccctcaaaataacaaacccacttccacaataacaacatcaatccatttatgagggtggggccttcttggcctaatcacctcttaatggtcccatccttatcacaacagcaattacatttcatcatgagttttgaaggggacattcaagctatagcagggtgggagctgaaatctgggcttcatccccctcccagagtttttgtttttgtttctggttttttttggttgttttttttctcttttccttttttcaaaaattggttaaatatatcatatttaacatatttcttttttaaatttttatgtgttaaattttaaaattactaaagttatgaatgattgttataacaagtgatcacaattgagagtggtaatcaaaattatgaatcttctgcccttgaagtaaatagtttaacaacctggtagggatcttttcacatccttccacatgcaatgctataaaaacatttacaaaactatacagggtttagttttaatttcccattttaataacaaaaatattattgcgttatttacattgtcttcaacttggctttttaaatttagtattctatcatggacttcctctagatcagttattgtggcttcaactcattcttttagggacgttctttaaatacatagagccagtgtcacttagttgacatagctctcctgctattggtggacatttgaaatagttcttttttttttcctgttgcaatatagcctgatttgctatggtatgtttgcttatgtagagcacagtcctaaaagtgggctgctttggaaacactgccccccaacactctggtgattcacattttcaccagcaataggtgggattctctgtctccacccctcagccagcaagcagtaggcatcctggagcctattaattttcatcagtgtgaggcaaaaataatttctgcttattttaatttccatgttatattagtaataatactggatatcttttcatatgttcatgaactatttgcattccctttatgtgaactgcctgttaatgtttgttgattattttttctaaaggattgtttgtctttttttctcactttggagggtttttttttttttgaacattagagatttttaagactttatcataaatgttgccaatatttttcccaatccattatttttctttttttgttatcttttgtgatagcaaaggtaaaataatacataattcaatatgttcatcttctcctttctggtatgtggttatacaagaaggccactttccctctaattttatttcagtattctcctggagttccttgtaatgttttcattcatttagtttttacattttaagctttaacctttctggtatttatttgtgtgtattgtatgagggaagtggcagagggtggaggtggctagcttttatctcttccagatagccagctactctagcacagtttttaaaatgaagttttctttctcatctgaattgagatgtcaccattggcattttccccagtacctatatctgtatacattttgggattctcagtactggttcactggcctattaatctgtttctggcaaatgtcatattgtttcgattataggcactgcatttaagttttacaatctgttaatgcaagttttctgttcattagtttttttcaaagatatcttgactggactattatcggacatttgttcttctattttgctcatttcccacagtgactctatttgtgtagcttttatgttctttaatgagatttttttcttttcttcctaaaactcctggacctgtcttgtctgttagtgacttttatattgtttttgctaccattttaatgaactatctatatatttatataactcttttccatttctattccaacctgatgttactggtatggagaaaagttattttgtttatttctgttttatccagttcctttcccatcttctcttattcactctaatgtagtttttactagaattcctcaatacttttggatatatgatcacatattctacaaattcaaaacaagtttatctcttttttctaatatttatacaacttattattccatgtcttattgtgtatctttagaaatctcaaaaactgaataatcatgactctagcagttatatctatcttgttcctgattttaaatgtcttggtgtcaccaatttataagcatttgctctggacagttagcaaataggttcttgttatatttaggtagtttccatgtattcatttttgctttgagtttttattaggaaacattactgaactttttcaaatccctttttgcagcaattagtgtattcatatagcttttctactttattgatttaataaatgattttgatagatgttgactcaaccttgaactcctattataaatgctcattgtctttttttaactgctggatttgatctattgatattttatttacagtttctgcatctgtgtttataggtgaattgatctataattttctatttttaatgtttctatgtggttttatataagatgatgctagctttacaaaataacatggggaactttccatcttattattatctggagaagtctcacaggaattatttattgttaatggttaattagataaagcagatctttattttctgattccttttgaagtcatttgtcaattcacattgtctgctttcccttatatgcaagtcaggaaattatattttggtagaaaattatccatttcctttaggtttttgaatttgccatcataatgttgcattgacatttttctcattcttttcttctatatctatacttatattactcttttcatttatgctgttgaacagttttactttttctctttcaaacttaatcaaattagccagagatttatgttaaaatacaaggaactgtcaaggaacttgatagattttttaaaattacttgttttgtttgttatttcattaattttcacttctgtctgtattaaaaccctcttcatatggttgtttttggggttttgttttgttttgtttctgttcttgttttttgagatggagtttcactcttgtcacccaggctggagtgcaatggcgtggtctcagctcactgtaacctccacctcccgggtccaagcaattcccctgcctcagcctcccaagtagcagggattacaggtgtgcaacaccacaccaagctgatttttgtatttttagtagagatgggatttcaccatgttggtcaggctagtcttgacctcaggtgatccacccgcctcggcctcccaaagtggtgggattacaggcatgagccaccgtgcccggcccatatgttcttttttgagagttttgttgatggtgttgaggttaaagcaaggccttggcatgagacttcctggttcttatctggactccaggcttcagtactgcagggccttcgtctgtgtcttggtttaatgggaaaagcaataaaatacctgtctcagagggatgcttgacaaataagtgtagtaatatttgtgacatcctaatagcaaagcctggcacgtagcaaacgcctaatagatgttacctgtttcttgagttgaatatttatttcttcctcctttttctctaattttagcttgttgattacagtatttgagccctttatgtgctgcctgtttgtgctagctttctttatcagagcctgaaatatagatatagagatatatagatatatagagatgtacaagtgtacatacatccatcgatacaagtacatatatttatttcccacttctgatgatttttaaaatctcattcttcttatgtctctacaaggttttgcttgacatacctggtttctggctttatgactcatcaatacctattttggttatatcaaatggccaccttaatcctgttgatgtctctgtccttgaaattgagtttgttttctcttcacgtgtccactttgccctgtttttctttgtgtcaaccttggataagttttcccagatatttattttcaggtttttatttgtctctttgccgtaggtatatttcttgtaaacagcatttggtttttaatctcatctgagtgtgtttcttttgaacgagggatccacccacttcatatttgtgtacaacctgtcctattagtatatatttttccatctctttaatttatatttattactatttcctttttacccttcccttattcctgctggtttcctagtttctaaagaatactgatattctactttctgtatatttctacctatctgttccttggttggttttctcagttataaaacagggataacaatgcccttcacagggcagctgtgcacttagcacaggccctggcacataataagtgctcaataaatattagttatattgctattagccgcacatcaccaaaagaaatgatgatcatctaacccttacatctatgtagtgcttgttacttttccaagcactttcttaactaatttggtccttataacacctcggtaagaactgcagggaatagcatctgttttacatatgaaattattggggtataaagacattacgttatttgtccaaggatgacaaatactaaacagtattgatgcttagactcccgaacacagttcctgaactgtaccgcctaggtttcacatagacgaatgattctctgcacatcataatccctgggaactttttaaaatcctgatgctcagaccacatcttacactgattaaatctgaatctgtagcgtgagacccggcatgaggagttttagaaattctccaggtgattccaatgtgcacccaaggtcaagagccagtggctccgattttcttggtgtaagggtaaaagcagaaacagctgttatcttctacctgtgatcttttctgtgaggcaactcttcttacacatgccaaggttggcatagagcatggaggaagcgattactgcattttgtgaatgaaaagacaaggaaaaggcaatggtgcttttcctctaactggctctgttgcgtggaatcagaagaggaaatgaaatttcagcgcaacctgagtctcaagggctccttgagcttccccaaagcaggtggtatttttagcattcaagtgaatttcagaggcaagtaccttggagtgggtgtgcctggctgccccgtcatctctaacctgcaacagcacattccttcggtgctgctggcagaagagaacagagaggggtccgggcagagggttccggcagtcaggaaggatgactcaggagccagaggtaagtgctcctaccttcccaggtatccagtgggattaaagtgacagtttgggttggttcagaatattacacaagggtaggtattaaaagggtgcttcactgacatgacacatggtctgaaaaggcctttggcactgctggcactcatggctgtgaccttgttgaagtaacggtcccttcagggcacgtgtgacggaggttgttgctccagccctggtacaacaagcagtcacgggccacgcgatgatgtcttagggagatcatgcatgtgccatcgtgttttttgtgtggttgagctctgcctgacacaccagctggtcagtattttttaatgtaattgctgcgtgtgtggaagccacagccgacccaggtacagcagcccctctgcatgtttctgggccaagcatagcccgaatccacctctgcccgcaaagggagaaaatacagagaaacccacatttgttttccattggcagtggctggctgcttgggttttgctggtgtttggatgaagaaggttccagaggccacactgtatggtctggactgctgggacacactctctaagaaacaaaagtgaagtaaagtcagacctggccatgctgtttgcctggctgggcagtgctcctcttaaagctgctaaagttttgcctgaacatctaatgagacggcccgcgttcgtggtgaacatcgggtcaatgtttagctgcgttgccatgagaaatagcttaatgctttgatgttgtcacacccagaaaggaacaagaaaactcagaaatgccaggaaaagcctaatcagatcccagaataaccacgatgttcgctcctgttcagcagttagagggccaggctgagggctcactggggctgttttaagtgtggaagtagagcagacctgaaattaactttcaaacaacccaatggggaaattattaatttccttttaaaagtctctaatgatttcaaatctggcagctaacctaaagagagagggacatctattattactgtttggatcagttccggcatatgtagctttcaagttcctggtgccccacccttcatgtctgtgtgtcagtgccctgagcgcaagcagcccagctgcacatcctcagggttaaggcaggcgttttactggggccatgcaagctgctgctggaggcagctgagccagggctgcgtgctcatgagagtgcctgatggctgggggctggtggcctttcctgagggacacctgaggcctctggggaacaaccctgtcttagataggacctcacatttggtgcagagggtgtcactccagagtttcgtgcattgcagagcacttccgcacacatcaccaccgccctggcgccacataccctcttctcagcaggcggtgctgctgtaggagccaacgtgggcactggcattcccagaattcagcctggcccagcaaggcccccatggtgacagccagggctggggcatggaccctgactcctcttggcctggcctgttccacagtcgctcgtgtgaacagaagaggaggcccttttcctaccctctgagggtcatgaagtaaaccctggactgttcccagcatccttccaccagttccactattcttgtgtcctggtgagcagttcagtccattgtcccacacatgcccattttctccaggttccaaatactgaagctttccctgtcctcttcctctgcccatatgttttccctgtggaataggagacaaatgtgatgctatccatgtgcatgttagtgcttcatagaactcgaaaatgggtagccagggtcacgtggcagaataagtgaaggggaacagcgcgtggcttctcagtcctgtgttcatgtcgtcctgctggattttaagacatccgacaaagcagtgagcatgtcagtcacttgtatttagttaacgacagagaaaaatgattaagctagacaggcagaaacagaaaaactattatttgaacttcagtgacaaactagaagacgtaatgagaaaagaataagaaagagaataagagtaagaaacattagccaaggctgtgagaactgttggagttcagcacagagatttagattcattatgatacaaatggattctagacaagttagcgttaagctttgaaaactcatcagaatatgcatatctatagatatgattattaatataatcatatctatagatcttatatctatagagacatatatatatttaaaagcatgtttatcccagttataagagggagatgactgcctttcaatttctaaacatatatgaagatatatgatcagaaataacatgaacattaaagcaaaattatttatactaaaacataattttaaaaagaaaagacatggaaaatatttcggaaaaaataactgacaaacacttaaatccaaggtagatcattggtgcaactccatgtcagctgatgatcgaatttaatttagccaaagtttatcgatctcctgccagatgcttgggacccagcagtgatggccagacctttgccctggctgtcacagtgctcacagattccagcaagtaaaaatttgagagaatgaacagttaatttacatataagaaaacactggcagtaaatcatggcatggaaacatacacaacatcactggcaattacagaaattcaaattcaaacagcttgcaagtactgtcacacacctattaaactagcaaaaataaatatacacaatgagtaagacatttggcagagcacagagcaacggacacaccagggtcttgctgctggcactgtgaattggttccatatgtgtggaaagtaattggcatcatgtggcaaaagctataaacctcttttctcccagtgaactgttctgaattcaatatttcctttctgaagaatacctctaggacagaattcaaatgaaatcaatagtgatggccacaaacatggccacagcactgctgtttatgataagaagacatgggggaaagaaaccaacatgtctgctgggtgcggtggctcacgcctataatcccagcacattgggaggccaaggtggtggatcatctgaggttaggagttcgagaccagcctggccaacatggtgaaacccccccgtctctactaaaaatacaaacatgagttgggtgtggtggtgcatgcctataatcccagctactgtggggctgagacaggagaatcgcttgaaactgggaggcaaggttgcagtgagccgagatagtgccattgcacttcagcctggacgacagaacaagactctgtctcaaaaaaaaaaaaaaaaagaaaggaagccaaaatatctggtggcagggaaagactataccatccatgctgtaccagcaagcagaccacgcctagccaggaaaaagcgagcctgcctcctcagcactcagcactcagcacactgctcctcctcgacccaggacaccctgcagatccccacacaatatcctcaggaaagccttccttaaccctcaggcctggtcacttgcccccaccccaaccttctatgtctcagagctccctgtcagttttattcaaagcactaaacaaagtttgggttatttgtttgggtgacattcttctttaatcaatttctccacatgactagaagcttcctcaaagcagaaaccttggccaattttgctcaccctgtgtttgcccctccgtataggacttggaacacgatagataggtgggtaggtagaaaatggatgggtgggtgggtgggtgtgtggatggatggatagatggatagttgcttggatagatagatgggtcagtggatggttgcatggatggataggaggatgatagatggatgaatggatagaaggatggatagatagatgggtgggtagacaggtgggttgatggttacatggttgcatggatggatggatgaatggatggatagatagatgggtgggtagatgggtgggtggatgattgcatggttgcatggatgaacaggtgggtgggtggatagatggatggatgaatgaatgggtggatggttgaaatttttgtatgcagtaacctcctttctgtttacgtagggcctcatagctttaaaaaagtactttgccaaacattgtattttaatctcttatacagcctgtgaggtggaagttttgtctttatttacaagttgagaaaactgagggttctctcgaaagcaagttaagtagcttagttaactgcagacaccatatttttatttcttgcatttttttccctctttcaaatagctattggcaaaattcctaagctggaactagtgacaggagatttcttgtaagtttcctatttttaaaagaaatgactgaaatattacagaaaaaagtacaatgttgctttttgttttaaaaacctctctacctgttttttaagaattttagcaaagaaaaagtgatgaattttactaaacacatcttttggcattcacttgcttaaaagagaagctcagtttccctttctctgatagggtgtgctgtgctcctccctaaattactgtcacgcccttgtctttgttcagaccctacctggccagagaacttaactctctgagtttagttgtagctgattaaatattttgttgcagttttgtatccatgtgcgtacatgtaattgggctggaattttaatggcccttgcaaagtaactggttttgactcataaaatgaaatgagtcctgtattaaggaaccacttacataacataggaactatttgttatttgaaatatttgactgggaaaaaattatattgaattaggagacttggggagctgattctctattttccttgtttgtttcatacaatgtttgttttttctctgatcgtgtcactgatgatttttattttggtaagtaaatctgacatttctacttccagattgtttgcctagagtctggacttgtagccacagattgttacaacgactgtttagtacagattgttacatgttgactgtttaatatatgatcagaagtgtatcttgtaagttatttttgtacttaggtttctcatttatctggtttcaacggtaatatttcctttctttgtttaaacatattggcagccaaccactaattctgatatttacaatattttttaacagacatgctattgtcaaaactgacttcattgttttatctcattcagtcttttatttaagtgggtaaacccctctaagattagaaggaaactgtcccccattttcttgtctctcctttccctactccctgtggtggttattctcaagtcctttctgaaattctccatttacatcatagagtcctcacaggctttccccaaatttaatagctgatttttctgtcattgtcattaccttttaaaattacatttctaatctacttagcaggaatgcttttggctttctaagagtctgttccttgcctttccttttgttatctgtgtgatcatgaccataatctgtgtcaatggaatgttcccagctctctggtcccaacctcccctctcttcccttgactcattaccatctgaattcttagaactgctgtaacaaagcacccaaaactgggtggcttaacacaacagaaatgtattctctcacggtcctggaggtcagcagtccacggtcaaggtgttggaagggtcggcttctcctggaagccctgagggagggtctttccctgccccttccagctgctggggactgctggtggtccccaacacttctcggcttgtggccacatctcccccgtcatctgctgtcttctccctgtgtcttcacatcgtcttcccgttgtctgcctctgttcacgtttctcctttttcataagaacaccagtcatgttggatgatggcccccacaataacctcattttggctagatgacctctgtttttaattaaagtcacattccgcagtacggggcgttaggacttcagcatatctttttggagggacacactgcaacccgtcacaccatccttgctgccttcacttcattgcccttggcctggatccacctgccatgggccaccttagatgccaggtagacggccagtcaaggtacagtgtcctcatcctcccgttttcaatgcctcctttctccttaagagcttgtctctaccagagtgcaggaacttgagaagtaggtgtttagaaaacccacaatgaatattcctcctgggagcagagatgaggcacagtttgtttggttctgttgtggcctttacatgcacaaggatgctgggacagagctgctgtctgtggtgtttccagttctctgtcactgaatccctgtcactcagggccccgtctgatggtctgagttcccagagttctctgggaacctgtagccttgaaatttaccttcagcttgtgggcgtcggtgcacagacgctctctgcagccatcgtctcatctctactataatcactggcgtcatgcagataacctgggatgagccttcagatgccatttctgggcctgctgctctgagcatctttgttttcagggcttcttttggcattttctccaggcctttgagtgagtctccccattttagattaggttcattgattttgcagcttctttggctgttcagttgttcttattgttacttctgcgtatcagaatgtggctcttgtcttactggctggttcaacaaggaggaggcaccgtcccaggaatctttgcttaactgcagaaagaaagacttggggtttgtatgggccaagaattgacaagttcaagaactttctgtgtatttccccccattgtaacgtgtgtcttcattgaatagatacctattaactgcttttactgtggtgtgcccttttgtcactgagctatagtctgtgctctgaagggatctacggtttctaggggggaagattcttactcatgagccataagcaaaatactgaccaactgacaggaacaaggagctgcagacacaggaagagctatgaattctgctgtggggtcagtgagacctagcaaggagctaacattacaacgtcactccggcaaggctgctcttgaccccacagaatcgtacagaggaacacctgtgtgcatatgtcacaggggccaggaatcgttttcggagtctgccctgggctggggtgccagccacatctgctgaggttcaaaccaggctaaaagctttgtagatgccagctcttcattgaacaatttttttcttcaactaataggtttgcactgatataaaaacataagagatgtcattgtggggcaatgcctcattcactgtgacaattttatggctaacatctccaagaagcatcatgtgaaggtgtctagcaccctcctgaacagcagcctccatcaccagatgaggagatctttcttatacatcagtctctaatgaagcagttgcccttaaatacacctaatccttcttgaaagcaatccaagtcaccaccactgccgtggaaaacaagtttctgaaatcattgcactgagccttctcgagaaagtggtacttccttttacttggactgaaatttaaagggctcatgcttgaaaaaccaacatgaacacattctccacctgtttgtgatagggtgggtggagcttaaccactcctgtgttgaattgatggcttctccttaaccagctgtctttgattttgtagtttagccttcatggataggattatataattgctggctttgctctctcggaatcttgtttattgtgattctgcctggactagacacaaataaataatgagggctaatgagggcttcagggctggaagagttaggttttaatgtcaagtgcatgaacatctttttatttatttattttttattttgagatggaatctggctctgtcacccaggttggagtgcaggggtgcaatctcagctcactgcaacttccatctcccgggttcaagtgattcggcctcagcctcccaagtagctgggactacaggtgtgcaccaccacacctggttattttttcatatttttagtagagacagggtttcaccatgttgtccaggctgatcgtgagctcctggcttcaagtgatccacctgccttggcctcccaaagttctgggattacaggcatgagccactgcgcccagccctggacaacttttttaactgtgcattttttctagtttctctctgccactttgtggacacctgggcaccctgtaatgtctgtgcttgaacaagaaaataacttttgtaaatcagttttcagactagccccagaccaggtagaaattgcacaggtttttcaacctccatccagcccagaaaccatttccaagcatgtctattttccgagtgtcaacatttttgcagacttctgctttttaccacttccctcccagcttgagtttatcagatgtcagtcctgcagaagcacagtgggtatgtgcctacagagagctctgggaacaggcaacatctgctttctccaagaggagaaaggaggtccactctaagggtgtatgcaaagaccctctgtattattctctttttacactgctgataaaaacatacttgagactgggtaatttataaagaaaaagaggtttaatggactcacagttccacatggctggggaggcctcacaatcatggcagaaggtgaaagacacgtcttacatggcagcaggcaagagagagaatgagagacaagtgaaaggggcttccccttataaaaccatcagatctcatgagacttgttcactatcatgagaacagtatgggggaaaccgccccatgatttaattatcttccaccaggtgcctcccacaacacataggaattatgggagctacccgtaattctctatctccttcaggatgagatttgggtggggacacagccaaaccatatcaccctcttagctccaggcccagcccaccttgtacttcccatgttgtcctcccatcttggcccctttggtcaccatggtaacccacattccagtagggaggcgggggaggtctgcagccccagagcaccccagcagccctttgagcacatgggccagtcagttaccaacagcacggctacacccttgtggtccccaaaacccttcctacaaatgtcaatgttgggcctacttgtgagccctgcagttgatttatgaacaagcagtttctgcactttgattggcagcttttccttggcctcgaattcccctgccctgggagtgtgccccttcccctaatttcttttacccagaataaattaaccccacaaatcactgccagtaggaaggcaaagggcatcgctatagatcagaggctgctctgggtgggcagggagaagctatgaaagaggcaggaagacataaagttggaaaagtgggttggagccaactggggggctgtcaggctgcaaaggagggactttggatgttctgctaaaggcggagtgggctagggagagctgaaaggtcttgcgcagactttgatatttcaggatgattgatctggtaagaagtgcacagagtggatagcttgcaggtcttggtggcttgaatctcttcagctcacaaacactgatttagtgtctgctgcatagtgggtatgaggttgagctgcagaggcagccaggcagggctctgcactgtggggtgtgcagtccgggttccggttggccatgctgtctgccacagcaaaagaaatgtgggctgagtcagtgccacacagatcagtggagaggttaatacaaagtgtctcaagctgaacagagcccaaaaaagtgctcacctccactgcggcttgcccagagtccacgtggagttagttaagcagcctgaggctgagcccctgctccttctgcagttcagggctccagccccagctcaggggatgtggaggaggtgctgagagggaggctgccattgtaaggacagccacacctaagcccttccccaaggtatttgtaccataattgggtcatgttacagtaataatttgattacttgctgttgttttgtttattttatgatggtccccagagttttatttaaagattttcaatagagacttaagatttgttgtcaaagccaaaaccataaccagcctcccctgcatcttgcatttggctgccatttcagtttgggtaccaaccattccatacggaaagaccataatggccacgcagagtgagtggagagggttggattgcaatctggacaccttgattccatgttcagctgtctggcccttgcccctgagacctgggtgtgtctctgtgaatccaggaaggagaggcagacaggccctgtggagccttttttgacttggcattgcaaagtccacatggtgaccttcctgtcagcctgttgctgggctgactgtcatgcttatccaaagactcctacccaaaggccactgtactttgcaagacgaccaccggaaacaatattgggacgagaactgacctaggcatcatctgatccaagccacttatttaacagattaaaaacaatgataatggaatgaagagtgatacagtcgtgaattgtggattatggaaagatgagggaaaaaaacccctttgctgcattgaattggaggcatcagaacacactcatgttaaatacagagctgtgtcccatcaatgggctgaaaagcagtgacaccccagcggtgatgagcacacctcacacccagatcttggtttctaaataccaatttttgctcaagggaatcaaggcctgggcttagaaagtacaagaggagactggaagatcttgttttgccgggaagtaaggaggcgtcccaaaattgacagcgatatgtcacaggaacacagggggctctctcccaccccagtggggctccccctggacaaattggggatgacttgggtgtcaaaaaaataatgatacttgggaaaaaaaagaatccatgagtccatagtgatacttaaacaggtgaggaggcaatgcttttctatacagaagaatgccaggtaatacatgtagaaagaaaggtagctttagcaaaactttctcattgcaaccaccgttgtactaattgattcaggccaggatcagcaacggaggctaaacccatggggcaaaaggatgcagaaacacagaattgtcacatagtctcagaatatcaccccatagattgtgtactaatcgcaaagggtataatgttaacctttacaaaggagggactgatagacaccaccttaaccatgagaccaaacagggcaccacctgtagcaggaacacctaatatcaggtgccccgggtggggtttagtgggaaccactcaactagactctaaggttgttgcccaaaatagctaactttaatctaaactttaggaaaaacttgagtaaattcagattatgggatattctataagacaagcagtgaaacacaccagcatctgcccccgatgaagaggctaaaagttgcaggacttaatgcaacgacaatgtgataaaaaaaaaaaaaaaaaaaagaaaaggcattaaaaggtgtgaagactcttccagatgaaagaaaagtaaagaaacatacagtgtaatgcagtgtgtgattgcaatgtcatgcaattgtcaagggatcccagatcaggacacaaaatagttataaaccacatttctgggataattgagaatattctaacatgggctgtgaacttaataatatcgtattgatgttacacttactgaaaatgataattatacggctgttgtgtagaaaaatattattcttcagggatacatgctgaagtatttacgggtgaagcatcacgatgtataatttactggcaaatgattcatcaaaacataaaaagcgtgtgtatttgtgtggagaaagaggggcaaaagcctatgtgacagcgttttaacaatcagtgagtcgaggtggagagtgcacaggtattcactgtgtcctagtgcaacttttctgaaatttaaaaaatttttcaaaattaaaatgtggggagtaaaatagtaacaatcaaacaggcccagggcaattgagtgacttgtcttaaaaaatcagctcagaatctaccctcctggcctaagatccagtgccgcccttcccttttcatccatgtgaacagagagacagacagacagagcgacagagtccctcattcctctggttcaaagaccggacggagtgttgaggggcgtaggcccagtctttccaaactcctggagtgggcggaggaggagctaaagacaggcgctcatcgccatctggtggccaaatagggatgcccgtcacctgccgccaatttttgaggaattcatcccacgttattgggacctttctcgtagcctctgcttgttacattttcccatttgcgaagcactaatttttgttcatatttctgctcctctaattttccaatacggatttccagttgcttcgaagaaacagacccaaaagcagatttcttctccccagaaacctgattgagcccaatattcttcggtaatcaggaagaaagagcaaagtcctgctcccatatatttcgccaggtccctttgaccaccccatgccggaaaaccgctggcccttctgactccctctggtggaaataaaggaagaccagtgagaaatgagtggagcaaagacattttgtttagcaggacttcaacggcaagagcgccagccaccaggacttgcgtgtggcagagacccacaggctggcagaggagcgggagctttctagtgggacaaagggaaggcctccggggcctcctgccgggaggccgttgtcgtggggaagctggggggcctcgctgcaggctgggcatcctatgggattggtaggggtgcaaagttggctctctcgggttggtcctaaatggaaagtgaggacaaaaattagagaatcggtcagttattaaccaagtcctggccattttagactgacttttacggaaatgatggcttagcttcctgggttgttactagagataagaagtggctcatgcctgtaattgcagcactttgggaggccaaggtgggtggattgcccgaggtcaggagtttgagaccagcctgagctcgacgaacatggtgaaacaccgtctctaataaaaacacaaaaattagccgtgagtggtggtgcagctactgaggaggctgaggcaggagaatcgcttgaacccgggaagcggcggttgcagtgagccgagatcgcaccactgcactccagcctgggcgacagagcgagactccatctcaaaaaaaaaaaaaaaaaaaaaaaaaaaaaaaaaagaggctggcctcctgcaagagactggcttcccgggctgtttgctatagataaagaggttggtttcctaggcaggtcactgtgggtcgtgggccagagttctgttttttatatattgtgtggccatcgtctgtctgtatctcaggctcgctctgaaagcagcctgtccaccaagcaccctggcgcggtgcgggcagctgcaggcggcagctcctctgatcacaggaaaggccgccttgaagggaggtcagagacttgggtttgggagtcagctttcttctccagtctgggggaggcgcctggacgcttcagcggtctcctctgtacgtggacaatcccgccgcgctcttccctgtgagccgcctcttgaggggcggcactgagcccgcgcccaccggcgccctctggaggttggagggtgacttgcaggcgctgtgcacagattgcctgtgagacgcaggtgccgatgggaacaggtagctcttctgcacccaccaccgtggcaggtgccggcggccgagaaggacatgtgcaggcctcttgggacccgggctggagcaggcacacagacgcgcatttgcattaacccttgctttattccaagcccatgtgggccctgaactcaccctccacatgtgcttttcctttctttccaccaccaggctctccgtgtgaaatggtcccatctcagactgccctgggtagacctagactggctcatagacatctcctgccagatcacggagctcgacctttctgccaactgcctggcgaccctcccctcggttatcccctggggcctcatcaatctccggaagctgaacctctccgacaaccacctgggggagctgcctggcgtgcagtcatcggacgaaatcatctgttccaggtggctccccggggtgtgaccggagccgtgtgtgaccccgctgtcaccgttgtgctcctgcacatgctcccgggttgtattttgtggttttgggggaaaaatgttctggctaaaataggagaaggagttttgcctaccctgaggcaagcctccctttcaggttaaaacagagaggtttagagagatcatttgtctggcccaagtttacacagctcacccggggacatgcgaatgcttgcctgagatgcttgtcttggtcctgcccaggaatcagatgagggcagccaaaccttcccacactggtggatgcaatggggctctgaggcaccagcttttactctgccttccagggaaagtgggaagggcctcagagaaagggttaactctgcaggactctggcagcaggtggacagtgtgggcagtccaggcttgcttcttctggaggccttggagggagacctgagccttacccctgagcttgcatggaaggaggaatgaccttagttgatttctttattttttatttttatttttattttttttgagacggagtctcactctgctgcccaactggagtgcagtggcataatctcggctcatggcaacctgcaactccctggttcaagcaattctcctgtctcagcctcccgagtaactgggattacaggcacatgccaccacacccagctaatttttgtatttttagtagagacggggtttcaccgtgttggccaggatggtcttgacctcctgacctcatgatccgcctgcctcggcctcccaaagtgctgagattacaggcatgagccaccgcacctggcctgatttcttttggacacataactgcaagtcctcattccataaagggttgaatcgatttttaaaatgaaaaaccaaggctctaagtgaagcaagagtcaagaatgttggaaagagcttggggtaggcattaatccatgggactcccaagtgagaacgggaaagaagcctgcacaccagaacttaaaaagcaagtgccgtccaagtgaggcccttcacctgggccagatggacaggtccagaaggttcaaagccctgctctgtggtctcagcagctttcagggaacctactcattttgctattacatgcctgcgaaggattcgaatccctgttggtcagtggagccagggcccaccgatgagaggtttgtctttatctacacaggacacagtaagagttcttcaaaagaattaaaaatcatatgcactacattttcaatgcacactctttaaccttgcatggggagaaaaagaaaaaaaatacacctcttggtttatagaaaaatatgtaaatttggtgttttccctctttattctgatgcctgccttccttcttctccatcgcaggctacttgaaattgacatttccagcaacaagttgtcccacctccctcctggattcttgcacctctcaaaacttcaaaaactgacagcttcaaaaaattgtttagaaaaattgttcgaagaagaaaatggtatgttttctcatcaacttgagtgaattagtcattttcttcttggtagggatatttttaccaattcatactttgggtctttttttttttttttagccactaactggataggtttacggaagctacaggaacttgatatatctgacaataaattgacagaactccctgccctgttccttcactctttcaagtccctcaattctctgaatgtctccagaaacaacctgaaggtgtttccagatccctgggcctgccctttggtgagtatcacaccaaaagtcatgaaagccacagtcaactctgcctctcagctggcctcagagagccctcaggtgcattatgtcagttcatcccctcagcagcgaagccgggtagaagggcccggttcccacattgtaagcatcgtcactcagcatacagcgaggctgtgtcccaggcagatgactcacctgaaagccagcctgcctggctctgggttcaagagccacccagcaacacccacagaactttacccagggacagctttcaccctggcacaggacgactcatgcctgaaaaaaggagggttcagttcttttaggacaactatcacataagagtaagaaatcaggccgggcgctatggctcatgcctgtaatcccagcactttgggaggccaaggtaggtggatcacaaggtcaggagattgagaccatcctggccaacatggtgaaaccccgtctctactaaaattaaaaaaaaaaaaaaaataagctgggcgtggtggcacgtggctgtagtcccagctacgcaggaggctgaggccagggaattgcttttaccggggaggcagaggttgcagtgagccgagattgcaccattgcactccagtctggtgacagagcaagactctgtctcaaaaaaaaaaaaaaaaaagcatcaatctgcactcgtagcactgctgattaaatgctgtttttgcatctggggaattttgcttgttaaaacagatggaatagcatgaagaatgtgtgtgtgtgtgtgtgcatgtgtgtgtgtgttatggctgttggttttaaaccaggaaactcttcatcactggcattatcattcctagtttggccattcgtgtaggggaaaccagcttctctctccagtgtggtcctgaattgttccattatttccaaggacaatgggccggatgttctggaatgaaggaaaaagaccatgagctcccccaggaaaccccattcctgtcccttccttggagtaggggcgggaggacaaggacagtgagggtgtgcagccttccagcaacactcagtcatcttcattacaggacattattgtaatggtccatttttaacatcaaatttggaaacagtctcaaaggcaccactgcatttaaagagctaactaatatacatttttttttctcgtcaatctcttagaaatgttgtaaagcttccagaaatgccctggaatgtctgccagacaaaatggctgtcttttggaaaaatcacctgaaggatgtggatttctcagaaaacgcactcaaagaagttcccctgggacttttccagcttgatgtaagcctaatagccctttctttctcattttcggcttttgagagaaaattgctccgtgttgcagtgaaatgtatgtgcttttcctgagcttctgagataaatataaggggaaaagatgaagaaaaagttcagctatcaaaaatatgcatggccacgaacagcgatgagggtggcacgtggacagcagaagcagctgtgtcaggtggtggtggggttatggttcgtatccctcgggactttctttaagtccacggcctgcccatatatgaggctgagtggacactgagagctccaggaagggcctttccacggaaccctgtgtgcctaccccagaatacgggtaccttctcgctttaggttgttttaggtggttggcgggtccttaggcagacaggccgtggatcacactcattgcttggagctcagggccaaccccagaaggggccccatcagggcagcctcaccaggggccctgtagtggacccccaggcagagtgcccaggccaccctgcacaggcttcagcccccggtcctgccaggccactgccaggacccccacgggcactcctccaaggcctggtgcagcctcttgtgtgcggcgacccccacaaggcagcgaaggccccttcagcatgtgtatcctcagagaggatgggctatcatgtcctaggctcctgacaagcacagggcaaagccagggacccagggacaggactcacgcttctcagaagaaaggagccacgcggggtgcccccgggggggggtggtcccacatcatactcctcgcagggtactcctggccttcaggccttgtccacagcccctgggcccctgttctgagtctgtcttctcgtatttcacaccaacaactagcaggcttggatttttggcttcccccaaagcccagaagcagcaaatcaggagaggcagagccttgtccagagcttcactgtgggcctgcagggaatgtgtctgctcgaggtctccttctccacactgggaaggggtgggtgggtatgtgggggcttgggggaccctgaggtctggcacatggcagggtctccatagaatttcagcaggagggggctggctgcagcggttctgatggtgggcggtggcgtgagccccttcaacaaggaaggagacaaaagcaccaggaggagagaatttaatgtggggcagcaaacagcctgtggccctcctgaggccgccctggttgtgggcgggatagttggtggctgtggtgatgtcctcaagcagggagatagcatgtctaaggtactcctgcaaagtaaaacgtgggccaggcatgatggctcagacctgggcacggcgactcagaaccgtactcccagcactttgcgaggccaaaatggggggactgcttgaggccaggagtttgaggctgtagcaagctatgatcacaccgctgcactccagcctaagaaacagagcgagaccctatctctaaaaaagtaaataaataaaaagaataacaaaaaaagaataaaacgtgttacaggtgcaaggtagcccctcatcccccttggtgactgggttccctgcagggtctgtttgcagtagggctgagggagggctacccacgaggggcaccccagacatgctgataatcctgaggggcccagcttgggactgtgtcggctagcagagggcatgcggctaggacagttacccttggtggcactgccaccccgtccccagacctgggctggcccaggaggccacccaccaggaggtggcagacaccagcactgtactgcatgccccatgccacccccaccagccgtgagccgttgtcctccaaaccatcagagtctggcactttccccagagagacacaccggtaatcagtactcttaagaatccttaatgctgacagctgcttgggctcctttcactctagaataattgcctctcactgcctttgagggaggagctcctgtagatagatggccccgtcgcactgtttgatatcatttcgtgagtttgaagaggctgctgggccccacacagctgggatctgcgtgaaggaaaattggttggaatcgtttgactgcgcgtggttgggaactgactggctcttcagtctcccctcccttcttgtatctgatgctatcttagcttctctctccctccctctctctctcaggccctcatgttcttgaggttacaggggaaccagctggcggcacttccacctcaagagaagtggacctgcaggcagctcaaaaccctggatctctccagaaaccaacttggcaagtaagcaggggcctctcctccctggccagttccaaagcgtgtgtggggccacggtcgagcaggtcctctgaatggtggcatgtgagtctgcgagggctgctgagccgccagctgggggcttaacaacagaaatcactgcctcacagccctgggggctgaagtccgaggtgagggtgtgggcaggcctggttggtttctcctgaggcccctctccttagcttgcagatgccgtcttctccctgtgtcctgttgcggtcaggcctctgttcacgtctgtgacctaatctcctcttcttataaggacaccagtcggattggattagagtccatcctaatgacctcattttaacttagttacctccttaacagccctgtttccaaatacagtcacattctgaggaattggaggttagggcttcgacacaggaatgtggggggaaacagcccctaatggtgtcctctcatttttaatttttagtctgctggagaatcttgtctctcacttcagcccaatctgtaattctgttcaaaagtctctgctgatcactaactgaaatggacgtggaattgaataaaagcacccagccccaaagccttccaataggtggaaagccgggatgagcccagccagcctctggagaccagccgcccccgttatctgcagaaggccacttctgcagtatcacggtggaacttgcaccccaaggaggacctctgcggggaggggtgggggcagtgaaaaaggcagccgccactgcagcgtgcgcccctgccaggccctgaagagttgcacatgaattgctccctatctccgtggcttggcattataacatcacagccaaaagtaatgcttttgtcgtgctgtcctcaaattttgtctctttttcctccccccagaaatgaagatggactgaaaacgaagcgtattgcctttttcaccaccagaggtcgccagcgctccgggactgaggcaggtgtgtgtgggttgggagacggtgttcccagatgagacagccggggtagcctggttcctgctccaccaaagtggggatcgcccttatcttgggccttccccttcaatgccctgttgcaatgccacagatgtccaagttcaaatgaaaaccctgcatatgagctgcgcccattctttctgtcccacgtgtgacacgcaagtatcctcaagccccactctcctgcgtggaggccagtgatgccagcagctaatatgtgcagctgatctacacaccaggcagtgccctaggcaggttacatatgtgagagtttctcatcctcacaacgtgaggtatgggccacatttccccattttgcacgtggggagactgaggctcccagggtgtctgagcttggctgccacaccaaaataccaccgaccgagtgcttcagcagcagacacttattttctcacagttctggaagctggatatctgagaggagggtgccagcactgtcaggggcttgcgagggccttcttcctggcatccttctctctatgtcctgagatagtgaagagagagaggactctggtctttcttcctcttctttttttttttttttctttgagactgagtctcgctctgtcgcccaggctggagtgcagtggcgcgatcttggctccctgcaacctccgcctcccaggttcaagctattctccttcttcagcctcccaagtagctgggattacaggcatgtgccaccatgcctggctaatttttgtatttttggagatgagccactgtgcccggcccctcttcctataagaacgttaatctcataagggccccaccctcatgacctcatccaaacctaattacagctcaaatatcccatctccaaatagtaattttgtattttaatacaatacaggatgccaggaagaaggcccttgctagcccctgacagtgctggcgccctcctctcagatatccagggtttcaccatgttggccaggctggtcttgaactcctgacctcaagtgatccgcctgcctcagcctcccaaagtgctgggattacaggtgtgagccaccacgcccggcccctcttcttataagaatgttaatctcatcataagggccccaccctcatgacctcatctaaacctaattacagctcaaatatcccatctccaaatggtgtcacattgggtattagagcttcgacatatgaatttggtggggggcgggggacacagttcaatccatggcatagggactgactgatttgtcccaggttgtgtggctgcttctcagtagcagagccaggtttcatcccaggactgtgggacttcagccctggaccagcagctacgtgctgttaagtctctactgccacacgatggtatcttgcaaagcccacatggatcacggccgcctttggacccacaggctgaggtgaggccaaggttgcacaggggctcgtggtcttccccaaaactcaacagagacagaactttcctagtttttgtgctggtcacacaacaaggccagttcagcagagagtacatctaggtaaacaagctctttttgttccattatcttctgtgagacacaggggaaggtatggagctgtccctttcattaaacaaccagctctgcttcttaacctcaaagctacaacttccaaagccagctctgctcacagaaatatccctcaggatgctggcccagaaaaccagaacccacatccaggttgttttaaacataatacaactttcttcttcagtttgatagatggttgttggcaagtacagatagtatgaggtagggatgagtgacgccacagaggccaggacacatttgcaggaggtgaactagggagtttgccgctgctacgctcttggatgaactggtgtgcttgtgtgttgagtatgatacacatagagatctgtcccataagagcgtgtgtatttatatgtgactgaaaaaggaatatcagtggaccagataaaagagtccaaaaatagacctcagtaaacatagaaatacatcgggagtccccagcgccccccaggaagcgaaccggtattggtccctggcctgctaggaaccaggccacacaggaggaggtgagcggtgggccagtgagcatcagcgccacctcctgtcagatcagcggcagcattggattctcataggagcgcgaaccctattgtgaaccgcgtctgtgagggctctaggttgtgccctccttatgagaatctaacgcctgatgatctgaggtggaacagtttcatccctaaactgtccccctcaccaatgctgcagtccatggaaaaattgtcttccacaaaaccggtccgtggtgccaaaaaggttggggactgttattatgtaatatatgacaaaggcagaacttcaacttagtgtaaaaggatgcttgcgtgcgttaataaacggtgttgatattcctgcctggaagggggacaaaacacgatactagattacaacaatcaggtttaagtataaaaaaagaaaacaataacatttaaggaatataggtataactttgctatgagggagatctttaaaatctagttggaaaatccaggaataattttttaaaaagactgaaatcattggcttcataaacattcaaaaattgtgttcagtgggaagcatcataaaccaagtcataatgcaaacagactaagaagaaatatttgcaacacaaattgttgcaacacaaattggcttaagtccctgatatacaaagaatgcttacaaattgatttaaaaaaaaaaaaaaaaaagacaacacaataggcaaaaaaaatgggcaagggatataaacaattttcagaaaaggaagtccagagggccaggaaacaaatgaaaaggtccttaaccacacgaatagggaaatgcaattatgaatttcataactgatccttttataaatgaagagccttaggactgtagaaattgagtccagacatagggatttcacttagaaggaaggggaaacaaacaccatcttctccttcatgccaggcgggatgatgggtatgagaacaggagctagtgtagacctcggtcacgcaagccacttgctgtgtggattagaaacgtgtctccagtttagaaatgccgaatccttcctgggaccacggaggagtgtgcaaggaagtgggctcagcactcaatgagacgccagtggggaaaatcacaggcatgcatggaaaagcaccataggactacgcgcggtaccaatgctctagaaagtgacagctggcagcccgcagaagtacatctggggagccatgtgagggggccgcgcccctgggaggttctctggcagaggtgaatcttggccttggcagatgacaaaggcctcttgattctttaaacttcatctagaaagttgaggcccacacctgagtgaaaagaaggcggctctttgcaaacccttttcctcagtagggttattctcccagggccatggacccttgggtaaggaattatctacaaaagacagcttgtttgcagtaggatagtaaaattccaagtagatttatgtacatccaaatagtcatatttgtgcagtggcctcatccaaaaataatttggatggccgtttttacggtaaaaatcagaccagcagagtcataaataacttatgaataaataattacagttcttaaataccttgaactgtgttctccccagctcagtgcccatcgttttcaacactgggccaggaggtctgttacaggtgttgcctctgtttgcaatcatagctcattattccagccatctcttacttaaagaggcttcataaacaccgtagcgaaactttaaaagtttggaaagcacagaggccaggtgtttagaatgtgttctctggggagaaagtaagcctttctcattatgacgttctttcatgaaaatgtgaattagggcaggctaatattgatcatcttttttcattgaaggaaaaaaaaggaagctttttgaacatttccttacctagcaaggactcatacaaagccatctttagaaggccggtgcacctttatttccgcaggagcccctgcagtgagtcccattcacagtacagctagctgggcagattttccaggcattggttttggtattccattatcggctctccctgaatgttctcagaggccaggttacccattaccattgttattgcagctacatgtgtggaggaaagccagagccgaggcggggtagctatgatcaagggcaaccgagcctggtttcagcccaacaaaagaactccggcttctctattttccatgtctggcagggaaccctatgagagggctttgaggcagttgtttaatcttgaattctccgagctcccaggcatgctgtcctgccccctctccaggccttagtagggaggataaaggcacttcagagattctgctgaaatccaaacctctgattcccatcagtgtgcgtttccaagctctttctcaactcaaatgctctggtgcccgtggaaacagcaaatttgacatgattttcatggtaatctcatagtgagcctaattaataaagtcacttaaatactaaacagttggctggcttttcaaagaatggcattgtaagaagcataaaaacagccaactgtggtatattttcattaactagctttttttcatggaaaaagcaacgcatgtatattttaaaacaccgtttttgaacagtagcaaagggcatgggataaatattcagtcctctagtaattcctttccccagagacaactatggagttcagtgcatctctggtaaccattgtgttcctgtctaacaactgtaacctctgtgcatacacatgtgcaggtgtggtgtgtgtgcatataacatatacatggtatgcgtgtgtgtgcatgcatgtgtgcacacattttctgctacactaataagccttctagatatccggttctgaactttttttttttttttttttttttgagatggagtcttgctctgtcacccaggctggagtgcagtggcacaaactcaactcactgcaacctccacctcccaggttcaagtaattctcctgcctcagcccccccgagtagctgggattacaggtgcccaccatcacgcctggctaatttttgtatctttagtagagacagggttttaccatcttagccagcctggtcttgaactcctgaccttgtgatccccctacctcggcctcccaaagtgctaggattacaggcgtgagccaccagcctggcgcaccttgccttttcaattgatgggtagctcttgagtattacttcatacccccatatatgtagacctgccccatactttgtaatagctgcaattattctattactcattgaaccaaccccctgtggctggacacataggttgttgtagattgtcctctatctctgccactgagtgtcctcattctcacatctttgccacacatgcatgcaaagctatctgtagaatgagaattgctaggtcgatgaggtgagcattttgttctgataggcttgccaaaatgccctctggaggttgcatcagtttatacgcccacctggtcaccacgctgtgacggtccagaattatttttaaatgcagtctgctttgccatgtctttgcagcaagtgtgctggaatttccggccttcctaagtgagtctttggaagtcctttgcctgaacgacaaccacctcgacacagtccctccctcggtttgcctactgaagagcttatcagagctctacttgggaaagtaagtacacatctggaggggccgtgctggctctgctggcccagagaggcagaacgcccatccctaaaccaactgggacacagaaagccaggcagaaagaagccatctactttccaagaagcagtagtgagattttcggaacagggcttgatcaaggaggtggggagagaggaagacggagtagcaatgcaatgatacacactttcactacatcacttgggctgtgatgaggagaaccactcaatcattcatcctttcattactgagctcccattgcatgccagctactgccaggggttctaggcagtgtgcaaagcttgatgagagtgtaaaatgttatattaatattaaagggacatcgccttctcgggaagaggtagtgatcatctttatggggatgtacttagtagcagagacaggaaagttgggggaggggactcaattctaagccgtggggatttgcagaagacagagctgccgtttctatcactgatcctccaggagaaagcctttggaattagtgttgaaatcagggctcaaagtgtggggtctggggtacaggctgcagaggctgacaggagccacgtgtgtgcgtgtgtgtgtgtgtgtgtgtgtgtgtgtgtgtgtgtgtattctctcgtggtggacacatctgtcttcagcaaccctggcctccgggagctccctcctgagctggggcagctgggcaacctctggcagctggacactgaagacctgaccatcagcaatgtgcctgcagaaatccaaaaagaaggtagggcttccgcagccctgtcccctgccatcacctcttggaaagacaactccagtccacttgttaagttctgggggtggagacagttggtgacccatggagcccagctccaggttccagatttgacaagatgctataaaattgtccctaaagcaatcgttactgagggtcactatactgagaaggaccaggtgatacaactgtgacctcctgggcagcaaggattttgtccataggttcttgcctcttagagttcgcttttagggtggttagtgtcatgccttccctccccctgatccagtagtcttccttaactgtccccactaaaacacaaagaaggagttccttcacaacaggattttgtgtcctaagagatgtgagcatgtgcccacgcagctacccttccccttaatgattttgcacaggccccaaagcaatgctgtcttacctgcgtgctcagctgcggaaagcggaaaagtgcaagctgatgaagatgatcatcgtgggtcccccgcgccagggcaagtccaccctcctggagatcttacagacggggagggccccccaggtggtgcatggagaggccaccatcaggaccaccaagtgggagctccagaggccggctggctcgagagccaaggtcaaggatggtctgcgtgcagagtccctgtgggtgggaggaacatcccttggactccttctcccttctccccagagagcccaggattttctcagcctggtgtccaaagctcaggccctttgcaggagccactgtgtaccattccataccagcttctgccaagagcagcgaatcatttcttaatgtgactttgtgatgttttctttttctttacttttcttttttttttttcttgagacagggtttcactgtgtctctcaggctggatgcatcctcaacctccccagcttaaatgatccacctgccctgtatgtttctgttatagttacttgaggctctgggacagtggttcttaaccccggctgtctgttagattcccttgaggggcttttaaagatagcaattcccaggcctcacctcactgctctctgaccccaaggattcaagttcaagtggtctgggataaggcacccccagggctgagagctaaccactgttgcaggcagtgaaacacaccagcatctgccccctgatgaggaggctaaaagcactctgggacttaacaccctgccgtccctgacacctgctttcaccccaggttctgaaaagtcctgtttctaagccctacttaaaatgaatccatcactgcttgaacccgggaggtggaggttgcagtgagccgagatcatgccactgcactccagcctggcgacagagcaagactccattcaaaaaaaattttttgagtccatccataaacttcttaatcatcttgctttccattcagtgccaggcaaatggaaatgaacattttcctgttcatgtaacagagaaaagagccatggactgttggtgggaactccatccctggaatagagcaggggcagttagccctttctctgagctcggggaacgaacacacatagataaggccatcctcatcaactgtatttggatttctgccaccctgtgattcctcgggatccaaggggcaagaggctgcttcactgtggaaaactgaggaggcttgagatccagatggtccatgattttcccccaaagctcccacgcacagtgccaaccaaacactgcagcttcttccacacacaaccactttccaaacctgctttgaaaaagtaggcattgaagctgtgcatctgttctaacacgaacttggaagctggtcctccaaggggtgaagcgctgcctgttggggccagaacaatcaaacacgacaatcaacgctaggccaatcctagaacattccaggagcaaatctagctgactcgagtctgaaggttctctccaggaaccagaatcctctgcattctctccagctttgcctttttcttaacagttatgcaatctcatttcttctcttagcttcctctagctgaggcctgaggggtgaattcgtgcttctatttttcctgaccttcacccccacttcctttctgcgatgattaaaaccccctaccctttagtggaaggacaatcctgtgaaggctgagcccgccgctctctctgtggccggcctcagccagttgagaacagctgttttcatctttatacaaaaccaggtcagcacactgtgtcttggaggctgatgctgcctcacagagatgactcctttctgtagaaaactgcagccttagcatccagggccagactcttacctcatgcaatgatagagaaaccaccgtttacacagccgttcccggcagcccaacagctcatcttttgtttgattcccacagggtgggagggagtttcccagcatccttggtgggcgccaccctctgagccccacaagttcagaggcccatctcctcctcttgccctggcacacagggaggctgaaccccagtgcaagccgtgacatcagagcacagcttcctcccacagggcatcccctacccatctgcagcccagacagagccaggccctctgaagtctgtccagggcctggtctctgctctgctaggagtagacagaagtcccagaagcccacccccatgccaccgggcccctgtccctcgcccagataactgtttcctaagaaacaatagagtgtccagaacttttccacggttgttttttcagacccccgagtccagcctccagagttatccgttgtctccgtttgattgactgaagcctttgtctctaaaatgcctccctgtcgctgccttgttgctcaagtaggttgagtccgtggagttcaacgtctgggacatcgggggaccggccagcatggccactgtcaaccagtgcttcttcacggacaaggccctgtacgtggtggtctggaacctggcgctgggggaggaggccgtggccaacctccagttctggctgctcaacatcgaggtgaggacaccagacgccagccctgccatttcagtgcccagagctttgcaggtcccaccgcttccctcaagcatcccctgtactgagaaaaaaagggggttatgttgccacagagggccccagaaccgtggtcctgcttgcttttcacagtgaggcacttgaaaccttcctctgctgagggctggtgatgtaatttccccgcttcccttaaatttaggaacccccacccttggatccaaaagcagagcagggttcccttcctgttataaagatgtccttgtctccctgcctctgatggctgctgtcatgtctgaagggtcagaaatccctccccacaagtccaactcagcaccctccgtggaggaggtcacagaacaccatagacacccctcaatgcaacagtccctcaggttcacggagaatgaggagcacaggtgctgcctgggctgacatcctgtagcgcagtctgttttgcattactagaaaggaatgagactgggtaatttatgaagaaaagaggttcatttggctcacaattccgcagactatacaagcatggcttcagcatctgttggcttttggttaggcctcaggaagcttttagtcatggcagaagggaaggggagccagcatgtcacatagtgagagagggagcaggagagacaggaagaggagccagcctcctttccacaatcagctcctctgtgaactgacatagggtgaacgcacccattactgcaggaaggtgccaagccattcatgagggatctggccccatgacccaacctcccgtcaggcctcacctccaacactggggatcacatttcaacataagatttggaggaggcaaacatccaaaccgtctcaaggctgcagattggtggctgagcaagggccgtggcatccagggtcagcgcacctgcacagctgggagctctgtcctgtcccttgttccatgaacagagacagtactcagccgtggggttctctgttgcaggccaaggccccaaacgccgtggtgctggtggtcgggacgcacctggatttaattgaagccaagttccgtgtggaaaggattgcaacgctgcgtgcctatgtgctggcactctgccgctccccctccggctccagggccacaggcttcccagacatcaccttcaaacacttacagtgagtgcccagcctcgggcagctcctgccttcttgtgggtgccagtcgctgatctttcctgggatcagcttgcagagagctcctgagtctgggtggggctaggcccctttcctggccaagggtggccatccacagagctgacccagccttggggagggtgaagacctaccagacggctggctggttgaggcctggaggtgcccctctttgcttcctttctgccccatccccgccccaagggccagtgctgaaaatgcatggtgcctattgaaccaggagactgaacgtgggcaccacccaaccaattgctgcccatctcatttgttgatcactgatcaaggacagaccctggggagggagggccagtccttccattgggtctgagtggtcctgatagcagcctttgagtcacagagggccaagagtttggaggggctttcagttaggcatcacgacgtgtccatacagataagtccaattgccctgggctgactgcctgtcactggactttcacaacagccctgcaggttgtggggattgtttgccactttgtaggtgaagaagatgaggttcagcaaattaagtgtgccctaatgggagtaaaatacactgcatattgcattatctgcactgatggctctcagattccctcgcccggggcagagcgccacgggtattggtgcatgggtcagcctgggacacattggcctggctcggaatacaggatgaggctgtcaggaattcctgctttgcccttgagaaagtcccatggggtctgtgataagaggagtcctggctctgggtcagaacccaagtccagcctgtgtgagcctgtgcctgcccagcctgtacccttgggggtctcggtgtacctctgcacctcactttcctcctccgtgaagtgccatgtttagtctgggaagacagactaaagcgacacagtgtggggcacccagcacagtgatttgcacaaagcaaggcctcaataaacttcttgtgttgtctttcacgagttctccagacttgccagcgttcaggacaaacctctcagggaaacagagaagcagcagcgcttcctcggagtggggcatgatgagtaaagacgggtctttttgctcacagtgagatttcctgcaagagcctggaaggtcaggaagggctgcgacagctgattttccacgtcacgtgcagcatgaaggacgtgggcagcaccatcggctgccagcgactggcagggcggctggtgggtaccttgctggtccagtttaaaccagtctgcctgcttcccattgttgggggtcctcacttccccctctctcctgtgaagcccatgtctgtgtggcaaggctcggtggttcctggtgagggagggtcaggatggaagatagtgggtggaaacgtcccaccccctcaggccacaggggccgggcaggatctgcccaagctggcaggtgtgccttgggacctgagagaccctgcctcgcccaactgtcccccagatccccaggagctacctgagcctgcaggaggccgtgctggcagagcagcagcgccgcagccgggacgacgacgtgcagtacctgacggacaggcagctggagcagctggtggagcagacgcccgacaacgacatcaaggactacgaggacctgcagtcaggtgggtggggctggggtaggtggcagggtgcccgtgagaaatggaactgtctgtacttgctaacttcagcttggcctcagtaatgaatgagagaccgacacccagcctgcgtttctgccttccatccccctccccttccttcttccctctcacccttctttccttggagggagagaacacaaacagctactctacaccagcattgtgtttgccacgaggacagacatacaagctgatggactggcgcctgccctccggggctgatattcagtcagggagacagaggtcaaacagttacaatcgattctcattagccacaggacttaacgttctgtaaagtcaccgcgatcactgaaatagcaaatacggaaccagtgctcctaggagagacgcagcgttgggctcctgcgagcctctggtcaccacatactcaccagcccgtcagtacagaaccttgttttatgtgtgttgctgcgtaaagatgccatacttaatatatgttgttgatttgttggcattgaactcacggctgacagcactattgctcattcatgaacaaagcttatctaacacacaggtttcctccataaggcacatcgcagccttctcacgcttagggaactacacagcgtttcagcacttcactagggaccattttgaacagtgaaagcgtcaacaaaaagcacaaaaattcaaaaaacgtggcactgacatagaccactaagcaggcagctgttttcagcatgagagctgagagagttgtcctgttcagcctccgctggcaacgtgcacattggtcaatgcaaatttttcaccactcagcacatgtctgcaaataaccgcaggagtgctgatttggaggttgcagatcaatcttagcaagaaggtgaatttgcaaaggcaaaatccacaaataatgaggatcaagtgtagttacccaggcggccatcagcctaggactttggcaagagttaccaggggccaccagggcacctgtgatcaggctgccagcccacctgaagggtccagcatgtgggacatgttggtttcttctcaggaataatttgtgacctgggtcctcttggaaagagggccaccccagagtccctttcgctcctttgtctaactgctgcttcctcctctccttgcctggggcagccatcagcttcctcatagaaaccggcaccctgctccatttcccggacaccagccacggcctgaggaacctctacttcctcgaccctatttggctctccgaatgtctgcagaggatctttaatattaagggctctcggtcagtggccaagaatggggtgatcagagcagaagacctcaggatgctgctggtggggactggcttcacgcagcagacggaagagcagtacttccagttcctggccaagtttgagatcgccctgcccgtcgccaatgacaggtgaggacacaacttaacacgccaggctgtgcaggttgctccccgaaagagggagttggggtctggagccactggtggcctgaacaagatttccagggatcagtgctgccactgctgccccctacggacaggccagcacccgatgacctgcctgccgggcctgggtcagcaggacagtgagcacggctggccgctccctcctgtgccacgggcttctctgttcagggagttaaaagaaatccacttattgaaaaggtgtaggaaaacatggaaggatgtcattaaaaataatttgtgggaatttcactttacaggggcttgattgcttgattatttggtaaatgagagtgagtggccaggtgaggtggctcacacctttaatcccaactctttgggaggccgaggtggccagatcaattgaggtcaggagttcaagtccagcttgaccaacatggtgaaaccccgtttctactaaaaatacaaaaattagccgggcatggtggtgcatgcctgtaatcccagctacttgggagactgaagcaggagaattgcttgaacccaggaggcagaggttgcagtgaacagagatcacagctctgcactccagccttggcaacagagcgagactccttctcaaaacaacaacaacaaaaaaagaatgagcgactaggatgtgcatactaattacacagcccagttccaaatgcagtccaacatgattaaatcatgagagcaacatcatcagctactccagggtggatggtccgagggtcaaatagaggcattccatatagtagctgatcattgcctctttctgtggacttctcctggatctgtaacatacccaggtctccccagtcctaaactgcaaacaaaacaaatgagcctctcctccttttcctccttttcttgctccccagcacctgccgctcctcatgactttgtgctggtcgccaggtagccctctaggtgcccccaggtacctctcctgtcctctgctgaccctgccccaagtactgaccctcccctctggagggccttctccatgagaggaccttgccaccctcccttccagcccgcagtgtcctcagcaggcccctcccctgcactttgcccaagccatcaattcagctgccttggtcctccatgcagctttggggtcctccttggtccgccaaaggaagaatcctcagattttcagcagggcccagcctccagaggctcaggcctgagcttccaaattgctcccacctggaagtctggcacggtgactgacacagcatgtctgagacacctgccttctctcctctgctgtgtggtcccaccgatcaccttcccccacgccccacccacggaactgtgctcagggagtggcactctaggctccaaattcctccctgtacccctgacacccactcctcaccccacctggaatgacatggccctgccatctcccagtgaaacaattctgttgacagcccctttcctccttgtgacacccatacctgcttctgtttttgtttgtttatttacaaagattttttccatcagttatcggggtacagttggtatttggttacgtaagttctttagtggtgatttatgagatttctggcgcaccatcacccgaacagtatacactgcaccctatttgtgtcttttatccctcgcccacctcccactctcccccaagtccccaaagtccattgtgtcattcttacgcctttgcatcctgacagcttagctctcacatatcagtgagaacatacgatgttgggtttcccattcctgagttacttcacttagaataatagtctcccgtctcctccaggtcactgcaaatgctgttaattcatccctttttatggctgagtagtgttccatcataggtaaagtttacttacagtgaaatgcccggatcgctagtgttcaaaacaatgacttttgacaaatgcatacaactgtgcaagcagcacctgcctcaagacacagaatgttcctgtcatactggaagttccgccagacgcccttccagtcgcttcccatccgtgtcagcaccagcactctgacttccagcaccagagcctactgtttcctgttcttgaacttctcaaccgcacagagtcacgcaatatggtctctaattggcttctcgcactaaacatcatgcctttgagatccatccatgcggttgtgtgtatcaggagtttgttctttctgttgctgagtagtattccattgtatggctttactgcaatttgtttatccactcagctcttgataggcatttggatggtttccaactttgggctatgatgaataacactgctgtaaacagtcttaagtctttttggagacacatgttttcatttctcttggatcaaaaccaggagtggaattgctggataatagagtgtaagtttaattttataagaaatcaccaggctgtcccccaagagactgtatgctcctccaagagactgtacactccatttcctccccactattttttttttttttgagatggagtctcgctctgtcgcccagactggagtgcagtggcacgatcttggctcattacaagctctgcctcccgggttcttgccattctcctgcctcagcctccaaagtagctgggactacaggcgcccaccaccgcgcctggctaattttttgtatttttagtagagacagggtttcaccatgttatccaggatggtctcgatctcctgacctcgtgatccgcctgccttggcctcccaaagtgctgggattacaggggtgagccactgcgccggcctcctccccaatatttgttgtctgtaggtctttctgattttagctattccagtggatgtgagcttgtacttgactgtggctttactttacattttcttcatgactaatgaggtctagcacctttcgtgagcttattggccgttggtatatcttcttctgtgaagtgtctattcaagttttatgcctattttatgattagaatgttttcctttttggtactgatatgtacttctttatatcttctggatacaagttcttttttttttattctttaagttctagggtacatgtgcacaacgtgcaggtttgttacatatgtacacatgtgccatattgtgctgcacccattaactcgtcatttaacatgaggtgtatctcctaatgctatccctcccccctccccctacccgatacaagttctttctcagatatatgatttgcaaatattttctcccagtctgtgacttcctttttttatattaatgaagtctaacttttaaattgtgtgattattgctttttatgtcatctttaagaaatatttgcttataccacaatcttgacaatctttctttatttttcttctagaaggtttgtagtttagcttttacttccaggtctataatctatgtcaaattaatttttgtatatggggtgaagtaggggtcgaggtccatttttttcctgtatattatcccattgttccagaaccatttgttggaaagactttcctttccccatggaattatcttggtttctttatcaaaaatcagtgatgtgggtttatttcaggactctattttgttccactaatatatatgcctatccttatgccagtgccaaaccccactgattattgtagctttagagtaagacttgaaatcaggttgcgtgagcgttttgtattagtttcctgtgattgctgtaagataccatgaatgtggcatcttaaaacaacacacatttttctggaggccagaagtccaaagtaagtttccctggtccaaagtcaaggggtcagcaggatcatgctgcctctgaaggctctagaagaaaatccattttcttatcttttccagtctctagagctgcatttcttagctcacatttcttttatcaatacataatattttacgtatttatggggtacaggtgagtagtttttacatgtgtagaatgtggaatgatcaagtcagggtatttggggtatccatcactttgagtatttatcctttctatgtgttggtatcatttcaagtcctggcttctaaccactttgaaatataccatatattcttgctaactatcgtcaccctagtctgctattaaccattagaacttatttcttctaactgtatgtctgtacccattcaccaacctctcttcctcccactctcacacccttcctagcttctagtatctgtcatgctattttctatcttcataagatcaagttttttagctcccacatatgagtgggagcatgcagtatttgtttctctttgcctggtttatttcatttaatgtaatgacttacagtttcatccatgttgctgcaaatgacatgatttcattctcttttacagccaagtagtattccattgtgtatatggacctttctttatccatttctccattgatggacacttaggttggttccttatctttgctattttgaatagtgctgcaatagataagggaatccaggtatccctttaatacctgggttcttttcctttgtataaatacccactagtgggattgctggattgtatggtagttctatttttagttgtttgagaaatcgccatactattttccacagaggctgtactaatttacattacagccaacagcgtataagagtttttcttttctctgcgtcctcaccagcatctgttattttttggttttctgatagtagctgttcaactggggttatatgatatctcattgtggttttgatttgcatttccctgatgattcatggtgttgagcatttttcatatacctgttggccattcatatgtcttcttttgaaaaatgtctattcatgtcctttgccttcttttgagattatttgagttttattgagttgtttgaatttcttgtaaattgtggatattagttccttgttggatgaatactttgcaaatattttctctcattcaacaggtctcttcactctgctaattgtttcctatgcagtgaagaagccatttagtttaatatagtactatttgtctatttttgttttagttgtttgtgttttcgaggtcttagccataaaacctttgcctagaccaatgtcctgaagtgcttaccctgttttcttctagtagtttatagtttggggtcttaaatttaaggctttaatccattttgagttgatttttgtatgtggtaagagatagggggtctagttccattcttctccatatggatatccaattttcccagcaccatttattgaagagggtgtattttctccactgtaggttcttagcacctttgttgagaatcagttgactgtaaatatgtggatttatttctgggttctctattttgttccattagtctaggtgtctatttttatactgatatcatgctgttttggttactatagctttgtagtatattttgaagtcagatagtgtgattcctccagctttgttctttttgctcaggattgctttagctattcaatctcttgtttggttccatatgaattttagaatccattattgatctgttcaggtttactttttattcctgattaactttgggtaaggttttatatttctgggaatttgtctgtttttttttcctaggctttgcagtttgttaacatatagttcttcatagtagtctctgatgatcttttgtatttcggtggtatcagttgtaatgtctcctttttcattaccaattttggttatttgggtcttttctcttcttggttactctagctagtgatttatcaattttgtttatctttttgaagaatcaacttttcatttaattgatcctttgtattgttttttaagtctgtattccattttatttctgctctgacccttatttattatgtggtttctttccttctgctgattttgggtttggtttgtaaatgtctgtaaggtccttttggtctcaagtcatttaaatccaatgtttttttgatgagtttctgtctagatgatctgtctaatgctgagagtggtatgtttaagtgccatactattatagtattagaatatatctctctctctagatctagtaatatttgctttatgaatctgggtgctccaatgttgggtgcatatatattgatattgttatattctcttgttggattgatccctttatcatttcttctttgtctttttactgcttttgacttaaagtctgttttgtctgatacaagtatagcgatgtctgcttgcttttggctactatttgcatggaatatctttttgcaatgctttactttcagtctatgtgtgtctttacagataaagtgagtttcttattggtagcatataattgaatcatgtttttttaatccattcagccagtgtacaccttttaagtggagaatttaatacacttacattcaaggcaattattaatatgtgaggttttgttcctgtcctattgttaattattttctggttgtttttatatattctttgttcctttatttctctcttactgcttatcattgtggtttggtggttttctgtggtggtaccatttgagtcctttctcttcctcatttgagtgtttgctttaccagtgatttttatacttttgtgtgttttcatgatgttaaatgtcacttttctttttgcttccaggttaaggatcccttgagcagttcttatagggccagtctattagtgacataaggtttctgctgaggaatctgctgttagtctaatggggtctcttaggtgactagattcttttctattgctgtatttagaattctctctttgactttagacaacttgactataatgtgccatggagaagaccttcttgcattatctctgtttggggatctcagagcctcctgtatctggatgtctaaataccttgctagacgtaggaagttttcatctcttattttgttaaataggttttcctaaccctttcattctctcttcaccttctgggactccagtaatttaaatacttggttgctttatggtgtcccatatatcactcatcgagaaaatatttactcattattttcttcatttttctttatttttgtctaactctgtttttttcataagacttgtcttcaagttctgagattatgattctgcttgatctagcctattgttgaagcttttgaatgtattttatatttcactcaatgaattcttcagtcccagaatttccatttggttttttttaaatgatattaatatctatctctttggtaaatttatcatttgtatcctgaattgtttttctgatttctttgtattttttttagaattttcttctatctcactgagctcctttagtatcagaatttttaattatttttccaggattttataaatttgttcttgattaggctgtatggctggagaattattgttttcctttggaagtatcatatgtccttgctttttcatgtttcctgtgtccttacattgatatctgtgcatctggtgtaacagtcacttcttccagtatttgaatttgccttcacaggggagaactttctcctgaagaggcatctgtggtgttggttcagtagggcactttggctttcattctatgtagatgcagtagtgtaatctgtattatttctttggctataaacaatgtcagtggcatctgtgatttcctcagtaatttagggtgcagttgttagtggagcttgtggggaagttttgctgggaacagggatgccaggtgggccagtctttgggccccagtggtggcagcaggcatgcctctccttggaccccagggtggtatacactggcaccagtgttagagggtccagacaggcctattcttgggcttccaggaggcttacttggatgttggtagtggcatcagtgggccaggtaggtggctgggttctcaggtccctaggcagctggcatggtgtgggtaatggcagtggaagtggcaggaaaaccttgtaggtcctgagcagtgcatgctggtattggcagtggctgcaatgggctggttgggcttgtgcacagggccacgggtgacatgtgcaagtaggtaccagctgtagtggtaacagcagagtcggtaggcccaaccttaggccctcaggagaagtggtcaggtaccactgatggtggactgaaccactgagctgggcagtccctcagccctagtccacatgctctggcacaggggccaggggacatgaagccaggtcaggtgggcttgtattcaggcccctcaatggtgtgtacaggtaccagccatggtaggcaggagtgaagtgatccccaggccagcaatggaatgctcaggctggggacatcagtggccacactgctgccctgccactggggagggtgggccaccttcagtggcaacagattaggctggtgggtggggaacatatgccactcacaccttagcctttaaggtggtagcctatgcctcactcacacctcagccccaggggtagcagcccacatttctcttgcacctcagccccagcaccactgggctcccggacagtacacagtctgttggggacagggctgtaaaatggctccttgcagatttcttaaagaactaaaagtaggttaccatttgatccagcaatctcactactggctatctacccagaggaaaagaagtcattatacaaaaaagatacttgcacacacatgtttataacagcacaattcctaattgcaaaaatatggaaccatcccaaatgtgcatcaatcaataattggattaaaaaaattgtggtatatatacaccatagaatactactcagccatataaaggaataaaataatggcatctgcagcaacctggatgaattggagaccattattgtaagtgaagtaactcaggaatggaaaactaaacatcatatgttccaaattataattgggagttaagctatgagaatgcaaaggcataagaataatacaatggattttggggactcaggggaaagggtgggaggggatgagagataaaaaactacacatcaggtactgtgtacactgctcaggtgatgggagtgccaaaatctcagaaatcaccactgaagaactttatcacgtaaccaaacaccacctgctccccaaagccctattgaaattaaaaattaaaatataaataaattgcctccttagtgtggctgctcaggtctcagagagtgtgagacctagagtgagcaccctccgagcagtgccattgcacaatctcccatcagttagtttcagggcccacaaagggtgaggggctctcctgtgccttggatttcaggagtccagagtgggaatgtcgaccactggggatctctcacttacctttccccacactggggagtctctctcagctctcagcctagcaggctgccttgcttccttgtccttccttgccttaggtatttcctgtcacttttctgttgaattccagtgttccctcttggatgatctattcaacgtgtgattatctactcactattttgcctcttctcagtgtcagaggcaagtctgaaatgcctctagtcagccatcttgaagccgtccctcccagcagcatggcaccctgcgccagtggccatcttgccttcttctgtgcaaatctctctcttcccccatcttttaagcacacttgtggctgcacttaaggtccacccagataatgtgggatctttcccccatttcaaagtccataacttaatcacatctacaaagtctctatttccatgtaaggtaacaatcacagttctagggtttaggacctggatattttggggctcattattcagcatatgacaccctccaattttgttcttctgtttcaagattattttggattattctagatcctttgcattttcatctaaattttagaatcagcttgtctgattcttaaaaaaccgttgtgatttttatggagattacattgaatctatagatcaaagaaagctgacatcttagaaatattgaatcttccaatatgaacatggtatatctctcatttattttggtttttaaaaagtttctctccacggtggtttgttttcagtattcagattttctgcatcttttgttaaatttgtgtctacataatttatgttctccgatatgggtaaatgacatatcttctaatttgatttccatttcttgttgctggtatacagaaatataatttatttttaaatatttaccttatatcaaaaaaccttgctaaattcacctattagctccagtagatttttcaggattttctaagtatgcttcttttttgaaaaaaagacagttttacttttttcattctaatcttcacatatttttttgctctgtttgcctgattgcattggctcggatctctagcgaaggtttaaatagaagggatgagagaaggcgtcattctgtgtgatctcaggggggaagcattcagtctttcaccatcaagtgtgatgttttctgcagagctttgttatccatggaaactttatcagattgaggaagttcccttttattcccagtttgctaaaagcttttatcataaatgggtactgaattttgtcccccaaaaatgcttgttctgcctctgttaatttttttcttcagttatttttctgttaaatatgttgatggattttcaaatgttaaaccaactttgtattcccaagattcataccaagtgttcatgatttattatcttttttatctaatgctagatttcagtggctcctattttgcataagaattttttaatctatgttcatgagggatattggttggtactttgatgaaaagtctttatgggttatcagacataggctgtcttcataaaatgaattgaaaagatttttttccttctctattttcttcaagattttgtataagattggtgttagaccttccttaacagtttgatagaatttatagcctggagtttacttcacaagaggatttttaattacaaattcaatctatttattagctatagggttattaaaattttctattcttgtgtcagttttggtaagttatttttttttcaataaattttttcatttcatctatggtgcagaatatattaatataaagatatttaaaatatctctggaatgtgtagtgatatgctctctctcctgatattaataatatgtcttttctctcattctttcttgatcagtcttgctaagtgtttatcaaatttttggaaccgttttaaagaacgaaccgttgccattgctgatttcttctattatttttctcttttatttcatctattactgctctttattattgtcttccttcagctaactttgggtttaatttgtgcttcttgttcttccttcttaaggtagaagcttaggtcatttattttaagcctttcctattttctatgtaagcatttaaagccataactttctaagcactgctttatatgacaaatacaactaattttgctatgttgtgtttttatcatttagttcgaaagattttctaatatatcttatattattttggtcagagaatatattctaagatttctgtattttgaaattcactgagacttattttatgggccaatgtgtgatctttcccagtgaaagtctggagtgcacacaagaaacgagttttctgtgttgtggctgtagtatcttataaaccttaattagctcagagtggtaaacaacgtgttcaaatcttccgtattctcactgatttttttcctactcattctatcaattactaagagagagatggtaaaatatctaatgataagtctacctctctctccagttctgacaggctttattttatatattttgaagccattattggttacatatacacattggtgtcatgcctgtgtaatgaagtgacccttttttcattatacaatgtttctctttatcactggtaatactccttttcttgaagtctattttgtctgatgttaaaatagccacaccagctcttttagttctacctgggttttttccctattcttctagtagcaggttatgatctctataaaaaaggaatctcttgctgacagcacattatccaatctgataatctctgccttttaataggaatatttgattcattcacatttatcataattaattatatggttgggtttaagcctactatttctctatttattttgtatttataccatctgattttgttattttgttcattctttcctgccttcttttgagttaaattttattttagtattttcatgctctctgttgggtttttggccattcttcctggtactgtgttttagtggttactcttgggattagaatatgcatccttaccttatcacaatctacttgtaattaatattataccaccttgaattaaatgcaaaaaccttagcacgataccaggacattactcctcccagcaccctctgtactcttgctgtcatccacgtttcttctatacagtagtcccccttatccacagctggtggatttccagacccccgtggatgcctaaaactgcgatagtattgagccctacatatactatgccttttcctttatctacatacctatgatgaagtttaattgtaaaccagtaagtgattaacaacacatagaaattaacaacaataacaacaaaacagtataattatgatatactgtcacagaagttacataaatgtggtctctctctctctctttctaaatatcttgatatttttggaccagtaattgaaaccatgaaaaagaaactgcagataagggaggactacaatatatgtaatgaaccccataatatagtgttattacttttgctttgaataattaaacaatcaatagtcttttaagaaattaagggaaaaatgttgattgtttctggtgctcttcacttctttccatctggtataatctcttttcatcctgaagaattacgtgtagcatgtcttaaagtctaagtctgatggaaacaaattctcttttttagacaagacttttgtttatatgaaaatgtctttattaacactctaattttttgctggataattttcttcgatgtagaattctgggtcatttttctgtcagtctttttaaaggtgtcaccccattgtcttctgggcagacaggggtcctcctcagtcttcgtcacccctgacccctcgctgaggacctctgaccccatgccacctcctctcatgtgatcaaggatgcccagccacctgctctgctgcagcccaggggcctctgagaagcctactgcccctccgagagctctgccaccatcctcctgtggcttttactgcccttacactcccctacttgttacctcttacccacctgcccggaccctcagttatgctgtcagcccttgagcattgggcagcacacttctctgcctccccacagcatgtgctctggccctggcatttggcccatggaaggcaggggagagggagtgaggccccctatccttacaagcagggtgctcttgtcgggggatttgtgcagactctttatgagctattacttaacttttcttccttcaaattctcacttttgaggcttggttttcatcaaaaccaagtgtagtgttggcttcttctttcctcctactctcctctgtgctacccattgccaggatatatcttctgaagtagctgaactgaacgcctcccctcggggtgggacccctacgagggccaggctgggggagcacacgaggggtgagacctgccatgatgctctgccctaaaccagcttggtcctcaggcctctgagtactagtttccatatcagccgcttcctgggtttgatgctgatattggcaatgaagctgtatccaggatccaaatccacaggatccaaatccacagaatgttgccatgcagcacccagagaacacgtcgccactctgcgtcctcagctccagatctctacaggggtgtcacctggagacttctggggagcaggcctggatcctgcacagtgaggccagagacccggccacctgggaaccagccactggccccacctttgcctgaggccccacccacctcccactaggtatgggaggggcctcaagtctttcttgctgctccagctctctgggttccttacaaaataaaaccccaaagaggaattcaaaattccacagcccctcataacatggcccagcggtgtccttaactttggtccatgagaacgttcagagtaaggcagcctgtgtgtttacaacattgccggatctgacaactttcagattgttttatcgcaggttagaggagtgaggagatacgagtactcagtaaaagaaagtcagttatctatatgaagtcagtttttatatgtataaaacgtacacgtatttataatgtgtgtgtgtgtgtgtgttggcctgaacaagaccatcagtgtgatcacggccaggtcctcaccaaggcttatggcacagcaggttagaatatgaagttgggacgcacaagtatgaatcccaactaccttctttctcgtctgcataatgggtataatataattaccataagtatgatagttgttgtgaggattaaattagataatacatgtaaaatattcagaccagcagaaagaaacagtagcaggcatgtcccagggcctcctgcatgggaacagccactgacaaatacatgtaaaatactcagaacagtgtctcttaagctcccaagacatccagtattgacagtccagttattgttactgtttcttcgtggtaggtactcatagccatggtgtcgggttctgtacacatccaggaatagtgggacacgtttcatctcagcacaggcataatggttcccttgagccccaggcaagtccccgctcctggcatcatcagctttctaaggctgctgggatccctggatctgtgcaaacagacacatttgcggctcctctcagagcatggtttcccacctgcagtgaacccctccagcccctcagaaaatctccatgaactccctggaagtaccatacagttttaagcctttgtgcttctttcaggaggaaggtccttgcctctcagcagactctgagaagggctgcggcccctgtctgaggctgtctcagtggggtggcatgagccagcacctccgtgcagacactgtgccctgccagggtttcactgctttacgttcatcaaacacatgaagaatttacctcttaggacctgtcctgccgactcactggtcattccctgggacggcctttcccagctcgtaattgctctgaaacccggagccagcggcctccactacctggagaccactgcttcccttgagaactggcttctgtggccactcaggatctctttatttgccatgtcaccttctaaacctctgccctcaaaaacatcatggagcacctcttctgtgtgccaccgcacatcgtgctgggacgcctggggacagagaatgctccccccactctctaagcacactccgacaaggagaagagcaagacagacatggggcaccaccactgtaagagggccacatgagagacccaggatgcatgagatgaagtagaaaaagcagaaagaaacagcaggcacggcccagggcctcctgtatggggaacaaacactgagcagatagagaagcaaggacttttcagatgtaaaggaataagacaggacactctgatgaagaggcatctagcgagaggttgggaatgtcctttcactcaagacctgaaaggctgaaaaggcctcctgcttcaccacctgtgtctgctgtgtcatctgcacagcccccgtctaccttcaccagccctgccaagaggggatcctttctctccccattgtatacccatgtgtcagagcgtgtaagtgagagccgagacttgcgcctgtatgctcgggccatgggctgtcactgaattttcttacagtttagggagtcttttccagaaagttctaaggacatttattggactgaaatagatttaagattaggagagctgaaggtaaaacctttattgggaaggagtgcagcatctgcacaccaggggccgtcctgtacctgtccagtgcctgcccccgcagccccacaggatgcagccgttgctggttttcgggcacccttttggagggacctcccaggtttcagccgtgaagcccttgccgatgcaatgatgcagcatttttatgatgaccgagagtgttctcgtaaaacatccctcttccgcacaaaacaggcctattctaacttttaaggcaatcgcgtcgtgtcaacgggccaagaataataaatagctttaaaggccaaaaatgttactctgaccctaatatctgcattgtccttgaaaccttgcagctgtgtttgtttttccttcatcaaccaaagttaatgttatttccccaactgcaaccccgtttatagagaattgagtcccatttgctgtgtctgacatttttaggaccatgatgttttcatgtcttcccttagccttattctagtatcttagaaaccatgatagactcatattaatgggaccagtcttcattttcctttggagtatttattcttagcatataaaccacgcttctcttactaataacagaattccaaaggccctgggaggaaggaacccagcagcctgaggtgttccagcacagcctgtccccagatcaggccatctgctggggtcagggccctgcagtggagcttgggccccactgttcaccagtcccccttggtgtgtttcagctacctcctgccccatctccttccatctaaacctggcctggacacccacggtatgcggcaccccacagccaacaccattcagagggtatttaagatgagcttcgttcccgttggcttctggcaaaggtttatagcacggatgctgatcagcctggcggagatggacctgcaggtattatggctgcggtttctgcatagacagatgcccgagagccacctacagttgtaccactgggggaggggaatgccctttgctggggggccctgcctggagacccttctcctagagccatgccaccaatgtagtgccagggggcaggtgtggcatgggctgctggccaacccactgaagccatcctgggagttccaaagcagcaccctccttagacagaacacgccctttataaacagtggttctcagtgttagcccacctcaaaaccacctggagtttgttagaacacagtttggtggccccacccgaggttctgattcagtaggtgtggactgaggccaagaattcacatttctatccattccccgaggtgatgccgccggcccagcaaccacacttggagaaccgtgaagttagaagcacggttttgccgtcctggctgcacgctagactcgcctggaggaaattctaaaagacacagaccacactccagaccgattgaatcagggtctttgagtgtggcatcatttgaaaaagtgattcctctttggtatttttaaggctcccaggcgagtcccctgtgcagtccagtttgagaaccacttgtgcagaactgtacgttggttctggtaacacgggagaccccccgcccaaggagttagcttctgtgggtttacctggggttacaggaaggcgtccccgctgtcagacaacattaatttcatgcagggcaggaacatggaagcaacatttgctacagtggtgtttttcaaagtggggttcctataccagcaaaatcagcctcacctgggaacgtgtgaggaacacacgttctcaggccccacctcaaacccactgcatgagaaactccagggggaaccccgcactggttttcacaaccctccaggggattctgacacacttttggttttgcgaacctctggcataatccctgactgtcaaatccttgacattaaactccgtatgagtttactgttgctacatcctaattagaaagcccttattgaattataacttcttagctctataaaaatgttctttgatcttcccatttttaccgaaatggtaagaaaaaaatcaatgcaaaagccttaaagtccatcgtgacagtagcagcctgtgctagcggggagggagatgggttaatagcgccagaagggtgcactgattgaaggagtgggcgcaggcgctggtgctcctacgttcccattcctctgccctccctttgaactctgtgtgccgctgtcttctcaagggagggtcatggagcactagcatcgtgggaggctgagctgacaagtggggcccagctgggcctggaggccagggcgcccttccgggcagcagcttccctcactcgaagttaggaaagaagtcctattgaaattcagatgggtgacaggagggggaaaagagtgcagtctcatcactcatcaaaggcatgcaaattcaagcagcagtgagatgccagttttcatccatcacattagcaaaaagctgagccgtaatccccagcccggggcacggagcggccccgcgcacactggtagtcagcgcacaggacagtctcgtcgttcgagaagcgattcctcgggatacatccagagctttaaaacgatcagacccttcgaccaataatccgactggtaaacatctaaactgaggacatcattttcaatcagagaaagctctgtgcctttctcatgtaactcaaggtggttttgagggagcaaaagattggcaccaacttacacttccagaagagagtggttcaggaaattactatgcttaatagaatattaaactttagaaaaatgaattttatgtgtgtttttaatggcataggaaaggtggggttttttaacatatacgaaattagaaatccaatatggcttcagctgtttttcacaaacatatggagatagaaaaaaaaaaaatcctggaataatatataccaaaatctgaatgatctctctgcttggtgttaaattggtgttttgttttccctcttacatttttctgtattttctacattttctaatatgaatttttgcttgtaaagtcagaaagggaaaaaaattttaaaggaaagcctatttttcaattctttggaaaaactgtgtttccggaattccctggagaccccgtcagctaatgtaacgttcaatttggcagcagggatgagcagcgtgggaggagagggtgggaaagatgggggacatttatcaagatggggcccagcccggcctctgcagagctctgcccagggccagcgaggagcccagaatacttaagcagggtcttttctctgtctttcagctttttgaaaacaagaagaatactaaaagcaggaacaggaaagtcaccatttacagttttacaggaaaccagagaaatcgctgtagcacattcagagtgaaaagaaatcagaccatctattggcaggaagggctcctggtcacttttgatgggggctacctcaggtaggaacacctggaagcccacctgccaggtcagcaggtgccacagcagccaccgcggggccacgtcagcaggatgcctcatcctcttggtgtccagaattttgctcgtgagagcggctcgtcatggcagcttgctagaaatgtgaggccctcccacgagtgtcccagaggctccggtctcctcacccctgctgagccccccttgcaggacgggaaaggcaaaggcagatgtggcggccacagctgaggacttgagggacgtggcggccattgagctcaggagagcctcaggcacttcccatggttattcaggtcaccatggtgaccttgcagccatcctgcccgtccccttgttctgtgagaagccaggctggggacaggggatgctgagactcctcagcccccatctccactgcccataaccagacacggaactcagctccctgtgccatttattcttggttttttgagagcggtagacctaaagtcagcccaacaggtttaacgaatgataaacacccaagattattttaatgtttacaatgaactttgcaaaatattcttcagctctgtgagaggagaagaagggaaaaggggaggtaactttacagagggcttgattggcacctgcctcttccgcatagatgttctcacttaaggcccagggttgctgctggacagatgagcatactgaggttcagggaggtctgggaacttccttagggcctcacctgagggtcagctcccaggctgagcgtccctgactgcaatcttcctcgtgcctccttcaccaggccaggtccggggcaagaacaaggcagggccacgcacacgtacatacagggaggagtcccccatcggtcctgcagggcacagagtctctccaggtccccgggggttggttcctgtccctgggggtagggatatcatcccagggtcccccagagccagatcgcaatgggctccttttggtctctggattgcagtgtggaatcttccgacgtgaactggaaaaagaagaaaagcggaggaatgaaaattgtttgccaatcagaagtgagggacttctcagccatggctttcatcacggaccacgtcaattccttgattgatcagtggtttcccggtaagaggagatgctagaagcaagccctcattcatgctaatatttcttatgaatcagggtggggctgctgctttcggggtggacaaaaatcccactgggattcagcccaagaaaactagggggtcttaacagcactttggtgggagtcctggcccccgagaagtccagctctgtcactggggggagtcccacggggaggactgggctcggacaccactgggaatgtgcagggaagcggcctgccagctgcccacaggcgtggcaagaaagatgacactggtaccacgagtggtccacggagatgctcagtgtgagctcacacgtgtcttgttttcatagtgaggactgtgtggctgaaattgcaggggagccggcagatggaaatttatcccctgcgcaggggcagggatggaggggagccgtggcagccaaggggccttgctctcctcccctgccaccccacccatcccggcggtgatcaaaccactaacaccgcccttctcagaccctttggatctgtttcttcattgatagttcacccaaaaaaagtactctttgagtgaagttcctgaggcctcctgtttgttttgctcctggggtggagacgactcccagagcagcctgccagggggaggccatctggggtttaatggggcaagcagctgtgggaggggctgccctgagagcttcagccctgaacgctggaggccaagcagctgtgggacaggctgcccgagagcctcagcccctgaacgctggaggccaagcagctgtgggagagcgggtttggaattccagtgccacccctgcaagcctcggctggtcccccggcctcctgggccggcctcacctgcatgcaatgcctgcatcccagacagcatcagggaaggtggctaagaggcagtggcagaatgcactcaggatacacattccagatcccagggtctggtctctgtcagggttggggtccttcacactgttggcaggaagggtgacctacaaggaaaaaaggcttagaaaggagccctcggagaagtcagctgggtgtgcgtgtcatggtgatttgggaggcacttggctgtctaagggggcccttaggcccatgtgaacccttctgggcactttgcagctccccaccagccagtgttccccacacagcaggtgctgggcagtttgacaggtgggtcccttagacagtcacctgagatggaaagggctctggtgagcacctgagacagatcgcctggagccagcatccccagccaggggcccctcccaacgggatgccttacacatggacctgcagatatcagatgtgcctggaaagttctaggcatccacctcctaccttgcatgaagcaggcagttggccggccctgagggcacctccacagggcatcttggagggtgtttctctgcacctcctctcagaggcgtgggggaatcccgtgtccggtgactgagtttcgtctatgataatttgcactcatttctgcccctgcattgcccttcatggacattgtaaacctgatgtttctaattgtaagaagggtgccttccccactgccgtgatggttggaggatagctcacacctagtctgcgatgacctgttagggcccagtcatgcaggagggatccccccactcctctcaggccccccagccagcctgctcagtgtcccgaccactggacagttctcggaagcatcctgaaccctccctggacacatctttcaggacaaacaattgcgctctccaaaaaggcacccgaatgtggcagtgggtttcagcctgtctcttgggtacaggccaggacaggcagctcccctgctgcgaaggcctcagggcctggggtgcagagtgctgctcggggggccctcctgcaccaccttcttgtgaagctgtctcctgctctgtccttatttagccctgacagccacagagagcgacgggacgccactcatggagcagtacgtgccctgcccggtctgcgagacagcctgggcccagcacacggaccccagtgagaaatcagaggatgtgcagtacttcgacatggaagactgtgtcctgacggccatcgagcgggacttcatctcctgccccagacacccggacctccccgtgccgctgcaggagctggtccctgaactgttcatgaccgacttcccggccaggtatgccccgaaggcccctcccagaacacagtgcaggtcacagggggcgttcctcgctgtgcagttgccgagtgatctccaggaagacccctctggggcgggcaggtgccccggccatggcttcccaccaatctcagtaccttttaggttcccatcctcggctgcctgaaaggaaccaggctgccggctttccattttggaggccttgataggcccaactgggaagagtgctttgcaagtgcagccatcctgcctccccatacggctcccccttcccctcgtagccagagctgctctctcctgagctgcctctcctttccactcctacctccccaccagctctagggccagcagataagtgcagccagtgctcctcaagcattcaggaaggggagagaagggagagctcccacccagagccttgtttaccttctttgtcaaacgctgactcctgtctgtagccctagcgctgagctcccacccagagcctcgtttaccttctttgtcaaacgctgactcctgtctgtagccctagcgctgagccttggacccctcaaatctgttcttagagtttattgtacctatgctaacccaagatcataactagagagagaatcggggaggaaataggaaacgtcacctttcagaagaaaacttccaaaggggtcctttctctacggccaccacttctgtggggttcaccctgtgccagccatcaccacctctgaggccgttcctgtcctgagagccctctgtacagaggagactgaggcttagcaagcctgcataacctacccaggtgtgctcacccacaagtggcagggccggggtggcccagatctgtccagcctcacagatggctttgaaccatgactctcggccgttggggcaaatgacccagcccaggacccacccgcatcagggcgggggggatgtggctgatgccgggcgtgtgtggcaggctcttcctggagaacagcaagctggagcacagcgaggacgagggcagcgtcctgggccagggcggcagtggcaccgtcatctaccgggcccggtaccagggccagcctgtggccgtcaagcgcttccacatcaaaaaattcaagaactttgctaacgtaccggcaggtaagcgggtcccaggttggtgctgtttttctcagacatatgctgcccgggtctaagctctgtgcggccttagagaggcctgaggctgcaggcaccccatgtcctactggctgacactgcgctgtccctggcagacaccatgctgaggcacctgcgggccaccgatgccatgaagaacttctccgagttccggcaggaggccagcatgctgcacgcgctgcagcacccctgcatcgtggcgctcatcggcatcagcatccacccgctctgcttcgccctggagctcgcgccgctcagcagcctcaacaccgtgctgtccgagaacgccagaggtaccgcggcgcgccgccccacccggccccggagaccgacagagccccgggcgcctcctgcctggcacggggggtagagcctcaggtggccttggcaagcccagggcacgcccaacccatggctcgtgtgaccatcccctggctgcgaggccaggctccccgccaggtccagtcactaggcagagccttggcgaggacgggggagcgcacactctggagtcggctaagaccaggctctgccgcggtccggaaagccgctgagtttatttgcctgtaaaaggaggatggtaacaggcctcgctgggagggcaccgagcacgggagctgcattgaatcactttcccaactgcacacgtacacggctgctgagactctgagaccgcagggtcagtgggaccatattttaacataaaatgtcgaagtaatttaccttgagaaaagagcagctaaactccagagtggccagagggtgaaaggtagctgtcttttgactaaggaagaagaaatgctatgaaaatcaatcacttctgcctcaatggaagataattttttaaacagaattctttacttttttttaatacaggatctcactttgttggccaggctggaggacagtggtgcaatctcagctcactgcagctttgacctcctgaactcaagccatcctcccaccgcaacttcccgagtagctacaagcacacgccaccacacccagctaatttgttgttgttgtttgtagagatggcctttcaccctgttgcccaggtcgttctcgaactgtgagctcagtcgatccccccactttagcctcccaaagtgctggaatcaccggcatgagccacacgcccagccaaacaaaatgcttctacttgcctctcacccctttacgtaggacagccttgacctgaggtgaactctagagatttcgaacccttgctcattcagcaaaatgccagcaattccaggaataagatatcaggaatgaagctacagcgatgagcatttctatcctaaatactgtttcacttaaccaggccattctctgtcctttatggcagtctggtgaatagtgagaatgtgtcaatggaatataaagtatctaagggccaggcgcagtggctcacatgtgtaatcccaacactttgggaggcccaggcgggcaggtcgcttaaagccaggaattcaagaccagcctggccaacatggtgaaaccccatgtctactaaaaatacgaaaattagccaggcatggtggcacgcgcctatagtcctagctactcaacttgggaggctgaggcaggagaactgcttgaaccctggaggcagaggttgcagtgagccaagaccatgccactgcactccagcctgggtgatagagggagactctgtctcaataaaagaaaaaagaaaaaaaatcataaagtatctagggagatcggaagacaaaaagacagttgttatcatgataatttgattctatcaaaactgaaattttgatacatttgaaaattgtttttctttgcaagattcttcctttatacccctgggacacatgctcacccaaaaaatagcctaccagatcgcctcgggcctggcctacctgcacaagaaaaacatcatcttctgtgacctgaagtcggacaacattctggtgtggtcccttgacgtcaaggagcacatcaacatcaagctatctgactacgggatttcgaggcagtcattccatgagggcgccctaggcgtggagggcactcctggctaccaggccccagagatcaggcctcgcattgtatatgatgagaaggtacgtgcctggatcccctggcccagccccacagtgtaggagcccagccctcaggctagccgggcagtcctggaggcacctgaagcttcggggctcagcatccccaaaagcacatttttctcactctcccttgctcaatgagggaggttctggcttgaaccagaagggtgcaggggcctgtgtctgtctgcttgtagcaaagttgacttctccttagcatcagccttctcagaccttgattcagtaacattgtagaggctgtaaacagcagatgaagagtccaagagagaaacaggtctggatttgggctccaactcacatttagatgtccacagtgaggacacaggaccagccttgcagggcactcaggaggagcagacagaataaggacggtaaagacccttggccttaagtcccggccacagggtgctggccaagttgaatgccaaaccaggagaagagtgaaagagcaagctggcatcccctggcaactgcactgccagcctcagttgagacaatgactaaatgttgatcttctgataacatttatccctgatggctacttggtagatgcaggcacacacacaacttgaagtcatcttaccacgcatgtattacatctagtgccagccttgttaattgatcacccagcattaaaattcccttgtctataatttcttattatctggtgattctacagatggtcattgactaattcctgtaggaatgacctgtgcatgtatggattagctcagcacctgtggttgttgcccatagaaaaggcaaatcagagcaacaaaaataagagcttcataatagtagctgacttcaacaaggaggtcaccttgaaactcagattatcatggaaacattcacattaaaaattctcaagtctatctatctcagtcattctcctgctaaaatgttatttcttgacccttataggggtctgtataaatttttccttgctggacctttttgattatgaaaattagaggagacaacatgttgtgatccaggagacgctcctttttttatgagttgcaatacataacacttttagtaccaagcacattaagctgagggtgtgtgttttcctgccttgtcttggtactcaagaataaggaccatgacatccttggagtccttaatcagtgactaacagcaagttctcagtgtgttttattggatggaaggatggatcgatggatagatggatggatgggacaatgggcaaatggacaatatggtgggaagtcagatggatgggtggatggaaaagaggaaggataggaagacagatggataaatgtgcaggacaggtggtcggatggatagatggatggacagatgagaagaatggataaatgtacaggaagacaagcaaatggatggatgggtggatggatggatggaaagaaggaagggtgagaaaatggatagataaatggatagaagagaaagtggtcagataggtggatggataaatggatagagggacatggtcaggtggtttgttgaatgtttgttttccttgtctaattgtgtctccctggtccctccacctgagggccaccttgtgaaggccactgggcccaggcagcgacctgacttggcttgttctgtgcccaggtagatatgttctcctatggaatggtgctctacgagttgctgtcaggacagcgccctgcactgggccaccaccagctccagattgccaagaagctgtccaagggcatccgcccggttctggggcagccggaggaagtgcagttccggcgactgcaggcgctcatgatggagtgctgggacactaagccagagaaggtacttggggacacagagcccagggcctgggacctcctgccatgtgaggaagctgtgggtccccagggggtgtgtgcctggctgcccaaccatcaccattggcaacccttctctgctcatttcttctagagggtgatgtttgctgctcctaacatacctactttcattgtctttgtgtgtgcgtgtcactcttacgaaacaaacttccttttcctccccgacttttgtgttacttcaccgtgcaaacaaagtatataaacccctttataacaatacagtccctatgcaagaacagagagaatgtgggtgtctctttgtaaagtgatggggaaaaggtttcgttgtgagaatcagggatcatattacagtgttcaggctagttttttgacggtggtgtttttgtgtttttggaagaggctagtggtttcaaagttaaaactcatttattaaatcagacagagctagtttaatgtatggggagtaaacagggtattctttagaagaacgcatgtccttatctgggcatggtgacatggacttatagtcccagccactggggaggctgaggcaggaggatcacttgagcccaggagttttaggctatggtgcgccctgatcgcacctgtgagtaggttctgcactccagcttgggcaatatagtgagatgaagagtgtatgtccttgggcctgggttggaatacccagggttcagctaacctgaccagatgagcttaaattgccgtagccaaaggtgacccagatacctggatgggtttgctcctgacgtctgaagctgtttcagcctcttgtttggatctagtctgaatgaacagaatccctcattcctccctggttggggctggctgatctcatgggcagaacgggcaccaatccggttgtaagtgaccttgctctcttctggtggcttctctccctcagcgaccgctggccctgtcggtggtgagccagatgaaggacccgacttttgccaccttcatgtatgaactgtgctgtgggaagcagacagccttcttctcatcccagggccaggagtacaccgtggtgttttgggatggaaaagaggagtccaggtaagctcctgcgggctgccctgccccctttgtatttggggtgggaggccgccgtggaatctgggaacacagtcgatgttgaccacagtgagaattatttagcagacggtagggtccagaacctggttagactgcactcaagaaagagcagggagagcagaagaaagtccacacaaagagacgtgcatgtatggttttgtggttaagagatgccaaaaatgggtagtatctgccagggtgtctggggacgtgagggcactgtggcatgtgcctacagtcctagccactccagaggctgaggcaggagaatcacctgagcccaggagttcaagtttagcctgaacaacatagcaagaccccatcttttaaaaaattagaaaatttaaaacatttttaaaaacgaaatgaggcctgtcggcctggttatgtgactttctcaagcatgttctgctgccccagattgcagaaggggcaacgggggggggcgtctaaacagagttggggttttgccaaagggagagaggggcagaggcattggggtgttttcaagggagtgatacagagatggaccaaggaacctaagtgaggccacaaattcagggagcacaatgcaaagtactaaaggatcctaggtattgccagagttaaaaaaaaaactcaagagttatggtttcaggtgggatgagccgaaaaactaggaggcggtggccagacaagacgtgcttgccgtggggtgggtgggaggcgcacagtcggtagtaaagacggcatctggagtgtgacctttggggaggatgcctggggtagagtgaggaatgagcttgagacataataagataaacggaacagacttcgcagtttctcttaggtcagtctttgtgagtttgcgtcaggttttatgccactcggactgagggttgtgacacagacgtactctaagaaatgatgctgtaaggaagtttttctgaccaggccttgtggctcatgcctgtaaccccagcactttaggaggctgaggcaggtggatcttttgagttcaggagtttgagaccagtctaggaaacatggtgaaactttgtctctacaaaaataaataaataacaaaaattagctgggaatggtggcgagcacctgtagtccctgctactcaggaggctgaggcaggaggattacttgaacccaggagtttgccactgcagtgggtggtgattgtgccactgcactccagcctgggtgacagagtgagaccctgcctcagaaaaaaagagaagttattccaaaacacagcgatggagcacgccttcctgatgggatgtactctaaggacaaaacaaaaagcaaacatattaattaaacaggtttcagtaattatattgttggcagcactgttatgattgttactctaagatgctgcttgtggttgtggagtcagttaatgagtaattatgttgctgttgctggaaacatgagctaaaggggaaagagatgtaaagtcgggtaagtaaaagcctgcagttctgaatcgattggatagactcgtgacatagttgaaaaataaacacaaatatctcagttctgctcactgaaaaggcctaaaaacaaggaccaaccaaatgccaatatgcacccctaggacccagactgtggtctctaagtaccaaagtgaaccagggctcatcagaatcatggcagagtccaggtccggggcagggagtgcacctggaacatctgccaccctagaagcaaggacatcgtcagacttctgagggtgaattggaggaccttgggccagactggtcctgggaggctgggccgggccctgccctgctggcctagagacacacacgcggcaggtacctgagacagttccgctcagggctctgaagactcatcccagagggaagacagaggcctcttcctgtgacctgtgaaggttctttaaaactcactgcggcctgaagagagactcactcacaggaagggaggagggggctggctgggagcacacgggcagccaagcaggggagccaggatggaaccggacttgacttgagatctgtctgagaattaaggaaggaaaggaggcaggagaggcagggcagacgagcaggtaaacaggatacgcctaggacacaattccagttgcagggaacaggggcaattattctttatgactctctatatttttaactgtttgttttcaaagtaaaagctattcaaatatcttagttttgtttttctgatgcataaaaaaatgatgggaaaaggagacaaatacacctgaaggaagtttttgtttgctgtattttctaccatttctatcatctgcaaatacgttatcagtcaacagctttttaaaatttggtggcaggagaaactttatattgagaactgctatccgcgagcttaacatattctcttgagtctgagggacagagctgcgtgatgcggggtacataacttcccagccccatcagcttcagcctcctctgccatgcagtgagtgctcaggatgcccgccacagcctgaggggagacagcgatgccggggacagccggcctggtgagccaaggctctcgcaaatgacaagccattagttctcagagcactcgtgctgggagcacattttgagtgcccccccgccccaacccaatctcctctggaattctcccaacttgtctttagccctggctttgtctactctacagtgaggagctccccgcataacaggggcgggcaggatatggccggcgggagggcccctccttcgtactgggggcaaccgtctcaaccctgaggggtcacggaaagaggacagcctttcttctctggcgaatgcccttcctgcgggcgacggtcaagcattacccttcgggcagaacccggctctgccctctcagaacacaggatgcaaccctgggtgggagcaggggaggtagacgaggctcgcagctggcaggccaggctcagggaaaggaggcagcccctggcccccgggcactgacagcacagtttctgccacttacaggaactacacggtggtgaacacagagaagggcctcatggaggtgcagaggatgtgctgccctgggatgaaggtgagctgccagctccaggtccagagatccctgtggacagccaccgaggtaagcactgcccgcaggcctgcccaccgaggtaagcactgcccactgggtgcagccctgggtgggggccacattcataaaaatacaggacgccaggtcaagtgaactttcagataacccccagcgcatccccgtgcagtccccaagtaatgccaggagccccgagaagtagcagcctgtcaccaggggcagctcaaccctgcctgctgctggctggaggccgggatttgcgatggtgaggaccagatgtagaccctcagcaggagacgagacccaggaggctagggacgtgcctgtgtttcccataacactgctagtcactcagctctgaaggcctcttgccttcacatcagggaaatcagggaagtcactagaaggcccaaggaggggtcttctgagaagtcccgagacaactggccaaacacaaatgttctgaggcaggctaggcacaggggctcacgcctgtaatcccagcactttgggaggccaagataggaggatcacgaggtcaagagattgagaccatcctggccaacatagtgaaaccccgtctctactaaaaaatacaaaaattagctgggcatggtggtgcgtgagtgttcccagctactcaggaggctgaggcaggagaatcggttgaacccaggaggtggaggttgcaatgagccaagatcgcaccattgcactccagccttgcgtaccacttaagcctcagaaatctcagtgttaagaaacatctgacaacagattagccgaagtaggtgcagcccagtcccaggcatccaagagatgctcccacaacatttcctcctagaatgggcgagagcaagggctctgcctaaagcgtgctgttgcatgggaagaacagtgaacatttcctcctagagtgaggaaagcaagggctctgcctaaagcatgctgtctcacatgggaagaacagtgagaagacagcattgcggcgtgagtccactttgccagtaccaggtgcacacacaaataccacagagaacttctgagaggctgtgcccccagatcccaatgttggttttctctggggaatagatgacgggctattttctgtttcctctttagactagtctgtctttttcaacgtttctacaaagagcagaaatccataaacaacccaccagaacgtgtcaatccatgtaactttccaagacccataggggatccccaagtccaagtgcatcctcatgggaatggcttgggaaatgccagacactttccagcctgggtctcacagtggacctgtctgcctctgcaggaccagaaaatctacatctacaccctcaagggcatgtgccccttaaacacaccccaacaggccttggatactccagctgtcgtcacctgcttcttggccgtgcctgttattaaaaaggtgaggtcggggcaaaggcaggtatgcaggtctctgatgcacttccacgcctaggaggcgtctcctagctatgtcagggtggcgcctgcagagccacacctaggaccacctggcctaggacgtagacttagagacggtgggaggaaagatatcagacctggtccgtcattagtgccttccggtttgcaaaaacctaagtcaagtccccagccagactgcaggccgaatgaaaaaccccctttcacatgcaaatgccctgactcaggtggaaggactgttggtacaaatggcacggtgagcagtcatgcgtgtgcccttcccctatccggagcctcttccccacctgcccaggccagagccacctcacagccacttgatcaccaggtcctggaggtcctgatctccctccctccatctctgcctcccgccaagtactcgccgtcttacaccagacgcagtttctctttgtgcagcatagccctgcagactcagctctttaacctcctagccctggcctttctaaatgagaccccaaggggcactctccccattaaaggcccagccagctgtgctgcaccttgggattagccccagcctctatgaggctggcctccagtccctgctgggcccggcaccctccccacaaagcaccccactctgtgctgggcccttgacatcccagcctcctccaggaacagcccctccacgcacctcttcccagacggcctccgattcagttctcaagacccggggccttgtcccctcctttgagaagctgcccctcagtggggggcagctccctggcttttccgggctcctccgcccacaggattcaggcacggctcagccagctctggtttcatccaccctgaggggcctgtctgtgcataggcgccctcactaaatgcacaagaagcctttactggtgttgctttgttaaaatgtgactgtcatcatccaattccagtttgcccatctacaaaacaggtataagaagagacagaaggcctagcatacccaaaggtctaggccggtgtgcttggtaaatgagtattattattacttctggatggtcgcaaaatacatgaactcttctcttcacccttcttcagtttcatttaaaaaaaaaaaaaacaggtatgaaatgaaccttagagtcatttatgaccatggccccacagcgaggctacgcagcttgggaccaggcccgtaccagagcgcaggagaacacgacacaaagtgttattgaggccaccgctggcgagagcccccagccagggcaccacctcctgcacgaccagagggaataaagcctgctctgtgcagggcctcctgggcagggtgtctgccccctccaaggccgccagcgcgaagcctgcattcttgcacgcgcacccacgttcacacccagccgggacgtggcactcaccgccctggccggggcctgagccaggactgcagatagagacctggagcctgtttgccttggctgccttctttccctaaagtcctggggatggatttcgatacgctttcttagagcatgttgtcctggacagtgagctacgggtctccactccattgccctgcacagccagcctcctgagctcccccagctccccacaaggaggctttctgccctgccccctcactggcatgaggcccagctccctgctctgccctgactccagctttgttctgcagacctcttcccacccccaccacagccgacgcggtgtctaggctgcggagctgcactctgttcctggctctgccctgggaggtgccccggggcggtctggggtgggcccagcattcagcaaggtccctgcaactttggcctctgcccggtgacctctggcgggtgtagaagagctcatgcttcattgagggggtggggggcaccctgaggaccctgtcaacgtcagctgaaccacaggcatctcgatagatgtaagctgggatgagggctcagcaggctgagacaggcctccagaagagggttgagtaggaagcgatttcttccagaattagttcagcaaacacatgtcatccacttggagcaggagccaggtggagtcacagggccaccaagatgaaggagactgagcccttccctgtgccaggctagtgccacggggatgctggtgggctgggagcccatccttatggaacactctgcctggtggggggggtggcaggcagggggcagtgcacagatgcttgccatgcccccactgctgtcatgttaagcagcaccgagaaaagggcgggggcaccaggtcctgcctctgaaggaggccttggtggcctcaaggagaaggcagctccctgctgctcgccctgcaagaagctggcagaagcagaggcagcccatgtggtccaggtgacacgcagccttacttggtgccacaggccctgcctctgggtggcacattcctttctttgctgcagggatggtagatatggctctgcggagtcagagctgcacttctttaggagtagccccggcctttctaagagatttgctgccctgaggcgcactggtggaaagtgactgcccgcctggtgtgggtgcagatgagtccagtgcctactctgtgtctctcttggaatgtgtgaaatggaaggatgtgacacatccctgtctccttccttcagaattcctacctggtcttagcgggcctcgccgatgggcttgtggctgtgtttcccgtggtgcggggcaccccaaaggacagctgctcctacctgtgctcacacacagccaacaggtccaagttcagcatcgcggatgaagacgcacggcagaacccctacccagtgaaggccatggaggtggtcaacagcggctctgaggtctggtacagcaatgggccgggcctccttgtcatcgactgtgcctccctggagatctgcaggcggctggagccctacatggccccctccatggttacgtcagtcgtgtgcagctctgagggcagaggggaggaggtcgtctggtgcctggatgacaaggccaactccttggtgatgtaccactccaccacctaccagctgtgtgcccggtacttctgcggggtccccagccccctcagggacatgtttcccgtgcggcccttggacacggaacccccggcagccagccacacggccaacccaaaggtgcctgagggggactccatcgcggacgtgagcatcatgtacagtgaggagctgggcacgcagatcctgatccaccaggaatcactcactgactactgctccatgtcctcctactcctcatccccaccccgccaggctgccaggtccccctcaagcctccccagctccccagcaagttcttccagtgtgcctttctccaccgactgcgaggactcagacatgctacatacgcccggtgctgcctccgacaggtctgagcatgacctgacccccatggacggggagaccttcagccagcacctgcaggccgtgaagatcctcgccgtcagagacctcatttgggtccccaggtacgtttcccgaggtgagggcaccatccagggcacgcccactgctcctgctctggggacagagcaaggggaagccccctggcttccttacaggtcatgtggggaggcaggtgctgttcttccaagagggttggtttcctccattgggaatggaagcgatcgctttagcaaatctaagagtggccgcacaaaagcttattgcctgccagagagcttaaggtgccacacaaggaaagccacagtcaactgtgactcagtttccactgagaaaattctcctctgctttgaagtctgtcccctccccataacttaatcccttagcagaaactgcatgtctgttgcctccctcccgcacctttctgcacaccggcttcactccccggagagcacggctaccgacaaatcgcttccccttctgggttttggttgcttaggcgcggtggagatgttatcgtcattggcctggagaaggattctggcgcccagcggggccgagtcattgccgtcttaaaagcccgagagctgactccgcatgggtaagactgagtggcagctcctttaggacccaggcagcagcatgagcacagaaggccctgcagccaggtcctgcacagtggctttgctgcccttccattctcccaaatagcatagccactaacgtggctgtaaggcaaagtggaaacaagatggggcccctcagacagctcctaggggctccgcactggccatggctgcctgtttctggagtacccagtgcacctgtagatcaagtaccctacctagtaccctacctaacgaatgtctccagggccagagttcagctgcaatcgacatgcagatgcatccaggtcattgattcactgttcttcctgccaagcaggaaaccctacccgaggtgtccaccagcccacacagcaccctatggggacagatgacacaggcacaccttgtcatctccaagcctggggtctcagctcctgcccttcctgggctgagacatagctcagtacctgtctgtgggtggggacccccaggattatgccagtctcctctgtgaaggtatgctgggcagggtggcctgtccgggacatggtctacatggttgcagtgatgtgaggctggcgccagctgcagctccccacagtgtttacaccccgcactttgactaccgagccccacacggtaaatctcccctacgaaaagtcctcagttcaaatgtgtgtgtgtgtgtgtgtgtgtgtgtgtgtgtgtgtgtgtgtactttggagctcttccatttcacactaggcctgtttccctgcagcatgagttatcccccatccctgggcaagtgggtttttatttcatctggagcataagagggtggagaaacaccagtcagcttgcttctcccaaagcaggacaatgacaaggacatccttggcagtcgcactcccttgcctgccagctttgaacttttgcagtgagtcctgggccagtgacccttactctgtaagtggttctggaagcaagatctggatctgctcctgagctctggcagagcctgtgggtagaagccttgaactgatggagttcccagcttgcaggtcgggcttctggaggaaatgggtgtgcagcacccaggttaggaccttggcatacctgccattaatgtcctaacgtttagctgttgtttttctcctattcatccctaaagccagattttacctctttctcgctagagggaggctcctcccctaaggggaggtcctggcaaggccacgcggagtgagaggtccctggacatcccagtttgcaggagcacctcagtgccacgcaggccgcacacacgggacacagagggaggaaaggcaattagtatgtgcttggggtggggcaccaccagggcagggaggccacactgtggcccaaaaggaaacctgtagcacacacccaccgatcctgcaaaactgtccacagtttcaaaaaatgtatatagtgatgactttggggcagtaggttttccatttaatatatgatcctgtatttcctaagcctgtagaaacagaatgagagaagaatcttactgagcttagtggcaagggagttgagttaaactcggtcatgagccattcacaagcagaaatttgggtcagtggtgttttctggacgctttgggagctgagtcaaggatgcatgatctgattgcctctgtggccttccagggagtctgactcttacagacaaagcccatggacgcgaactcatgcccacagcccgtctttggactttataaagcctaagcccacaggctggccactggggagaagtggtgcatctcagcacaccccagagagggctggcaagcagacacactcccctgcccttagccagctccgccttcctcagaaggcacagggggagggtcccaaccccacccgagtgggaacccctgtgagtttcctcagacccccttctctctgcagggtgctggtggatgctgccgtggtggcaaaggacactgttgtgtgcacctttgaaaatgaaaacacagagtggtgcctggccgtctggaggggctggggcgccagggagttcgacattttctaccagtcctacgaggagctgggccggctggaggcttgcactcgcaagagaaggtaattcctgtggaatgactgtcacacatcagagctggctggcccggggctgcagcctgacccctctgccatcggcctctagttctccaaggacctagaagacagatggagttctcccctgaactccttgctgctaagaagtgctgagaagttactcgcctggcggtggctccagggttctctggttctctggagcagagttctctgaataccccatcccccaactgctgattttacagccccagggaagacagtggtatcaggctgggagcggcctcctctggcctcccccatcagtttgcaggagcaggggtgcaggatcctgttctgagctgggtcaaacaaagcagggccgggccttcctgccatccccaggtctcagatggaattacactagaggccctccgctgggaagcacttgaggtagggcaggaggggggctgtgacccctgccctttccccgccagagacctcaggctctcagcacattccacaggctcctgagtccccgaggcctgggccagcttgggcaagccaagatcagatgtctctgtgttcgggaaggtctccgtgtgggaaagcccttgggggatcccgggtgaggagtgttgccccatccagagaatgaatgagttcctttaagtgccaccgccagcaagcccagaggcacacagtccgagtgcacccgcttagcctttacattcctctccaccgacaaaaggaaggggaaactcaatcagcaggacttcagaaagggccttgtgtttatagctttgtcaagtaaatttggacgcagctggagcacaggccctgtttgtttgcacataataatcttgtttatcactttaaaaaattcagtaatatctcagcagtcaggcttctggttgtgaaatcacattgtatgggatttataccaaattatgtatttgctaaacattcactgcacacgtgtacagcggagtacgaaaaggaacgttgtccacaggggatttatggatacaacagcaaacattttataaactatgcacatgcattacacacatgcacacacatatgcacacacatgtgcaaacatagccacttttttgtcaagagttaccctttggggctccttaaaccagaatgggagtttgaaagagagatcatactccagctgaagtttgttgacccttttctaaaattaaaaagatcaaatttagtatttgctggatatgcagggagatgagactcttttaatctcaaaataaacagattctttcaagaacgaagctgtggcctctgtcttttgagcgcttatgaccacagcacgggctcagtccctcccagacccactcgctgtctggggataatgggcagcccctccttgcccactgtgccaacatgcaggtggcccctgagcagcttccatgggtggagacgctgctctgtcagtcacaggcttggaaaaagcgagtccccccactcttttttttttttttttttttttttttaccaacctgggcaccaagtcccagggggctgagggtctgtgcttcctgtctacctccctgccattctctcaccctcatcccacagcagggtctcaggagtcccactctccctctcctctcattccagtgccccacaactgcccagttaacccccagatgcaagccagattccatctgccccaggccccaagcttttgctttggcatcacgcgaggccaggctgctttgcaggcaccaaaattcaccctctcctactcctggaaaagcccagccccaggcctcacagagccaggggaggggatctcatcacatcacagttagaaatcatacaggcctaaagtcccagctacccaggagccaaggcaggaggaacccttgagcctgggagttggaggttacagtgagctatgatcacaccagctttctagcctgggtgacagagcaagacccaactcttaaaaaaaaaaaaaaaatacaggaaatgactaatgaacttgactccatgaaattgaaacttacgtggaaaattagtccaaagcctaaaagactagcaactgagaaaaaaaaacattgcaacacaaatgagagacaaagacctcacttatcttcattacagagagttcgtaatgtcaataagaaacagaaaaccggaaaggcaaacaggttaagggcatgggcagcaattgaattacaaagaaacagacagacccttaaacatcaatgcttgacctcacccaacagcagggaaacagtctccacaacagtaaaatgttgctgggatgggcccagcattcagcatggtccctgcaactttggcctctgcccagtgacctctggcgggtgtagaagagctcatgcttcagtgagggggtggggggcaccctgaggaccctgtcaacatcagctggaccacaggcatctcagatagatgtcacttaccaccctcatgttggcagagggtggtaaccagccagcatctccttcttaaacacctactaagtgtcaggcactgtgaccggagacacagtcaagaatctctgtgttttttttgttttgttttgtttttgttttttgagacggagtctcgctctgttgcccaggctggagtgcaatggcgcgatctcagctcactgccacctccgcctcccaggttcaagcaattctcctgcctcagcctcccgagtagctgcgattacaggcgtgcaccacaatgcctggataatttttgtattttcagtagaaacggggtttcaccatgttggccaggatggtcttgaactcctgagctcaggtgatccgcccgcctcatcctcccaaagtgctgggattacaggtgtgagctacctgcgctggccgaatctctgcttttaggagctcactcctcataggtagagttgacaataagcacacaaacaagtgagatagcagggcagccggaccacccagttgggcaattcgtggcttggcctaggaacgttacatttgactgaggctggcgaggcctgcagcctgcaccaggaggtacaatgtgagactgaggaatgggaagaaggcattccatggagctctgagggcactgggtgcaagggccttgcacatgcaaagaccctgttgtgggttcaagccactgtgtgggagggacaggagagcctggcgtggctgcggccttgaaggaggggactgtgcacacagaattgcaagtgggggtctccgcggaagctcctggcagttttaagcaggattattagatgattcagtcaactttacaactcactttgctgaatggagggtggattaacgagggggtagttggaggctaccccttggagggcattctggacttatctaccaaaatttcaaatgcacataccctctgacccagcagttccacttaagtatttggtcctgaaatcttggtaaaagtgcccaaagatacagaacaaggatgttcactatagcatctcttagaatatggccccaaacaggaagcaaccccaacctctatcatgagggaggtcataaaattcctgcacatgcaacagtgccatcctctgcagcctgtcaaagaggcaggcagcactaactgctggactggaatgttctccaagatataataaatgcatttgtttgaaagcagcttgcagcacagtgcgtcaggcctctgagcccaagccaagccatcgcatcccctgtgacttgcacgtatatgcctagatggcctgaagtaactgaagaatcacaaaagaagtgaatatgccctgccccgccttaactgatgacattccaccacaaaagaagtgaaaaaggccggtccttgacttaactgatgacattatcttatgaaattccttctcctggctcatcctggctcaaaaagctcccccactgagcacgttgccacccccactcctgcccgccagagaacaaaccccctttttcctttacctacccaaatcttataaaacggcctcacgcctatctcccttcactgactcccttttcggactcagcccacctgcgcccaggtgaaataaacagccttgttgctcacacaaagcctgtttggtggtctcttcacatggacgtgcattaaatttggtgccgtaactggcgcggggggaggggggggggaacctcccttgggagatcaatcccctgtcctcctgctctttggtccatgagaaagatccacctacaacctcaagtcctcagaccaaccagcccaagaaacatctcaccaatttcaaatccagtaagcagcctctttttactctcttctccaacctccctcactatccctcaacctctttctcctttcaatcttggcgccacacttcaatttctcccttctcttaacttcaattcctttcattttctggtagagataaaggagacacgttttatccgtggacccaaaactccagcgccggtcacggactgggaaggcagccttcccttggtgtttaatcattgcagggacacctctctgattattcacccaggtttcagaggtgtcagaccacgcagggacgcctgccttggtccttcacccttagcggcaagtcccgcttttctggggaatgggcaaggaccccaaccccttctctccgtgtctctaccccttctccgcctttctggggggcaagaaacccccaaccccttctccttcaccctgagcggcaagtcccgcttttctagaggaggagcaagtactccaacctcatatctctgcgccccaatcccttatttctgtgccccaacctcttatctctgtgccccaatcccttatttccatgcccccacctcttatatctctgcaccttgatcccttatttccacatcccgacctcgtatctctgcaccccgacccctttcccacttttctggagagtaagaacccctgaaccgcttctctccgtgtctctactctcccttttctttaaacttgcctccttcactgtaggcaaccttccactctccattcctccttcttctcccttagcctatgttctcaaaaacttaaaacctcttcaactcacacctgacctaaaacctaaatgccttattttcttctgcaatgccgcttgaccccaatacaaactcaacagtagttccaaatagccggaaaacagcactttcaatttttccatcctgcaagatctaaataattcttgtcgtaaaatgggcaaatggtctgaggtgcctgacgtccaggcgttcttttacacatcagtccctccctagtctctgttcccagtgcaactcatcccaaatcttccttctttccctcccgcctgtctcctcagtcccaaccccaagcatcgctgagtctttctaatcttttctatagacccatctgacctctcccctcctccccaggctgctccttgccaggccgagctaggtcccaattcttcctcagcctccgctcctccaccatataatctttttatcacctcccctcctcacacccggtccggcttacagtttccttccgtgactagccctcccctacctgcccagcaattttctcttaaaaaggtggctggagctaaaggcatagtcaaggttaatgctcctttttctttatcccaaatcagatagcgtttaggctctttttcatcaaatataaaaacccagcccagttcatgcctcgtttggcagcaaccctgagacactttacggccctagaccctaaaagcccaaaaggccgtcttattctcaatatatattttatcacccaatctgctccctacattaaataaaactccaaaaattaaattccggccctcaaaccccacaacaggatttaattaaccttgccttcaaggtgtacaataatagaaaaaagttgcaattccttgcctccactgtgagacaaaccccagccacatctccagcacacaagaacttccaaacacctgaactgcagcggccaggcattcctccagaacctcctcccccaggagcttgctacaagtgccagaaatctggccaccaggccaaggaatgcctgcagcccaggattcctcctaagccgtgtcccatctgtgcgggaccccactggaaatcggactgtccaactcacctggcagccactcccagagcccctggaactccggcccaaggctctctgactgactccttcccagatcttcttggcttagcggctgaagactgacactgcccgatcacctcggaagccccctagaccatcacggacgccgagctgccagtaactctcacagtggaaggtaaacccgtccccttcttaatcaatacggaggctacccactccacattaccttcttttcaagggcctgtttcccttacctccataactgttgtgcgtattgacagccaggcttctaaacctcttaaaactccccaactctggtgccaacttagacaatactcttttaagcactccttttagttatccccagctgcccagttcccttattaggctgagacactttaactaaattatctgcttccctgactattcctgggctacagccacacctcattactgcccttcttcccaatccaaagcctcctttgtgtcctcctcttgtatcccccgaccttaacccataagtataagatacctctactccctccttggtgaccgatcatgcaccccttaccatctcatcgaaacctaatcacccttaccccgctcaacaccaatatcccatcccacagcatgctttgaaaagactaaagcctgttatcactctcctgctacagcatggccttttaaagcctataaactctccttacaattcccccatttcacttgtcctaaaaccagacaagccttacaagttagttcaggatctgtgccttatcaaccacattgttttgcctatccaccccatggtgtcaaacccatatactctcctatcctcaatacctcactccataatccattattgtgttctggatctcaaacatgctttctttactattcctttgcacccttcatcccagcctctcttcactttcacttggactgaccctgacacccatcaggctcagcaaattacctgggctgtactgccccaaagcttcacagacagcccccattacatcagtcaagcccaaattttttccctatctgttacctatctcagcataattctcataaagacacacgtgctctccctgccgatcatgtccgattaatctcccaaaccccaaccccttctacaaaacaagaactcctttccttcctaggcatggttagtgcagtcagaattcttacacaagagccaggaccgcaccctgtagaccttctgtccaaacaacttgaccttactgttttagcctagccctcatgtctctgtgcagcggctgctgccaccctaatacttttagaggccctcaaaatcacaaactatgctcaactcactctctacagttatcataacttccaaaatctattttcttcctcatacctgacatatatactttctgctccccggctccttcagctgtactcactctttattgagtctcccacaattaccatttttcctggcaccgacttcaatccagcctcccacattattcctgataccacacctgacccccatgactgcatctctctgatccacctgacgttcaccccatttccccacatttccttcttccctgcttctcaccctgatcacacttggtttatggatggcagttccaccaggcctaatggccacacaccagcaaaggcaggctgtgctatagtacaagccgctagcccgcctcttagaacctctcatttcctttccatcgtggaaatctatcctcaaggaaataacttctcagtgttccatctgctattctactgctcctcagggattattcaggccccctcccttccctacacatcaagctcagggatttgcctccacccaggactggcaaattgactttactcaacatgccccgagtcagataactaaaatacctcttattctaggtagacactttcactggataggtagaggcctttcctacagggtctgagaaggccaccatggtcatttcttcccttctgtcaaacataattcctcggtttggccttcccacctctatactgtctgataacagaccagcctttattagtcaaatcagccaagcgttttttcaggctcttagtattcagtgaaacctttatatcccttacagtcctcagccttcaggaaaggtagaacggactaatgatcttttaaaaacacacctcaccaagctcagccaccaacttaaaaaagactggacaatacttttaccactttcccttctcagaattcaggcctgtccttggaatgctacaaggtacagcccatttgagctcctgtatagacgctcctttttattaggccccagtctcattccagacaccagaccaacttggactgtgccccaaaaaacttgtcatccctactatcttctgtctagtcgtactcctattcaccattctcaactactcatacgtgccctgctcttgtttacactgccagtttacactgtttctccaagccatcacagctgatatctcctggtgctatccccaaaccgccactctgaactcttaaatacataatctttgctggcaggactatgctgaacctcctttggcactctctaatcagatgtcctgagtcatctcaattcttagaccttttatacctgtttttctcctttacttattccgtttagtttttcaattcatacaaaaccgtatccaggtcatcaccaataattctaaatgacgaatgtttcttctaacaaccgcacaatatcaccccttaccacaagacctcccttcagcttaatctctcccactctaggttcccacgccgccccgaatcccgctcgaagcagccctgagaaacatcgcccattctctctctccacaccgccccccaaaaattttcgctgccccaacacttcgacactattttgttttatttttcttattaatataagaaggcaggaatgtcaggcctctgagcccaagctaagccatcgcatcccctgtgacctgcacgcatatataagcccagatggcctgaagtaactgaagaatcacaaaagaagtgaatatgccctgccccaccttaactgatgacattccaccacaaaagaagtgtaaatggctggttcttgccttaagtgatgacattaccttgtgaaagtccttttcctggctcatcctggctcaaaaagcacccccactgagcaccttgccgcccccactcctgcccgccagagaacaaaccccctttgactgtaattttcctttacctacccaaatcctataaaacggccccacccccatctccctgcactgactctcttttcggactcagcccgcctgcacccaggtgaaataaacagctttattgctcacacaaagcctgtttggtggtctcttcacacggacgtgcatgaaagtgtgtactgagttaccgtgtgcgtaaaaaacattgcagagctctgcgtgtacgcacagggaaaatatcccaaaggacacccaacgacgtggtggacactggttgcctctggggaggagaacagagggctggcatagaggagtgaaccctttatttttattgtacaccttccttcctctctgcaccctgaattgtgtgcatgcctatgatggaggtaattaggctgggaggggcctcttccctgagcccaacaggtggctcttggccttggtctctagaggtcatggggagcccccctttgtcccctctcctctgtgagtgtctgattccatggagggcaggtcctgaggcagggttgggttccctaacaatccgtccatctaacttcatggtcctggctaaacgagaacctccttggctgtctttgggatgcaggcccaggtgaggcggatggtgggatgcaggcccggagccccaggtgaggtggatggctacagcagggggacacgcatgcggggctggactcagggggccaaggccaattggctctgaccctggtccaccttcaccctggaatggggaaggtgtgcagcccaggtgcagggtcaaggcccacccctccccaggagatggcacacaggcctcctcccgcccaccacactgcacctgggaaagcagtggcctgacgactggtcactggctgagccgtcaccaccttccaggaccactgattgctcaaacctgcagggtctttgcaaggagcctgcctgggtcggggaggctgccagagcccgtctccctcacagtgcctccagggctggagcacgggctcctctggcagaaagcactgggcaagccccagaggagacatggtgacacagaaactccccaatgctcaggaaaacctgaaacacgccgagaggcaagcagcaggctgctgccctggaaggagccacattttccagcatgtcgggcctggggcctcagagtctctgcggggagagggggtgagggaaagggtggggggatggggaatggagaatggagttggggtataggggtcagttaaacagcactttaacaatcactgtggcagaaactgcaagctgcagcccttcctgctcagtatcagaccccaattttgttggtgcatgttttcccagccacctttgcaggtggggtggccctgggactgagctccagccaggggtgacttggatgtcgtcaagtagagcttcagggaactccatcaaagggggctgagtcactggaggcccctttgaccctgcccctgcctcctccttccttgtgggagggagggccccaggaggacctggggcagtgatgggggacagttcgccagctctgactgccaacctgcgggcttcatgtgatcttatggaaaaggaacccacttccttgttgaagccagcatttttcagctgtctatgactggcagccaaatgcagttcctaatattcagatacattttccattagcccgaccagagcactaagggtcagcacgtgagctggctctaaccaccttctgtttaagtccgggcagggggacctaagaaccatggattggagcgttgtgtgccaggcgtgccccctgctcaccggtgcatcgtgagagctgggtgtggtgtagcccacagttcttcccaaggcaaccaaaccacagtcacagagaggatccagggtttcatccaagtcacccaaaggccaaaacttaaggtgtggtggctttgatgtcctgcaagtttaaattccatgctggacaggctaccccagctctgcagccctggtttctcc

SEQ ID NO: 1285 - DNA, 41670 bp, Homo sapiens
cggctgctggccatgccccgtgtgcatgtaggcgatggggaagtgagtggaggagagcggaaccttgattctgctcatcaaactgcttaaccgctgaagcaaaagggggaacttttttcccgatcagcagaatgacatcgtgatggggaaagggctccccagatggctggtgagcagtgtgtgtctgtgaccccgtctgccccaccccctgaacacacctctgccggctgagggtgacacaaccctgttccctgtcgctctgttcccgcttatctctcccgccttttcggcgccaccaccttcttggaaatgagacagagcaaaggggagggggctcagaccaccgcctcccctggcaggccccataaaagcgactgtcactcggtcccagacaccagagcaagctcaagacccagcagtgggacagccagacagacggcacgatggcactgagctcccagatctgggccgcttgcctcctgctcctcctcctcctcgccagcctgaccagtggctctgttttcccacaacaggtgagagcccagtggcctgggtccttagcagggcagcagggatgggagagccaggcctcagcctagggcactggagacacccgagcactgagcagagctcaggacgtctcaggagtactggcagctgaacaggaaccaggacaggcacggtggctcatgcctgtaatcccagcactttgggaggttgaggcaggcagcccacttgaggtcagtttgagaccagcctggccaacatggtaaaaccccgtctctactaaaaatacaaaagttagccaggcttggtggcaggtgcctgtaatcccagctactcgggagactgaggcaggagaattgcttgaacccgcaaggtggaggttgcacagtgagctgagattgcaccactgcactccagcctggcaacagagcaagactccatctccaaaaaagaacagaaatcaatgaagcaccgagtgacagggactggaaggtcctaattccatgggtatttacggaacccctacgccgtgtggagtcttattctagacagtggggacgaggccatgaacaaggtagatgagagaggagatttctccatcctggtcagggaatttgttaaagactgatgaaaacatgaataaataattgtgtctagtacattctattcgtgaatctcataacagacagtggtagagtgaccgtgacccattcgccacacagtagagtcacttttttggtttgttttttagagacagggtcttcctctgttgctgaggctggagtgcagtggtgcagtcatagttcactgcagcctcaacctcctgtgctcaagcaatcctcccacctcagcgtcccaagtagctgggacagcaggcacatgccacgggttgggggaccacaggcatggtcaaggggctggcagtcaagcaagtgtttcatgagaaagtgacagttgaccttcgtcttggagggtgagagatggaggcagcaaagacctaaggagaggacaagccagcatagcccagggtcaggctgaacaagaggagatggtgggacttggggataaggctgaggggtgggcagtccctaagtcttgtgggcaaccatgcagacactgatttttccttggaataaagaggaagcccccataagcttttttttttttttctgagatagggtctcgctctgtcgttcaggctggtgtgcagtggcatcatctgggctcactgcaacctccgcctcccgggttcaagcaattctcctgcctcagcttcccgagcagctgggattacaggcggctgccaccacgcccggctaatttttgtttttttagtagagacagggtttcaccatgttggccagactggtcttgaactcctgacctcaggtgattctcccacctcggcttcccaaagtgctgggattacaggcgtgagccactgcgcccagcctcctgtaggtttttaaaatggagaaaaccacaatctcactggccatgttttaaaaaacttaatctgccagtcaggcaccatggctcacacctgtaatcccagagttttgggaggccaaggtaggaagatcagttgagcccaggagttcaagaccagcttgggcaacacaaccagaccccacctctacaaaaaattaaaaaattagccgggtgtggtggcgtgcacctgctgtcccagctactcgggaagctgaggcgggagcatcgcttgagcacaggaggtcaaggctgcagggagctatgactgtgccactgcactctggcctgggcaacagaggaagactctgtctaaaaaacaaacaaaaaaagtgactctgctgtgtggcaaatggattgaggggcaagaatgcagggaggtgtgttaggaggctggcactggcatccaggcaggggaaggtgatatcccaaagaagagtagcagctgtggaaagaggaggaggcggatctgggaggtttttttttttaggaaaagccgcccatgggaaggtgagcagaagcaagaaagcaaggcccctcctaagagtccatttgagctctgggtttaaaccacttggagaggagcaggttgccgggagccagtctcagaggtccactgggccccctgccatcctctgcacccccttctgctttcacagacgggacaacttgcagagctgcaaccccaggacagagctggagccagggccagctggatggtgagcgcaacagtgatgcctttcctagccccctgctccctccccatgctaaggccggttccctgctcacattcccttccttcccacagcccatgttccagaggcgaaggaggcgagacacccacttccccatctgcattttctgctgcggctgctgtcatcgatcaaagtgtgggatgtgctgcaagacgtagaacctacctgccctgcccccgtcccctcccttccttatttattcctgctgccccagaacataggtcttggaataaaatggctggttcttttgttttccaaaccagagtgtctgttgtcctttctctctgccgagtgtctgtgctaagagcttgtcctgaccctgccttgcaagcaccagtgcttggtgggtcatgtggggctggtgtgtcctggaggttgccaggaaagttggtgaagaaaatttgtttctgttctcccccttcatgttgcaataataggggatgaaagttaatgtttcctctccttgagatcttcctaaaacagctgtagaaatcagtgcctgtaaggcaagcttgtccaacctggaggccacatgcagccctggatggctttgaatgcacccaacacaaatttgtagtttcttaaggcattatgagatttttccgcaatttttttttttctcatcagctgtcattagtgttagtgtgttttatgtgtggcccaagacaattcttccagtgtggcccagggaagccaaaacattggacactgctataaaggttctcaaagtaagatccagggactccttttgtagggctcctgaaggtggaaactactaagactttttttttcctttttttttccttttttttctttcttttttttttttttttgaggcagagtctctctgtgtcacccaggctggagggcagtggcatgatcttggctcactgcaacctccacctcccaggttcaagcgattcccctgcctcagcctcctgaatagctgggactacaggcacgtgccaccacacctggctaatttttgtatttttagtagaggtggggttttgccatgttgtccaggctggtctcgaactcctgacctcaagtgatccacccgtctcagtctcccaaagtgctgagattacaggtgtgagccaccacgcccggcctacaaagatgtttatttgcctttttcaccctggttctctcatgagtatacaatggagtttccaggaggctctgcgacacctgttggcatcatcaccagatggctaatggattgtgtgctggtgtatctcacgcttttaaatgtcccagtttctagcccggtgcagttgcaccagccctgctactcgggaggctgaggcaggaggataatttaagactgggagttccagaagaagacctggtgtcaaaaaaaaaaaaaatggggcaacgaaaatgagagcaatacagctttcaagaatgggaggggccaggggtggtgattcatgcctacagcactttgggtggctgaggcaggcagatcacttgaggtcaggagttcaagaccagcctggccaacatggtgaaacaccgtctctacaaaaattagccaggcatggtggcatgtgcctgtaatcccagctagtcaggaggctgagtcaggagaatcacttgaaccctggaggtggaggttacagtgagccaagacaacactgctgcactccagcctgggcgacggagtgagaccctgtctccagaaaaaaaaaaaaagaagaatgggcaggaactcagttccttgtggaggtgaactatattcctatatgtttcacgtgcaaagtgtgtccttcctgagagaatacaacttaagatgctcctgtgtaacaatcccccatacctcgctcatctgctatacctggatggcctctgaaggccatgggcctcacaccttttggtcttaggacccctttacattctgagaaattattgaggactccaaaaagctcttgataaagtgggctatatctctagttgcctgatgtattagaaactgaaactgggaaaatatttttactgtttatttatttatttttgagacagggtctcactctgtcgcccaggctggagtgcagtggcgcgatctcagctcactgcaaactccacctcccagtttcaagcggttctcctgccttggcctcctgagtagctggaactacaggcgcccgccaccatgcctggctaattttcatatttttagtagagacagggtttcaccgtgttggccaagctggtcttaaacgcctaacctcaagtgatccacccgcctcagccactcaaaatgctgtgattacaggtgggcctggcctgcccacatttgatagaaacagacataggggctgttatttcactgtcttcttagctcccaggaagcaacagctctcacttgatggtaaagggcattggtcattcggcctcaatgttgggtgtgggcagggagtgggaaggcccaggctgggcgggagagggctccaagacacggctgccacacccaaggcaggtaaacctgactagaacttctgattttgtcaagagaaggtgggaattcctatttttattagagatttcttgctttgacagtattggcaactgagcaaagcaatttgtcttttaacatcaacattctgtgagccaaacgaagcccagctgggcgccagatcagtctggggcaccatcaatgtctgccttcgctttggaatccacagaggcttgtcctctgggaggggaggtttcctgaatgaaaactgaagggatagggagaggggagttgtggtgagcttggcctcttattagctgtaacatcttgcatgcatcttcttcatatccggagctccacctcctcatctgtattttttattttatttttttagtctgggtcttgctccatagcccaggctgaagtgcagtggtgtgatcatggctcactgcagtcttgatctcccgggctcaagcgatcctcccacctctgcctcctgagtagctgggaccgcaggtgcctatcaccacgccccgctaaagttttgtattttgtgtagagacgtggatctggctgtgttgcccaggcgggtctcaaactcatggcttcaaatgatcctcccacttcagcctcccaaaatgctgggactacagttgtgagccaccatgcctggcctctccttacctttaaaagaacagaggcactgggcgtggtggctcacgctgtaatcccagcactttgggaggccaaggcgggtggatcacctgaggtcaggagtttgagaccagcctgaccaacatggtgaaaccccgtctctactgaaaatacaaaaattagccaggcgtgttggcgcacacctataatctcagctactctggaggctgaggcaggagaatcgcttgaacccaggaagcagaggttgcagtgaaccaagatcatgccactgcactccagcctgggtgacagaacaagactccatctcaaaaaaaaaaaaaaaaaacaaaaaaggaacagaagctaagtccatacaggacttagcttaactggctctagagctgctcaaccaagggaatgagtgtgaaattgctttggaaactgtccaatgcttcctcaatgtaaaggattcatattgacaggagagggtagaggcctccctcctggcaggtgggaaacctgaaatcaggaattacacttaatgacacggggtgctcttctctcctgagcaagcagttctctggggtggtcctagagagatgggagaacatgtaaagcagagatactcaaatttcagcgtgctcaaaatctcctggagggcctgcaaaaatgcagatgggtccaggctcagtggctcaagcctgtaatcccagcactttaggaagctgaggctggaggatcacttgaagccaggagttcgagaccagcctggccaacatggtgaaagcccgtctctactaaaaatacaaaaattagctgggtgtggtggtgcacacgtgtagtcccagctactcgggaggttgaggcacgagaattgcttgaacctgggaggcagaagctgaggtgagctgagaccttgccactgcactctagcctgggtgacagaatgagactctgtctcaaaaaaaattaaataaataaaaataaaatgcagatgaggctgggcgtggtggagcatgcctataatcccagtggtttacgaggctgagacgggaggattacttgaggccaggaattcaaggctgcagtgacctatgatggcaccactgcactgcagcctgggtgacacagtgagacgatgtctgtaaaacaaataaacaaataaactgcagatagctgggcctccagaatttctgattccacaggtgcaaggcggggcccttgaccttgcattttgagcaagctgcagtcctgtggaggactggttgtgaagctgacaccattgtctgagggcagcaaaggctcttggatggattgagcctcagctcccatctatgagagctttaagctttaagtgagagctccccatggccgagagcttcattctgaattcctgctgctaggaattcaaaactcacattgaagtcctaacgcctagtagctcagaatgtgaccttagttggaggcagggtcttcacagaggtaatcaagttaaaatgagacgggagaatcctaatccaatataactggtttcctaaatctgacagggtacagtgactcacacctgtaatcccagcagtttgggaggccaacacaggaggactgcttgagatcaggaattcaagaccagcctgggcaatatagtgagaccctgtctctagcaaaaaaaaaaaaaaaaaaaaaagtgccagtagtcccagttactattgagaggctgaagcaagagagtcgcttgaatctggagggtggaggtggcagtaaggtatgattgcaccactgcattccagcctaaatgacaaagcaatactatgtctcaaacataaataaataaataaataaataaataaataaataaataaacggcaaatctgggcaggggtgaatacagggggaagggaatgtgaagatgaagatgccatacagagaaaggcccggaacagatcctcacacccctcagaaggaaccaacactgccagcacttgatcttgttgatcttggaattcaagctcaattctggcagggttttttgtttgtttgtttgtttgtttgtttgagtcggagtcttgctctgttgcccagcctggagtgcagtggcgcaatctccgctcactgccagccccgcctcccgggttcacgccattctcctgcctcagcctcctgagtagctgggactacaggcgcctgccaccatgcccggctaattttttgtatttttagtagagacagggtttcaccgtgttagccatgatggtctcgatctcctgacctcgtgatctgcccgccttggcctcccaaagcactgggagtacaggtgtgagccaccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtccccttagacagggcacctgcccgccagtcacaggtcctgtcacccagccccttcctctcatgggctccagccgcctcgctcccacaggtctcctggagacccgagttgctgatgtcagcgactattgcgagtgctcctgtgggacactgtcctctccccagcaacagccttcagttcacacccagggaggagatggagccccacactgcaccagcacacgactccagctccaactaggtgggtgttgatgctgaaggctgtgacatgcaaataccccccaggatctccttgtcaccccgaccaccaccaccaaagcccaggcaccaggcccctctcttctccaggacccaggcattcaagccccgcccgactctcaatggtcctttgtcccggactgggaaaggcacgggcagagtctgacatcatgaagcctggggtgggggtgggactccccctccccctccaactcccccccagccccacaacgcttctctccctggtctgagggatttccccgcccctcaccccctgggttctcccttgagagcgaggaccccccctccccactgctctggcctgaaggaggacaggagatgtcccagtgaggctgaacagctcatggtgaaatcactgctgcactttgtcacgccacctccagctgccccgagcccccacccaccttgcaaaagtcatgaccaaggggtggaatctgcactcagagggtccttgcccaacttggtcagcacagtcctatgtgcaccaagcactgccccggggacagaagggtgcacatgacagacagagaggcagataggtttctggtgagcccctgcctctgagagctcctgggttagtgggaggcagaggcgggcagacctagggtgcacacgggccagcctgccaaggctacagaaggaaaggacagcattgcaatggaggggcctggctgatgggcgaagatgggaaagcttcccagggaagcggcacccaggctgctgagcctacaggatgggtgaacggcagccagtgccagagtggggagtgctatggggtggggactgctttccaggaagaatgagcagcaggtgcacaggccttgagtctgaaggtgccctggggctctggggaacacattcaaccacccacactgtttattaagctcaactgcctgccaggagcttgtctacgagcaaggatggattgagaatatccaagacgaagcttctggcctggtggaggtcacgttctcatgaaaggagttggtgaacacggaaggtcatttcagatggcaagaggaggtgacactgacgttgagggtggaaaggacctgtctcctcctgctgcccacctaatgttgccaccaagattccctgaggacaatgcctctgtccctcagcctgggacttccaaagagattagactgcccccccacccccgggacccagaatcagggtgtacagggatggaagatggggagagagcaaggcagccactcccgacccctccaggaaagagctaggagaacccaggcgtcaggctgcccagtccgagccccgtggtgacaagggcccctttgtgcccccctcccccgggggtagggaggagctgggccctggaggcaggcggcccctggcacccagggggaggggaggggctggcaagtgggggcctagaccctggaaggcaggggactgcgagctgggctggcggagcagaggtgcagaagcaactgagtccaagtgagtatggtggcagggaggccagggcaaggggagcagggcaccggggcagtggcacccagacgtgagcagggtcaggtgctctgggtgagggagcatcgctgtgcaccgctactgatttaggatgcaggagtgtgtggcttggggctgctttggggatgggctcggaccatcgctggggcagcgatggggctctgggaagaaaccacagagagaaaaaacaaagggccccccctcagcaccccttgtgggtgaagattttgcaggagaggtttccttggggttcccgagtgcggggcagatggggtggaggaggtctgcatctggccgaagaatggaaggatgtccaggtgatcagacacctgcaggctgcaatctgggaggtggatgggggcagtgggctgttagtgactgcattctagcacctgggcacatagcaggtgtgtgtgtgtgtgtgtgtgcgtgtgcgtgcacacacatggctgcccatgcaccttcctctgtaagcctcagtcgacttttcttcattaatccccactaaggacactttttatttttcgttacttttttttttttaagagacgggactctcactatattgcccaggctggtctcaaacttctgggcacaagagattctcccaacttggccttccaaagtgctgggtttacaggcgtgagccactgcgcccggccccaactacagaaactttttagatgcatttgtcctcatcccatccttcccttggcattttaatccaacagatctgctgtacatatgtttatggactgtggccacacacactgtaatagctgaggttgatttggcccccatcccgagaacttgttttccccgctgttaagagtgcatggtctacctgcttgtttcatgtctgcccgggcacgtgctcatcctcatctgcatctctctcctgtaccttcctgtcacaggtgcaagggcagcgtcggccaggtgtccatcggcgcgtgtctgagtggacgcgtctatagccatcctcagtgtgtgtgtgcagttccttgcatctttgttagcctggcatgcatgctgggctgtgtgtgtgtgtgtgtgtgtgtgctgaatgccagggctgtgtctgtccaggtgtgtgtggacagcagcagaggcattgcatgcacgccttgggaactatgtgagtgccagcccatccctgtgggcacaggggtccctgtgcctgtctgtgtgttcagggtcctgtctgggtgtctgtatgagtctccgctgcgtgtgcctgccccttctggctggggctacatctgtcacatttcatccccgcgattggatgtgtctgtgcatgtgtctctgtccgtgggaagagggcggtgaaggctgggaaaagcaattgcttggaaaccctggctgcaaccccaaggcaacccatggagcagcagggtgccaggggctcgctagcccccaccctgggccttcctggccctgctcaaaggccagccaggagtgcctgacccctttcttactccccacttaccctgaaagccccccgcaggctaaaacaccctctccccgagggaacaggactcttttgtaccggggaccagcttctggtgagggtgcggacaccaggggccgtctgtggggtgggagagggcggcaggaattcacgcggcatgtcgggaatgctgatactgtgaaacccagtcattgatggctctgggtccctgcccgccacccccaggccccggccgtgggacatctgctccctcactccactcgccacacccctcagtctcacccccgtaccccgatgcggtcgttcccccttccctccccacagttctctgacaccccagcttggagggagttgttgccagagagtggcttcgaggctgtgtgggagggtcccaggcacaatgggagggccacatgggcagcctgacaacaggtcacaacccatgcaggagatactgaagcgggggtgggttgggtgcctcaatcccgcccccttgcacctgagtgactcttgttgcatgcaggttgtctggcggcttcaggtggacccagaagacgtccccaactcagggagattcaggtgaggggcagggtaccaactctcttcccttgcttcagctttgcaatgctggccctgccttggctctctggttcttactttctggagatctccaggggcatcacggtgacaaagataatgatcagcacatcatcactgcatagagacaggacatgcagcaaagactgcagaccaactgtgtggccttgggcgagtcacttaacctctctggacctcagctataaaatgaggataatgcatcttcctcaaagagatccaatgagttaagacagcagaataagcagtgagggctggcacatggccaatgccatagaagggtttataattataagtaatagcagcaggctgggtgaggtggctcatgcctgtaatcccaacactttgggaggctgaggcaggaggatcgcttgagccaaggagttcaagaccagtctgggcaacacagaacatggcaagactcccatctctaaaaaaaataataataataaccaaataaataaactaaaataaaattagccaggcatggtggtgtgtacctgaggtcccagttactctgaaggatcgcttaagcctggcagattgaagctgcagttgagtgagccacgattgcaccactgcattccaggctgggtgacagggctgagaccccatctcaaaaagtaaaaagttaaaaaatatcagcagaccaggcatggtgatttacacctgtaatcctttgggaagccaaggcaggaatattgctggaggccaggagttgaagaccagcctgggcaacatagtaagaccccacctccacaaccatttccacaaaaaagaagaaaaattaactgggtgtggggtggcgcataccagaagctgagacaagaggataacacgagctcaggattttgaggctatagtgagctgttattgtgtcactgcattccagcccgggcaatgaaacaagaccctgtctcagaaaaataagtaaataaatgcataaataaataataatagcagcagcagctaacatatgaatgggccccttcctgaagcccagatggaacaccccctttcacttcccccagcctttaaccctctcctctccctttccagcgatcactcactcgctgtacagaatgatattcctcacggcactgcctctgttctggattatgatttcaggtaacggctgacaggtgctggggacctaaaggctttggcccctgagcaggttggaggtgggtccccgcagccccccggcatgtggttggggatgggagccggagggggtgatcgggtaggacgtgtccctgagcctcagctctcctgcttgcccgcagcctcccgagggggtcactggggtgcctggatgccctcgtccatctcggccttcgaaggcacgtgcgtctccatcccctgccgctttgacttcccggatgagctgcggcccgctgtggtgcatggtgtctggtacttcaatagcccctaccccaagaactaccccccggtggtcttcaagtcgcgcacccaagtagtccacgagagcttccagggccgcagccgcctcctgggggacctgggcctgcgaaactgcaccctcctgctcagcaacgtcagccccgagctgggcgggaagtactacttccgtggggacctgggcggctacaaccagtacaccttctcagagcacagcgtcctggatatcgtcagtgagtccccagcggttgtgcaggcaccgggagctggggcagcggggcgggaaggagtgtggccggaaggcctccccgcaccttccccagcaggcctggatggcagatctgggaggtgctgatttggctgggggtgcaaacctcaaggcccacgcagaccatgcagatgacagacatgaacaaagcagggccccaaaatagtcttgctgccctcagggggaaacaggtgctgctactcttttggaaacacctggagaaaggcagtggggccagggggtaggggcaaggctgctgggcccccactttagcgtggtgatcttgggcaagtgacttaacttccttgggccttggttttcttttccgtaaaatggggataagaacagcacttaaggcaatgagtgaaaagccatcagatgcccagagcagcacctggcacgtggcccccagctctggccaacagaaagcagggcggtggctgtcaggtgttctgaattttcaagataaaccagaattttggattctttggtgtaatctcctaattcttaaattttggttgctgattcagatttctttttttaaaatcctttaagccaaatagaatacagctatggccagacatggcaatcagaatagggcacactgcctgatttcagggatccccctgcctcatttctgagtggcgctgctgcttggagtcctcagcgctgagtccctatgagagagccgggttcaccctggtgcagaaagagactgcacaggtgcagtacacacacacaccactctacagaaatcacacactacacactgcacactctacctacacactacccacacaccacacactacacatacatcacacactacacaaaccacacaccacacactgctcctgctacctacacactgcccacacaccaaacatacacatcacaccaaacacaccacacacacacactacacaaaccacacaccacacactgcatacactacacacacacacactgcttggcgctgaggactccaagcagcagcgccactcagaaatgaggcagggggatccctgaaatcaggcagtgtgccctattctgattgccatgtctggccatagctgtattctatttggcttaaaggattttaaaaccacacaccacacacacaccacaccaaacacacaccacacacacacaccacattacaaaaactcaccacacactacacacacaccacacacaccacaccaagcacacaccacacacatcacacactacacaaaccacacaccacacacttcatacactacacacactacccacacaccacacacacaccacaccaaacacacacaccacacacacaccacactacaaaaaccacacaccacacactgcatacgctacacacacactacacacacaccacacaaacaccacaccaaacacacaccacacatccaccacgctacaaaaactacacaccacacactgcacatgccacacacacactacccacacaccacaccaaacacacaccacacacaccacacacaccacacactacataaaccacacatcacacactgcacatactacccacgtaccacacacacaccacacacctcataaactacacaccacacactgcacacactacccacacaccacacacactacacacactacacacaccacacacatacaccacacactgcacatgctacccacacaccaaacacacactacacactacacactgcacaaaccacacacacactacaccctatatacactgtacacatacatgcgccacccccacatcacaacacaaaccacacaccccacacacaacaaacatgcacaacacacgctacacaaaccacacaccacacacacaacacaccaaacacacaccacacacacataccacactacaaaaaccacacatcacacactgcacatgctacacacacacaccacaccaaacacacaccacacactacacaaaccacacaccacacactgcacatactacccacgcaccacacacacaccacacaccacataaactacacacacagtgcacacactacccacatgccacacactacacacaccacacactacacacaccacatacatacaccacacactgcacatgctacccacacatcaaacacacactacacactgcacaaaccacgcacacactacaccctatacacactacacatacatgcactacccacacatcacaacacaaaccacacactccacacacaacaaacatgcacaacacacactacaaaaaccacacactgcacacacaccacacagtacccaaaccacacgccacacaccacacactctacctacacactacccacacaccaaatacacaccacacaccaaacacacaccacacaaaccagacaccatgcacacaccacacacacaaaccacacactatacccaccacacactgcacacacacaccacatactacagaaaccacacaacacacactgcagacactacctctacaccaaacacacaccatgcgctacacacaaattacatgctacacaaaccacacacactacaccctacacaccctgcacacatacatgcactacccacacaccacacacataccacacactacacacagcacacacacaccacacatgatacaaaccacacaccgcatacacaccacatactacactcacaccacacaaaccacaccacacacacaccacacaccacacacaccacgtactacgcaaaccacataccacacacgacccaaactacacaacaccccacacacactgcacacatacatgtactacccacacatcacacacacaccacacatgacacagaccacacaccacatacaccacgctctacacccacaccacacaaaccacacatcacacacacaacacacactgcacacataccatacacaaaaaccacacactacacacatacatcacaaacacaccacatactacacaaaccacacacatcacactacacacatgcaccacacacccacaccacacacacacacacacacatacctacacacacacacactcacatgcccggcggagggtaaaccaagcaggcatgggagaggagagccgcttgggaagtgatgaggtgtggggagcccacgctgacgccagagccacagggtttgtagccagtgttacctggtgccagctgcagcctcagtttcttcatctgcaaaatgagcaaaattacagtcctcaccctctcgctttgcgggagggactggcaagttaaacgccgtcaagtgctctggccacgacactgtgattttcattacgatggcgctctggtggctccgtggagggctccggggtgaccaagaggaggaagggtaaagggaattctgaatctggaggcagggagcggaggcgataccgttgaggagtaccattgccagcaatggaggtggacaaggaggagggtgggtggggtgggaccgggaccgtagcccagtgctgctttctcagccctccctttccccgcctcgtatagacacccccaacatcgtggtgcccccagaggtggtggcaggcacggaggtggaggtcagctgcatggtgccggacaactgcccagagctgcgccctgagctgagctggctgggccacgaggggctgggggagcccgctgtgctgggccggctgcgggaggacgagggcacctgggtgcaggtgtcactgctgcacttcgtgcccacgagggaggccaacggccacaggctgggctgccaggcctccttccccaacaccaccctgcagttcgagggctacgccagcatggacgtcaagtgtgagcctgggtgcgggcggggcggggtggggcggggtggggcggggtccggggagggggtggacctggggatgcggccggaggcggggccgggccgtgatgggggcggggccatgcccagggccaggcagggattggggggttgggtgggacgggggcggaaccaggcagtcctggggcggggccaaggctgagggcggggccggacagtgttgggggcggggccgggctgggagagggcactgggccggttccccagcacctgctcactaacctcgctgtgtcgcgggccttagaccccccggtgattgtggagatgaactcctcggtggaggccatcgagggctcccacgtgagcctgctctgtggggctgacagcaaccccccgccgctgctgacctggatgcgggacgggacagtcctccgggaggcggtggccgagagcctgctcctggagctggaggaggtgacccccgccgaagacggcgtctatgcctgcctggccgagaatgcctatggccaggacaaccgcaccgtggggctcagtgtcatgtgtgagtggcccactctgtgcgtccacacgcccacctgcagccgagagataaagggaaaggggcctcatccagggcgagcatgggctgggtcccgaggggaccggccataaacagtcgaggccaaggtagacaggggggttgcaagtcaaggtgtaccttcattctttccacaagaatctggggaacacctgctctgcctcatcctccttccaggacaagacccaggcctgcctcctagggaagcctgttaactgcagcttcctgggggcagttcctggttgttctgggacttgatgtgggtctggtcccaggaatctgcgttttactttataaaatttttttggagacaaggccttgctctgttgcccagtctggaatgcagtggcaccatgatagcaccacttgccctcaaactcctgggctcaagcaagcctactaccccagcctcctgagcagctgggcctacaggtgtgcaccaccacactccaggctaattttcagattttttttgtaaaggtgggattttgctatgttgcccaggctggtatcaaactcttgggctcaagcaagcctcccacctcagcctgctgcgctgctgggcccacaggcaggtgccaccacacccagccaatttttctatttttttatagagacagagaatcgatatgttccctgggctagtcttaaacttctgggctcaagtgatcctcccgcctcagcctcccaaagtgctgggattagaggcatgagccaccgtgcctgtccaggaatctgcatttttaaatgaattccattgtagttctaatgagagggttgaggggacttcaggcctcatccagccccttgtatgcacatttatattactgggccagcaagaagggagctggtcagaagaggattcttagctgagaaccaaagagataccattcattcattcacaaatgtgtactgaggcaaagtgcccagcactggggatattaataatgacagccgcagccaacatttactccacagctcttgagtgctttttttttttttttttttttgagacagagtctggctctgtcgccaggctggaaggcaatggagcaatcttggctcactgcaacctcccacttccctgttcaagcaattctcctgcctcagcctcccgagtagctagaattataggcgcacaccaccacacctggctaatttttgtatttgtagtagagacagggtttcaccatgttggccagaatagtctcaaattcctgacctcgtgatctgcccacctcggcctcccaaagtgctgggattacaggcgtgagccaccacactcagcctaatttttgtatttttagtagagacagggtttcaccatgttggtcaggctgctctcgatctcctgacctcaggtgacctgcctacctcagcctcccaaagtgctgggattacaggtgtgagccaccacgctcggactcctgcatgcttttgacatgcaatcttccccccggcattccccacggctggctctgcccacctcctaggctcgctgaagccttcccccatcatcctatcccaaactgtaactaccctgattttccataccctcagcccctttatttttctctacacacttcttcccatcttacaaattacatattttatttaattacatcggctgtttccacatgggccttgttcaagctagagcaatgcctgtcactcagcaggttctcagtgaatgttggatgatcacccctatgaggttggaactattatgaagcccattttccagatgagaaaaatgaggcccagagaggttaagatgtgggtccacacacaactggacaggggtagagtagggatctgaagacaagcatgctggctaccaagctgctgttcttggaaatgagatagccaggactggggtcacctgagccttcctgaaccggtgtgctaggtttggggtgggatctggggtcatatctggggatggtagttggctggcagaagaagcacctcctgggttctgaccatcagtcccgtcctaccccgcagatgcaccctggaagccaacagtgaacgggacaatggtggccgtagagggggagacggtctctatcttgtgctccacacagagcaacccggaccctattctcaccatcttcaaggagaagcagatcctgtccacggtcatctacgagagcgagctgcagctggagctgccggccgtgtcacccgaggatgatggagagtactggtgtgtggctgagaaccagtatggccagagggccaccgccttcaacctgtctgtggagtgtgagtaccttccgctcccctatgctggggatggacggttccgtgggggacaccagggttactgtgggtgcccacgcatcccaatcagtattggctttgcctgtcctccgcagagacaaggaagggagggcagggaagctgaattcacagcaggaaaataaaatcccatctgagaatattgtgttcccacatccgggagtgggcttttttttttttttttttttttgagacagagtattgagtcttgctctgtcacctaggctggagtgcagtggcaggatctcggctcactgcaattgctgcctcctgggttcaagcaattctcctgccccagcctcctgagtagctgggattacaggcgctcgccaccacacctggcaaatttttgtatttttagtagagacggggtttcgccatgttggcctggcttgtctcaaacccctgacttcagatgatctgcctgcctcagtctcccaaagtcctaggattacaggcgtgagccaccacgcgcagcctggggtgggcttttgaccagtgaaatttctggatcctgtggccactgcccctctgcactaaccgaaacaatgaccatgatctctaacctgtgtagagtgtcgctatgtaccaggcactgttggaagcgctgtacagcaacccactcatttaatcctcatgacatcttcatgagggaggttctattactgtttccctgtttacggagaaggaaactgagacccagagaggttatgccacttgcctaagttcccacagccaggaaatggcagaatttgaggtttgaatccaggcagtctggttccattcttcttccctgcccaaggctgacctcatcctatgttatgacagcagaatacattgatggggtaattgctatacacaaaaggctgtgcggctctgtgagaggtggaggatagggctgagaagacaccacgcttatgaacaggtacagaatagctggagagatgacacagatgcacataaaaagctactgtcttggaaatgaaactcaccattgcaccgctggccagcgcctctcatctcctcactatggactgtgccaccatctcccaccacccctacccccacagccatcactccaggttgtagcagccaagtcacagttttgactccccttccttaagcaattccctctggaatatcgccttcctgtttccatttcccctgcttcctcccaagttcctgttggcttctagcactcctccccaaatttcacctctctggtcttcacgatgcccacaatggcccccaccacacaagtttgccagaaggttcgatgacattcaacatgcaaagaattcaaagcagtgtctgctacacagtacatgctctgtgctgtgtacatggcgacaatcagtacatggcagatacaggttagtcctcgggggcaacctctcgtggcaaagccgtccctctcctgctgacctataatcttcaggcactttccctcctggttctgttccctagcggggctgatgtgatcctggcgcggggctgcgtggtcccctgctccctccaactgtgcgtgctatcctgggccagcttccccctctggttgtcccctgatccctgttacaccccacaccagtgattcttcagtttaagagtcagagagaggagccgatgggagtacttgaacaagcctgcagcaccaactcacatacattttccggtggggtgcagatctctcctttatagtaagagcagcaggcagcaaatgcgcgttaggggcctgccctgggccagaccttgaatcctctacagctgttttctggttcagttcttatttttattattattattattttttttttgagactgagtctcgctctgtcacccaggccagagtgcagtggcacgatcttggctcactgcaacctctgcctcccagattcaagcgattctcctgcctcagcctcccaactagctgggattacaggcatgcgtcaccatgcccagctaattttttatttttagtagagacggggtttctccatgttgcccaggctgttctccaactcctagtctcaagtgatccacccgcctcggcctcccaaagtgctgggattacaggtgtgagccaccatgcccagcctatctggctcattttcaattctagggtcaccctgtgaaacaggggtgtgttataattatcccctttaccaaggagaaaactcaagggcggaattccctgaggccaggcagctataaaagtgggtccgagcccgataattccagactcctgtctgccccagctgttaaacctctggctgcctcacctccctcacagctcttagcactctaggactcaatccggcttctcttgaaaacgaacacgcaggcagatgtggagtgtgcaggcctcacctgctagacttgaggggagcagtggccctgtcccctgccccacctgccagctccctactcttcacccaggcctgtgtcaaagtgcttgcccttggagagtgcgaccctcaggccccctccctctccacacagtcaatgttccctggcaccaggtctccaatgttcactgacagtggtggtgacccttgagcagggccttctgtcttacctgccaaccccagagccctgaacggcacggggcatgcaggaagtgtgcaaccttaccgagtgcctgagatgtctagggaactagcttgagtacgttgtacgcattgacctattttgttcttacaaccatgtgattgaggggagggtaccattcttcaacccagtttaatacaaggaaacagaagtttgactggcatccagtcccaacagggctgaacagacctgggctagaatcccagctctgtccccatcctcctgcctgagctcaggcgagtgacttcagctttgcaacccttagcaagggttcataacagtatcttaccacaaagatggctgtgagaactaagagaattaggctgggcgtggtggcccacacctgtagtcccagcactttgggaggctgagacagttggatcacttgaggccaggagttcgagaccagcctgaccaacctgacaaaaccccatctctactaaaaatacaaaaattagccaggcgtgatggcgcacacctgcagttccagctactcaggaggctgaggcaggagaatcgcttgagcccggggggtggaggttgcagtgagctgagatggagccagtgcactccagcctggatgacagagcaagactgtcccagccccccactccagcctggatgacagagcaagactgtcccacccccccactccagcctggatgacagagcaagactgtcccatccccccactccagcctggatgacagagcaagactgtcccacccccctactccagcctggatgacagagcaagactgtcccatccccccactccagcctggatgacagagcaagactgtcccacccccacactccagcctggatgacagagcaagactgtcccacccccccactcccccacaaaaaagaagaactaagagaacaatactgagtgttcatagtgctacatactctgtggatattggatgtcatcatctttctcactgatttttcctttggactccaggttaaatatttgttgtgtgttttgctgctgaggttttgctcatgtgacctctctgcgggaatggttctgtctatccacccatgagtacttgggtgggatgttacgtatttttaattttaattttttatttttttgagacagggtcttgctctgttgcccaggctggaatgcagtggtttgatcatcgctcactgcagcctcaacctcctgggctcaactgattctcacacttcagcctcctgagtagctgggactacaggcacacatcaccatgcccagttaatgttttaattttttgtagagatggggtcttgctctgttgcccaggctggtctcaaactcctgggctcaagtgatcctcctgccttggcctcccaaagtgctggaatgacaggtgtgagccactgcacccggctgggatgttaagtgtttacaacacacttgcgcgcctatcttcggagtcccgtagccccttgtgagttactgactgtaaccccctggtttgcacagatgagaactccatcctagaggcccaggagcctgagtggcctcacccagccagtagatggcagagctgggattcaagccaaatccatcccaccacaaactcctcattctttgtacctttgtcttacaggtttgtctagagtcccataacagtttccgcagcttcacaggttgtctgaaaagatactaagcacgtgcaccggcagggtgtcggcgttccgccgacatccaggtcgaacactttgtcaccagagcaccagtggggctgtcttgagtggaagtgctttgaaaaagttttatgtctgtcggttcaggttcgctgttattaatgtactccgtggcgtgttagctggttaacgctatagcaagcatattgcagctctgcccgaacaggactttttattcagtagacttagagatgtttgcacagaggttcccattcctgccgtgaatccgtgtgcccgtgtgactcccaggtccaccaccgttaccggcacattctttttgctagcaattgaaaataggtggggtaggtgagccaagggtctcttgcctgtgtgtaagtgggttttggtgagaactcactgagaaccagtgctcagtctagagcaagccaaggagggtgctggactctcaggccaagaaagagaacacagtttaaaaagcagcattctgtgctgtaatacaattgcgtattttggtacaaaaattagccaggcatggtggcacgcacgtgtagtcccagctactcaagaggctgaggcaggacaatcacttgaacctgggaggcagaggttgcagtgagcagagatcgtgccactgcactccagcctgggcgacagagagactccgtctcaaaaatcatagtaataacaataataataataataatttcctgttttggaaaatgaaagaaaaaacctaccagtactatttttgtaatccagtggcagcaaagcaaagctcaaccaagtgactttgggtggagggtggtgtttggtgctagtggcaggagggaatctcatgggtgaggaagggccggggttcaaggcggctttaggggaggaagtggggggcatctgcagcgcagactgaaaggaaggagcacagcctggaagccagaaaggaggggatagtctaagcctgtgtgagccccaagggtctggggaggccgggggctgggagagttccatggttcctcccttctacgtgtggggcccagagtggagaaggagcaagcccctgtcttgatggaaacaggaggccccttatgtaagtgtgtgatgcagggagggtgagtgctggggaggagaactgagtgaggcagggagtgaatgatacgtggagcgaggtgcagcttccctgggtggtcagagaaggagacgccgcatgggtagaggccagtttggagcgagggagggcgttccacaggcaactgatggaagtgttccaagttgagggagaaacgtacagaccctggagtgggagaaagctccacgattttcagacacagcaaggaaccggtgtggctggaaaggactaagccagggggagagaaggagagagtgtgtggtcaggcagggcctgaggggccttgtagatgaaagactttgtattttgggctgggcacagtggcttgcgccttataatcccagcactttgggaggccaaggcaggaggattgcttgagctcaggagttcaagaccagcatggggaacatagcaagaccctgtctctacaaaaacaaacaaaaaccctccagtaactatcatgagtatgacagatttaccgtcctctgcaattctgaacataaagctttaaaatcaaaaggctttttgcaaatttggcaccaccctgatttgacagcaaaatctcgcctaaagaacacaaggctgtttgtaatctatactgatttcatttagggtgaatattcgtactttttgctgtatacattacattgaactatgtgaaattttttctgcatgtcaaaaatggtcaaatgtggctgggcgcagtggcttatgcctgtaatcccagcactttgggaggctgaggcgggaggatcactagaggccaagagtgcaaatgagctatagtactgccactgcacttcagcctgggcgacagggccagaccctgtctctaaacgataaaaaataaaggatttgtattttaggtgaaccacggagcaacagaaggagggttttgagcagagagtgccatgatctgatttatgtattacaaggtgaatgaggttagagagagtgtaagagccagggcccaggagaaacggcccgtccctgtgacatagtgctctgtccaggctgaagctgaggctagagtcgcctcaaaagtggcaccagaagaattgccccaagagagcaccccaaaccaccccgaaatgaggccacttgggattccaaagagagaggcactaaaccaccaggtgatcatcagtccaaagcatttgggaggggaacttgcacagtgctacggcgagagaaagggagggtctacccagacacgtccgtgagggtcagggtatgggtttacatgagggtttaaggaatttggcccagggctggggctggtttctttcattctttcatttttgttgttgttgttgtttggggtttttttgagacagcgtctcattctgtaacctctcgtactcctgacctcaagtgatccactcactcttcggcctcgcaaagtgctaggattacagcagtgagccaccatgcccggcctctttcagtgttttgagcaacaacctaaacacctttatcagtgcctgggaatgttcaaggccccaggcgtgggttagtgaagcttgcagtgaaaacaggcagccggcggggtcgtagtgaggtcaaggcgctctcagtcaggacagagaaaaaaggaggggaaattggagggccctacaggaagctaccgcccccatccttggccacactggccttgccttgagccaaggagtctccggggccgggcctcgcgttggctccgggccaccctcagacctgattttgcccctgcagtcgcccctgtgctcctcctggagtcccactgcgcggcagcccgagacacggtgcagtgcctgtgcgtggtgaagtccaacccggagccgtccgtggcctttgagctgccatcgcgcaatgtgaccgtgaacgagagcgagcgggagttcgtgtactcggagcgcagcggcctcgtgctcaccagcatcctcacgctgcgggggcaggcccaggccccgccccgcgtcatctgcaccgcgaggaacctctatggcgccaagagcctggagctgcccttccagggagcccgtgagtggcgtggacttggggtgggagccacaggagggagcgggcacgtcttagatccaagctcccaaggctgaccaacagccacagagcatgggctatgcagattgacagaaaggtcaaattctccctttccggttggagaggagaagccgccctgagtttgccccgagtttgctaggacctttgaggcatgagcccctccccagggccctctagcatgaaagggattgccctggcacgaggaggctccgtgccaatcagtcagtgcaaggatgccccggctgtgtgactacattgactgtcatcccagcatgtctccaaagttctcaggtgtcgtcaccaccacccatagccctaagggcgcctgggtcttttctgtcctcagatcgactgatgtgggccaagatcgggcctgtgggcgccgtggtcgcctttgccatcctgattgccatcgtctgctacattacccagacacgcaggaagtgagtgccagctggggctgatctggggatgggagtctccaaaaaggggacctggtgggagatggaggcccagagtgggtgggggaaggcagcaccataagtgtagagaaggcagattctgttctgggaatgttcagctggacagaggagagagggttcctgttaattccagcccctgctggtcaggggcacaccagggcctgggctgagccctttacacacatcatttgagacctgtttgcccacattctattttgacagcctccctatctctaggaactctcccctacacactccagtgtggtggggaaagcccaggtaccccactgcagccacagcagcaggtccacttgacgccagaagccccaaagattacacacatctggggcaaaaaaaaaataggccttggccgggcgcgttgactcacgcctgttatcccgcactttaggaggccaaggaggaaggattgcttgaggccaggaatctgacaccagcctgggcaacatagcaagaccacatctctaaaaaaaatttttttttaattagccaggcatggtggcacacactgtagtcccagctacttgggaggctgaggtggaacgattcttgagctcaggaattagaggccagcctgggcaacatagggagaccccatctacaaaaaaacaaaaaaattagctactagtggcacgtgcctgttgtcccagctactcgggaggctgaggagggaagatcgcttgagcctgggaggttgaggctgtagtgagctatgatttcaccactgtactccagcctaggtgacaaagagagaccctgtctctaaaaacaaacaaacagacagacagacagacagaaagcctctccagccccaaaccatacccacctggcccaactcagctgcagccgtgtttctttcttgtggcacacacacatcagctgtcctgagaaataaattaacccctctgctccacatcctggtggcaagaggggcagaaagacccagagcctatgaggggaacctggagaatccaggtgggggtcctgaaaaacggcagagctcaggggccaggtggctcgtccccagccgggcaggggccacagaggtgggaaggatgggctgtgtgggtaggagaggctggtggttctgaaagggctgcttgccacatcttagagatgggtgggagaactctgaggtcccctgagccaaactcctaaaacacgtgggggtgcagaaagggagggcagagagaggtctgacgagtcctgccctgcagaaagaacgtgacagagagccccagcttctcggcaggggacaaccctcccgtcctgttcagcagcgacttccgcatctctggggcaccagagaagtacgaggtaaggaccaggctccaggctggcctgggaacctggatgccagggacactgaaggcctgggaaaggcctgtgaggccaaggggcaggggagtgggagcggcctctcacaggaggagaggaaggacattccagggctgggttggacctggaggctggggaggaggtgcccaggccgaagctgtgtagggggcgatgggacgtggggcctaagggccccctcccctccctgcctgtgtctgtgactgcatttccttctccaatagtccaaagaggtttctaccctggaatctcactgagtgccccaggaggtaggttccgggggcctcagtgtgccctcctctgggccctccttgggccctggggttggcgtgcatgtccgtgtgtccctgtcaggcgtcaaggtggtctctggtgatgtccgggcctgcccggcagtgctggccttgtctagtctgtcctgttgcagctcccttctgtctgtggccaccgtcctgtgtgtccaaattcctgtggctagggggtggagggaggggtgggaagcgtggggggaacccacatgtcacctgcaggacctcccagattgagggcggacccatgcaggacccatgggggggcacgtaccaaaccaggtatttccaggaatttggaaagatggggtcctgactaggtggttttcacccaaaaaggtattaggggttacattgtgtgccctcaaaactcctatgttgaaagcttcctggacgggggcagtggctcacacctgtaatcccacaactttgggaatctgaggcggatggatcacttgaggtcaggagtttgagaccagcctggccaacatggtgaaaccctgtctctactaaaaatacaaaaaattagccaggcgtgttggcaggtgcctgtaatcccagctacttgggaggctgaggcaggagaattgctggaacccaggaagtggaggctgcagtgagcaaagatcgagccattgcaatccagcctgggtctcaaagaaaaagaagaagaagaagcagcttcctggagaaactgaatttgtaggcaaatttcaagttcagcaatgattaacactggcagaagctccagagtgggacctggtgaccgcagggctcgctgggcctgcggtccttgagaaaggaggttctcgcagggatttatttgggactgaactcaggagctctgagggtgcaaacgctctgtcctctgcattgggaaaaggcagggagcaggaccctgctaatgggcggtttcccctcttagagcgagaggcgcctgggatctgagaggaggctgctgggccttcggggtgagcccccagagctggacctgagctattctcactcggacctggggaaacggcccaccaaggacagctacacgctgacggaggagctagctgagtatgctgaaatccgggtcaagtgaaggagctgggggcagcctgcgtggctgacccccctcaggaccctcgctggcccccactggctgtgggctcccttcctcccaaaagtatcgggggctggggcaggaggggagtgaggcaggtgacagtgaggtcctgggggcctgacctccccctccttcccagctgcccctccctgccagcacccccacgccctcattacggctcctctctaacctcctttaccctcatctgtctggaggggagctctgtctgtccgtgttatttattgctacttcctgcctggtctcctgcccccacacctggccctggggcctgtacaaaagggacatgaaataaatgccccaaagccaaatgccagtctagatcctgatgctttctgacccgcctttgggcagcctgccatcccaccgtctacagaacgatgacagaatttctccttgccctcggctgagcctggtatgcaggcaagggcccagggattttagccttgaacccagggccagtggccactaagttgctcccactctgagctggtagctgcgagctgggtctggtttgacttatggatgatttcacataaaaatcctcatgctggtttttgccgcagtcagatcagctgacagcaccaggcttgcacttgtacgtggacatgacttgctgaaagggagggtcctgtgcactggccgcagtccccaccactccctattgtcccacacctggccggcttcctgcactgagattacctcctggtccctgcagcttggagtgcgagccacagatctaggtctcaccagcccgtgttggtttcaccaccatctctcacattcatgctgcaatttgcagcgtcagcctttatacatcactacattcagttccagaaacattaattaagcaccagctgtatactgagccctttctagaggctcaggctgtcctgagaagggtctcctaggacagctctgtgacgatgagaacactgagacttagagaagttaggtgattttcccagggtcccagagctcggaaacggtgtgtccaggccatggggttgatgcttctgattcaaatgcactctttcttttcttttcccttcctccctctctctctctctctctcttttttttgatggagtctgtctctgtcacccaggctggagtgcagtggtgcaatctcagctcactgcaacctccgcctcctgggttcaagtgattctcctgcctcagcctcccaagtagctgagatcacaggcactcgccaccacgcccggctaatttttgtatcaaatgcactttttctataatacctgtcaggaagttaaaaagggccagagtgtctggtataaatgggattgataactaacagttgttgaacgctttctatgattctacccagtttgcattaattaatctccattaacctcatttaccttccctaataactatgacaatggttctcaaagtgtggtccctaggcagcagcatcagcagcacccaggaacttgctaaaaaggcaaattttcagcccccaccctagacttcaggaatcaaaaaccctgaggtggggcccaggaatctgtgttttgagaagtccttggtggattctgatgcacgtgcacgtttgagaacaagcagctgaagcatggagaagttacatcagttctgtggtccccaattgttagcagtggagcccagatttgagccccgaccactggcttcggaggccacactctgacgctgtgctacacggccatcttggtgagaaccaacagctgctcacagagcccgggtgctggaggagcagtaaggttaagctgtgggctgcgggcagtgagggcagggtttcctagacggcagctctccctgatttttttttgttttttgttttttttgtttattttttgagatggagtctcactctgtcatccagtctggaatgcagtggcacgatcttggctcactgcaacctctgcttcccaggttcaagcacttcttctgcctcagcctcccaagtagctgggactacaggcgtgtgccaccacacccagctaatttttgtatttttagtagagacggggtttcaccattgttggccaggctggtctcgaactcctgacctcaggtgatgcgcccaacccaccctcccaaagtgctgggattacaggcatgagcccctgtgcctggtctctccctgcattttgaagaaggcagaggacacagcacagagaccaaaataaaggcctagaggcaggaataaacaaaccaggtcgggaggggaggtgacatggggctgcttggctgggatgggaagtccacatgcaggaggaaaggagacgtgtggggggccgggctgtgggaagggaaaccctctgtggggcctgtccaagctgggagggtgcatgccctttcttcacggagctcacagtcttgcagggacaaggacatgaaagaatctcatgcacaatatcaaactgcaactgtgacaccggcttccaaggagaagctcagagtttttacagcaggggtccccagtgctatactgcacacccagatactggtctgtggcctgttagggactgggctgcacagcaggaggcgagcagccagcgagcaagcatgaccacctgagtcctgcctcctgtcagatcagcagcggctttagattctcatagcagcacgattcttatcgtgaactgtgcacgcaaaggatctaggttgcacactcacagatggtgcctgatgaactgtcactgtctcccatcacccccggatgggaacgtctagttgcagggaaacaagctcagggctcccactgattctacatgatggtgagttgtatacttacttcattatatatcacaatgtaataataatagaaataaagtgcacaataaatgtaatgtgcttgaatcatccccagctccctccccactctcaggcccatggaaaaattgtcttccatgaaaccaatccctggtgccaaaaaggttggggaccgctgtgtgacttaaggtcacagggggcaggggaggcttccctatggaaggaaactcacacatgtgtgaaggccccaagtgggaacatgtttagcaaaattccaggagctgaagcaaggccagagaggcatcggatggggctggggatacacaggggcctctcagcagccgggagggaagcctcttccagatcccctgcatacatgctcaccagccctgccctgacacacctgtcccctgacgacagactctggctccagcaggtctggcctgggaggacttcacccagaggagcaaaacattgtcaataaccagggatcggggagtaactcacgctgcccaaagtgcagcttgagggccctgggagccactgtgacgctactgtgtatgcttcatttagtatgcaccggaacaacaggaaaccagaatgccgcaccagcttcggatgaggctaagtcaaaataaataaataagaaagaaatcaatcaactgaactgattttaaaaatgtattaaataaacatgttgcaggtggctcctgaaggttgtaggcaaacctctaaagtttgggaaacaatgagggaatttgacacaaagaccatccttaggagggaccggcactcagccatggcgaacgtgtaggaccgagccaggtgcggtggctcatgcctgtaatcccagcactttgggaggctgaggctggtggatggcttcagcccaggagtttgagaccagcctcagcaacatagcgagaccctgtctctacaaaaaatacaaaaattaggcaggtatggtggcatgcgcctgtagtcctacctactcgggaggctgaggtgggagggatagtttgagcccaggaaatggagtttgcagtgagccgagattgaaccattgcactccagcctcagcaacagagtgagaccctgtctcaaaaaacgaacaaacaaaccagtaggacctgaactcaagttcactctctcagactttccccacccagctcctggaccccaccagaattcaacacatgctcactgagcacctctgtgtgccaggcctatgctgggccccagggtcacagcagtgcccaaaaagaatcactctgtgacctcccagagctgacattctgcagaagagacagacaacgatcagaaagacaagcaaacacatgaccgcacatctgacagtgaaggaactgcagaggggtgcaaggtcaggctgtgctgggtcaggctgccatttcagaaagagaagtcatttgacttgagaccagaaggaagtaagggagggagctctgtgggttcctggggaatgtgggtccagggaaggccaaaatcgagtgcaaaggcccctggcgagaatgtacttgttaccttcatggaacaagaaggaaagaagcatgcttgagtggagtgatggagccagagtggttgcccaaggaagctcgattacacagggccttgtaggccacaggcaggactggggcttgtttgtttgtttctttgtttgtttgttttgaggcagagtatcgctctgttgcccaaggaagctcgattacacagggccttgtaggccacaggcaggactggggcttgtttgtttgtttctttgtttgtttgttttgaggcagagtctcactctgttgcccatgctggagtgcagtggcacaatctcagctcactgcagcctctgcctcccgggttcaagcaattttcctgcctcagcctcctgagtagctgggattacaagcatgtaccaccacgcctgtctaatttttatatttttagtagagacggggtttcaccatgttgaccaggttgctcttaaacttctgacctcaggtgatccacccgcctcagcctcccaaagtgctgggaatacaggcgtgagccatcccgcccagcaatggaatttaatcctaggttttttttttttttttttttttgagatggagtctcgctctgtcaccaaggctagagtgcagtggcatgatctcggctcattacaacctccgcctcccgagttcaggtgattctcctgcctcagcctcccaagtagctgggattacaggcacgcaccaccatgcccaactaatttttaatagacacggagtttcaccatgttggccgggctggtctcgaactgctgacctcaagttatctgcctgcctctgcctgccaaagtgctgggattacaagtgtgaaccactgtgcccagccaggacttgggctttcaaagagcgcgttgagaagccgctggagaagtgagttcggaggggtgtgatggcaggcttgaggcttcagaggcccactggcagctgcgtggacagtgagcacaggctatcagtggaggcagggacagggcttgggaggccctggccattgtccaagagagaggaagtggagatggggagaggggtggggtcaggacccattttggaggaggaagtggtgagactcacttgaagagtcaaaggtgactccagcagcttccttaagaggttgaagaaagcaggaggggcaggttcagtggagaacgcaagagtgatctactccggccgagttcaggcccagggaggccctcagggacagggaaggcagatggcaccccctccctgggaaatgccaagccgaggaagagtcagaacacatgacacagtgactcagagagatgggggcagacgctgagatgagggttggccaggcaggaaggaaggtgagaaggtctcatggcctcacgtgccagtagggctgggccaccacgtgtgggagggaggacacccaggcaccaggccatggtcatgacacgggtctctttgtccctcccggtctgccaacctcctgagtcactcctgacggagatgactgatccatccctggcccgcctcccaccctgtccctgggacagtgcctggggcaggcagctccattatcctccttgatgaaagagctcccagccagcactggccactccagagcctcctccccaggtgggtgatcatgcagggctgggctcttgcgactggccgggggtagagatgcaccgcactgctgagaagtgctttctaggagttcaagaccagcctgggcaacacagcagacattgtatgtagaaaaaaaaatgtttaaaaataagctgggcacagtagtgcatgcctgtcatcccagctactcaagaggctgaagcaggaggaccacttgagcccaggagtttgaatctgcagtgagctatgagtgcaccactgcatgccagcctgggcaacagagtaagactcagtcactaaaaaagaaaaaaaaaaagatcgaatgtggtgctcatgcctgtaatcccagcactttgggaggccaaggcgggcagatcatctaaggtcaggagtttaagaccagcctggccagcatggcaaaaccccatctctactaaaaatacaaaaattagccaggcgtggtggtacgcgcctgtagtcccagctactcagaaggctaaggcaggagaattgcttgaacctgggaggcggaggctgcagtgagctgagatcgcaccattgcactccagcctggacaacagagtgagacttggtctcagaaaaaaaaaaaaaaaaaaaaaaaagaaagaaaagaaaaagggggagaaaaaaaggagaagtaggcgagcctctttctttccccactcttctcgctctcaactccaggctgctccttaaacaggaggtgacaacctcaacctcgcaaattaaaaaaaaaaatcttttaattttgaaataattatcacaggaagttgcaaagatagaacagagaagtctggcagcagctgagccaaaggccccttcccaccctagagctcgatctgcctggggagcgggaaggaaatgacagtttagtcccaaagggcctctctgtgaagctcaggctagggctgagtagccagaggtgggtgaattaatgtctgcagggagtgctgggtcagcagcgtaagtgacaatgtctggaataatgacagctcacttttacagagagcccgttccatagcagccaccatgcaaagtgctgtaggggctggggacctgtcacagcatagccctgaagtcataacagcaatcttattatcaccctgggagggaaactgaggtgatgtcacaacaaacacgtggcagacctgggactggaacccgggtctttttaccacatgcttgtcatgggatgtgcgagttgctgagtgtgtcctgtgtgtgctgtcaccagcccggtgaggaaggcactatcattgttcccgtcttaccatcctgggcagaggttggggggtgagggggacatagccaggcagggagtagccacccagggctcacagggactctgttagttgcctgctttcactgcttccctggtaaaggggtgacagtcaagtcaccaaaaaaggagaccaacgacctgtttgaaggaacagggaggaagagtgaaagcgccgaggctgcgttctcaggagtcctgctcctcctcccttgccttctccacgcagcccttggcctccagaaatcaagacacgtccacaagcccaatctcctcctgttagaagactatgagccacacctggtgctgtggcctgcagaaacctcagctactccttctaggtgaggagcaggaattcaagccccaaagggtaccctccctgagacctttgggacctggccacctggcttggagtcccccattgagattcctgggattaaaaaaataaaaatatacggccaggtgcggtgactggctcctgtaatcccagcatcttggaaggctgaggaagtggattgcttgaggacaggagttggagaccagaatgggaaatgtgagaccccgactcaataaaaaataaaaaataaattaacggggtatggtggctggtacctgtagttctagttactcaggtggctgaggattacttgagcccacctcaagttcaaggctgcagtgagctatgatcacaccacttcactccttcctgggtgacagagcgagactgtcttaaatttttttttttttaataagtatagattcacagaagttgcaaagatagaatagagaagtctggtgtactcttcacccagcatcccctgatggttacttcttaagtcattcaggacaatatcaaaaccaggaatttgacattggtataatgtgtgtgtacagttctatgtcattttatcacatctggatgtatataacaacaactgcagtccagatacagaattattctgttactacaaagacctcccttgtgctactcccttcatagtcagacactttcccctaccatccctaacccctggcaacttttcatcttctccacctctatcattttgtcatttcaagaatgttatgcctgggcgtggtggctcacacctgtcatcccagcactttgggaggctaaggcaggtggatcacttgaggtcaggaatttgagaccagcctgaccaacatggtgaaaccccatctctactaaaatacaaaaattagccaggcatggtgttaggcaccttaatcccagctactcgggaggcttaggtagaagaatcacttaaatcctagaggcagaggttgcagtgagccgagatcgagccactgcactccaacctgggggacaagggcaaaactccgtctcaaaaaacaaacaaacaaaaagaatgttgtaacacatgtgatccttggagactggcttttttcactctctgtaccactcttcagaatcgtccaagttgttgcctgtatcctcttcatatctcactcctttttattgctgcatagtactccatggcatggatgtaccgtaatctgttaagccactcacctagtgaaggacgtattggttgtttccagtttttggttttgcttttttttttcttgagatggaatcttgctcttgttgcccaggctggagtgcaatggcgtgatctcggcttaccgcaacctctgcctcccaggttcaagcaattctcctgcctcagcctcccgagtagcttgtgttagaaatgcttgatttttggtgctgtaaagaaatagcactttaatgtaaatttaatttcttcagcaaggctagttttactttctgcagaaagggtatactcgctagcagttttgctacaaaagtacactgaacaaaggagacagggtcatttataacttgatgcatctactttattgctgtgtctggtttctattggctgaaacgggacctcacattctgtatttgtctggattggctagcaacttagaactttttaaaagaggcaaaggcagaggagaacaaaggaaggagaaagtaacgtggaatactgagaaaagtaaaaacatttctaaataaggaagaggaacaggctttgacttaatgctttcttggactagtataagcatgctagggcaaatctttaggctaaattgtaggatctaagaacataaagtacattgatttttttattatggctagtagatatttaagaatgttagcacaggtctttgaataaattttgcttctaagagaagttactatttattcttaattagatggggaggacagtctctttgaaaaggaacttctactttactatttacactgggattaccagcatgtaccgccacgaccagctcattttgtatttttaatagagacaggatttcacaatgttggccaggctggtctcgaactcctgacctcaggtgattgccctccttggcctcgcaaaatgctgagattactcctgacctcaggtgatcgcccacctcggcctcccaaagtgctgggattacaggcgtgagccaccgtgcctggcctgtttccagtttttggctattacaaacaaagctgctgtgaataattgtgtgcaggtttttatgtggacatacgttttcatttcttagggataaaatgcccaggagtgcaattgctgggtcatctggtaggtatattttgtttagtttttcaggaaaccggcaaactgttttccagagtagctggaccactttgcatccccaccagtcgtgtgtgaatgtttcaagttcacagcatcctcaccagtgtttggtgttgtcattattggttatttaattttagctgttctaaagcggtatcttgtcatgggtttcaatttgcatttcactaatggctggtgatgtgagacatcttttcatgtgcttatttgccttctatataccttcttcagggaaaggtgtcatcatgtcttttgcctattttctaactggactgttttttatttatttatttatttatttatttatttatttatttatttagagacagagtctcactctgtcgcccaggctggagtgcagtggtgggatctcagctcactgcaacct

SEQ ID NO: 1286 - DNA, 138398 bp, Homo sapiens
aactaagttttggctttgttgagtatgtgatctttgcactgtgcttcactattttctgctcttaccttgaacttacactcccaagcagggtctaagagtgcccactgaagccaggggcagcagctcatgcctgtaatgccaacactttgggaggctgaggctgagaattgctcgagcccaggagtttgagaccagcctgggaaacatagtgatatctcatctctacaaaaaacaatttaaaaaaaattagccaggtatgatggctcatgcccatagtgctagttacttgaaggttgagacaggaagattgctggagcctaggagttcgaagctgcagtgagctatgatcatgccattgcactccagcctgggtaacagagtgagaccctgtctctaaaagacaataaaaagttcccattgttccatattctcagcagcacttgatattgtcagactttttcatttttgccaatctggtggccagtacatggtaacttattatggtctttgcgctatagattgtttgtgtccatccaaattcatatgttgaaaactaaaccccagctgggcacagtggctcaggcctataaacccagcactgggatgctcagattggaggatcacttgagcccaggagttcaagaccagcctgggcaacatggtggaaacccgtctctacaaaaaatataaaaaaatttgctgggcatggtggtgagtgcctgtagttctagctgcctgggaggctggggtgggaggatcacctgagcctgggagattgaggctgcagtgatccatgatagccccactgtactccagcgacagggtgagactctgtctcaaaaaaagaaaactgaaccccagtgtttgatggtatcgagaagtgaggcctttggaaggtaatgaggtcaggagggtggatccctcctagaaaagagccccagagagctcattcgccccttctgccatgtgaggacacagtgagatgatggctatccatctgtgaacacaaagccagccctcaccagacactatgtctgccagggccttgatcttggatttcccagcctccagaactgtggagaataaatttttgctgtttttaagccacccagtctacggtagtttgttatagcatccaaaatggactgagatagcttgcatttgcaataacagacgactttaagtatttgttcttattatttatcaacccccaagtgcctgttgttgacttttgcctatatttctattgggttgttgatcttattaaattatagatctttctttctttctttctttctttttctttccttgtaatggagttttgctctttttgcccaggctggagtgcaatggcatgatctcggcgcactgcaaactctgcctgccaggttcaagtgattctcctgtctcagcctcctgagtagctgggattacaggtgcacaccaccacacctggctaattttgtatttttagtagaggtggggtttcaccatgtggggcaggctggtctcgaactcctgacctcaggtgatctggcctcccaaagtgctgggattacaggtgtgagccaccgtggccagccaattatagacatttcttatatggtatggatttaaatccttatcagttataacttctcccagtttgaggcctgcgtttttaccctctttatggtgtttttgaaaaacataaactgttaaaaaagctttaactgtgtattcctttgcagctttttattttgcactatgtgtactgaggaacaaaagaaaaaaatgaaatttgagaccagacgtggtggctcatgcctgtaatcccagcactttgggagaccgaggcaggcagatcacaaggtcaggagatcgagaccatcctagctaacacggtgaaaccctgtctctactaaaaatacaaaaaattagccgggcatggtggcgggtgcctgtagtcccagctactcgggagtctgaggcaggagaatggtgtgaacccaggaggcggagcttgcagtgagccgagatcgcgccactgcactccagcctgggtgacagagtgagactccatctcaaaataaataaataataaaaagaaagaaatttgaattaaaaccaaagagcttagtctgtatcaccctcccctgattaaatttttaaattacagttctcctgtcctgaaattatattatgcatgagttctgctatgtgtgtcctgtgacctgagagtgggcaagaactttctctgttcacagctatgtcctcaatgcttcaaacatagctttgcccaaagtaggtgctcaataaacactgtggatggaaggaacaaaggaaggagagaggagtagcggggcagccaccgaaggctgatgtggcttttcatgactccacccagtgaggcccaactggctccaagggtagggcagcagcctaaggaatggaggaaatggtctttcctcaagcagagcttagactttattgtcttggaaaaacctgtttgtatttgggagatgtgcttactttaataggtcaaccctgcaataatgggcaggtctgaggctccaggagtgctggggtagtctattcacccccttattctttctctctatccttttttacccacctgccttgcagccagtgggtgtcagagccagcagcagactggagtctaagggcactgctttctgtccgtgagcttgagaaggcttcttgcccttctgaatctccaagtccttgcctgcaaagcacaggcaatgataaaaacactaacgccttatctggtgttgcaggatcccttaccaagggcttctacgtctcctatcgtgagctcagtactcagtgaggtaggcaaaactggaggaggaaaccggggaggaggagtgagtctctaactccccacgctgtgtggcctaataagccttgatctgtgttctacagactctgagctctgtgctcctctctggggaacaggtggaaagggcagccctccaggaggtggtgagtcctctgagctttggaagggtggactctgcacctgctgcgctggtgctctctgggaattttctccacggacctccagagcaactgtgagtggtagctgttaccattcccatttgactggttcagaaaccttgcctgagggacatgaagtcacttgcccaaggtcccccagcattcagcgtcatagtcagagttcaaactccaaagcccttgcctctgcctcaccactgtggtctccctagacctttagatatagttccagacagtgggttttcccagctcagagcagagtgggtcatgggacagggcaggctccagagggctacgctaccagaatctggtaatgacaactgtgtatgtgtgcgtgagaggcggctgaccgatctagatggggactgaccgatctagaactagatggggatcaatcatcttcagcagatccgagagctggagaattactgcaggggcaaatggctctttctctcctgcatcccccagggccatctctacactgcggtgaagcatgggacgtggtaaaaggacacctttgagctgtgggaaaagctgacacgatttttcagaatagtgtgtttaggaaggcgggggcgcccatgttcttcccgagaggcgttccatccagagctatctggaaaggctggggtactggaagccagaaggtggagaatcactgatgcagctctactgagttttcagctgggccccacccacactgacctaagcacaggaggttcgagggctctccactgaccaggaatgaaaggatcaattgcagagtttcggccttggagcccagtcctggctctccctttgcttgctcctgacgttggaagagttacagcccctcctgagtctcagtcagtcgcctctcacgtgcccattgacgtctcacaggctgttggagagttagggggtcctagcataggtgtcttgtgccaggtacacagctggagctcaataaatgtactgtgacctcaggcaggaaaagccaaggaggggcgggccaccctgggggctggtctgcagagtcttcagggaagaagccaggacaaggacaaggaccctggatgaggacaggatgagaggatggctgcataacagcagggaggctttgggcaggcaggggagcctttccaggtgagtgaatggcaggaacacaatcttggaagtgagaattcctggggtgccttctgggccttgaagcagggctcacagagggcaacaggaccccgctggagtgaagaaggggactggagggtaaattaaaagaatagcagcttgtctgccctcatccccggtgtggggggagcagcctggcatggagtccaaatggacctcatatttcccaaagactcaaagcatctggggcctacctggaatgtcccaggaacacctactgcccggcccctcctctttcccctcaccaagcatgatgactgcaatgtctcataattatcacactctgcttttctccatctctgtggctttacatattctcagtgttcagctcttggtctgcaacatatctgcgtacaaacacgcacacacacacacacacacacacacacacacacacacacacacactgaggaatggctcccgggtcccagtagttcccactctctggtagaggagttgtgtttgtgagggctgtgatggggtgacaagcctgcagcagcctttccatgttcgtccaaactagatgtggtgcagagagcacaggcctgtggatcagcagatgtgacacttagcatgatggtactggttaggatcaagctaggcagtaacacacaacccaactgtagtgggtgcaacaagcaggtgcttatttttttgcagaagaaatcaggaggatggcaatctcactgctagtgcaggtgcttgaagctgccatcggggacccagatactttctggtgatagtgtatatggggggcgtctgctggagcttgggagatttggacccccattctggctctgttgctaactagttgtgcagcttcagacaaagcttctgaagctttgacttcatttctttatttgtttttaaaattgcaggctgagtatagtggctcctgcctgtaatcccagcactttgggaggctaaggtgggagcattgcatgaggccaggagttcgagaccagcctgggcaaaatggcaaaccctcatctgtacaaaaaaaaaaaaaaaatacaaaaaattagctaggcatggtggtacatgcctgtggacccagctactttggaaactaaggcaggaggatcacttgagccccgaagtttgaggctgcagtgagctgtgattgtgccacggcactccagcctgggtgacaaagtgaggccctatctcaaaaatgaataaataaaattgtggtaacaacatataacataaaaccatcttaaccatcttaaccatttttaagtgtacagtttagtggcattgagtacattcatactgttgtgcaatctgtcctcatgtctcttttctttccaaacggaaactctccctattaagcaagaactctctatttcctcctccccactggcaccaccattctgctttctgtctcaatacatttgactgctccaggtaactcatagaagagggatcatacagaatttgtccttttgtgtttgacttatttcactcatcataatgtcctcaagtttcatctgtgttgtagctaatgtcagaatttcccctctttttaaggttgaataatattccattgtatggacataccacattttgtttagccattcatctatggatggacacttggtttgctttcacattttagctattgtgaataatgctgccatgaacatgactgtgcagatatttccttgagactgtgttttcaattcttttgggtatctatctggatgtgggattattagatcctatggtaattctatttctaatttttttcaagaagcataatactgctttccatagaagctgcaccattttacatccccaccaacagtgcacagtttccaatttctccacgttcttgccaaaatttgttattttctgcttttttggtagcagctatcctaatggctttgagactcagtttctcgtctgtcccacagggacatagtagggctagattatctctagcttctgatgtctcatggtgccttccttcttgccatgaaagtaagtattgcttatgcacatatacatcttagtaaatttagttatatcttttcagcttggggccccaaggtagaaactattttaatatgaagacaggaaacaagaaatatgaaaagggattgaagaaggcattccaaggacaacttccaaaccctcctctctattccttccagaccatagatgcacataattctgggccacagagagtcctttggacagaacaatactttactgtttcttctcttcctctccttttcttttttgcttgtaattcacacacccaggtggctaggcgcagtggatcacacctgtaatcccagcaccttgggaggcagagatgggagggttgcttgaggccggaagttcagtctgggcaagacttggtctctaaaaataaattacctaggtatggtggtgcatacctgtagtcctagctattcaggaggctgaggcaaagaatcacttgagccccggagttcaaggctgcagtgagctatgatcacaccacagtgccccagcctggacaagagagcaagaccctgtctggctcaagcaacaacaaaggaaggaaggaagaaggaaggaaggaaggaaggaaggaaggaaggaaggatggatggaagggagggagggagggagggaggaaggaaggggaaaaagagagaggaagggagggagggagggaggaaagagagaaaaaggcaggcaggcagggcaagaaagagacaaagagaaagaaagaaagagagaaagaaagaagaaaaaagaaacacacacacccatctcccactctttatagtgtcatgatgtcatttaacataagtgcaaggaaaagttcaaggcgtttaattctagcttttacaaaacccagaagcatcttgagttaagtactattatcttcatttcctaacttttggcattcgctgactcattatttcatatgtggcttgggtgagaaaagcatctgggtggcaacctcctcccccagctacttctctggccaatggggactgttctgaacttcccatacactttctcgcagcttctgcctgaggctgaaaccctttctggggtgttttcccaactgtcatcaggatgggatgcagaaccaggtgccatgctctgtccaaaccctgcctggctccggccttctgcagtctcacttctcaccgctcactctcctgatatttacccagacccaccgtgtggcttctcattgcggtgctcatcaggccatccttctgcttgaactgtcctttctacccatcctcccacagctaactctgctcatgcttttagactcagcataaacatcctctcccccaggaagccttccctgatccaaacccccgagttgagctaaatgtccctgcttgggtctcccacaacacttatgctcaccccgtcttatcataaccaacattgcagttgaagtgtgtgaagcacacatttaactaatggaattccactaactcctcttggccagaaggagaaagagaataactttatttatttatttacttatttatttatttctgaggcatgttcttgctctgtctcccaggcaggagtgcagtgggcatcatccttctgccttttttttttttttaagtttttgtagagacaaggtctcactctgttgcccaggctggtctccaactcctgggctcaagtgaccctcccacctcaggcccccaagtagctgggattacagatgtgcatgccgtctccctattcacattttattttactttattttgttttttgagacgcagtcttgctctgttgctcaggctggagtgcagtgggctgatcttcgctcacttcaactctgcctcccaggttcaagagattctctcacctcagcctccttagtagctgggactacaggcacacaccaccgtgcttggttaattttttgtattttagcagagatggggtttcaccatgttggccaggctggtctgaaactcctgagctcaggcaatccgcccacctcggcctcccaaagtgttaggattacaggcgtgaaccaccgcgcccggcccctattcacattttaaatagaaccactcttggccccctgaccactcctctctgagggttagatgggagccctgagtgttaccttagtcctcaggtgttttaacattgggagcctctggcctctctgggagtgaatctggcgtttaaagatacatatatttggccgagcgcagtggctcacgcctgtaatcccagcactttgggaggccgagacgggcagatcacaaggtcaggagatcgagaccatcctggctaagacggtgaaaccgcatctctactaaaaatacaaaaaaaattagccaggcatggtggtgggcacctgcagtcccagctactcgggaggctgaggcaggagaatggcgtgaacccgggaggtggagcttgcagtgagtggagatcgcgccactgcactccagcctgggcgacagagcgaaactccgtcccaaaacaacaacaacaacaacaacaacaacaaacatatatttcgtggagcaagaaatgtctcaaacatagcaagagagttgggatgccaacggaccaaagggaaagcaagcatgacatagccccccactacaagggcttacctattatccaagctttgggagctaggttagaatcccagctctgtcgctaaccaacctgtgtactttagccaagtcactgtacctgtctagacttcggatcgcatgtgtgtctgcccatctcatagggttaccctgaggctaaatgaggtaacaaatgtcatgaacccacaaggtagactcgactctcggtaacagttcgtgtcacccccatctcacactactctccctcttcggaccctgcacccatggattccatccaccgctggccaggagctgagtagaggcaccgagcacgtgaagaggtgaatgggcaaggaaggcttccaggtcaggtagcatttccagtgttccagcctgcaggcatctaccgagcctggcccgaggctggcacccagagatgcttccagtcttccagcagcaacgcactgactgtaagaaaagcctgcttataaaccccctacaggcatttggaagctggtccctggggtcctctacagattcatttcgcccccaaacccatcccctttgtgccaccctcgttattgcactcttccatccggatggcatttagctgggtccgggtctgtcacccgtctgaccaccagctccttgagggcaagaggcgcctgctgccctcagggtccgcgcccagcccgcagctgctcagatccggagacgggaaggtttgttggcgagaacctgactcccgggtcacagttaaggatgcaagagcccggcgccttcccgtagccccggccctgtcattaattaatgctggggctccattcggtgcagcgcagtcccagggatgcaaccgcaacttttgcgcacaataggctctcgatctgtaatccagccaacccaggcctgtagtgtgtaaatgccaactcagcgggagggctctggctgtcgcccagagccgtttctcggctctttcgcggttgccggcgcgctcgggacaggaggaacccgcagcccgcgggagtcagcggagacccgaccagcactatccagccctctgcaccgcccccgcggcgaggtctggaccaagtcgcccctagcaacaacagccgggccggctttctcaggccatgctgattggcgggactccgggtggcggcctgtcgtcacttccggcagccggaggcagcagaggaagccgaggggcggccatcttggctccgtgaggctctgaggtgccggggtgcggcggcggcagcggcggccagcagggcggaggctgaggcagcaagctcgctagagagggagaagcagtcgggcgcaggcgcctcctccgcagcccgctccatggtcggcgcccacagcccgcggcggcctgtcttgcgctccacttccttcacatcctcctccgcctcctcgttttcaggcgccgccggcggcgctgtgtggaggcccgcgagctgaaattcgcggtgcgacgggagggagtggagaaggaggtgagggggcccaggatcgcggggcgccctgaggcaaggggacgccggcgggccgaagcgcagcccgccgcccgcaggctcggctccgccactgccgccctcccggtctcctcgcctcggccgccgaggcagggagagaatgagccccgggacccgccgggggacggcccgggccaggcccgggatctagacggccgtagggggaagggagccgccctccccacggcgccttttcggaactgccgtggactcgaggacgctggtcgccggcctcctagggctgtgctgttttgttttgaccctcgcattgtgcagaattaaagtgcagtaaaatgtccactaggaccccattgccaacggtgaatgaacgagacactgaaaacgtaagtaacctgggcgttgtagttggcggaccttcggggtggcattcgtgctcctcgggcagtgccttgcagtcgggtgttccccccagccgaacgctctggaaatagagggcaggccgtagtcacccaggaggcagccaggtcggaccgtttcctccagaagtctgccgtgtcccgctgttcgcgggcgggtctgcgaagtacatcgattatgccggcagtctagtcggttaataaagcccaggagttgcagcgttacggatcggtgctttgagaggccaggttgccgcgcaatggattgtgcaaacgtgtgtgtcagatcactgcagtggtcagtgcttattttagccgaactctgcttttaacttggtcaggcagttcttgagagactgtcacattaataacatatgttaccggtgctgattaagagtaatcgattgggtcaagtgggcggtctcgttctttaagatggtctggaactaaatttaatcacagtcactaagtgtccactgagggatctttgcggtccccttaggaattccaaaacactagcgcgcagcctttattaaggcagtttcctttccatacaaatcttttttgaaggagttggttaaacattttgaaaagcagatgtatagtgaagctctgctctgccactcactgcctagctgagggacacccgctgggggcttcgctgtcctccttcctaaaaagagattggcttagatgagctcttaggtccctttcagcgctcacaggctatggttttataaaaggaacctttgattttgttcatgtgaaactacaaaatgccaggaacagcattgctagagaatgagaacttgtagtagaaattccattgaagaaacgtttgactctgttcgttttctaactctgttctcctctaacactgggttcaaaagtgtttcaatctagttgttgactatattctgtaaaacatctagtaaataatttgtaaagaaacttcactggcctttcattaaaagtgttatgaggtaattgctggcacgaaatgtcttctcttagggaatgcttccttgctttgagtgttttcatgctttcagtaatgtcctgagatgttgtggcctagtggagttaatgctttcattttgatcttcaaaaatgccgcttgtttgctggatagctgtttgataatttaatccgtaaacgtaaaccatagcctaaagcatccctgtagcatattagtatacaatatttaatgctctgtggccctgagtaagtagaacagtgatgtacctttctccacctgagatagattagaaaattatataaagagtgagtaatagaaactcttagactaggtgagtcagggaactaatttccttatagtccttttaaagaaaccttatttatttgtttatttatttatttatttacttatttattttttgagacagaccgagactgtctcccaggctggagtgcagtggtgcgatcttggctcactgcagcctccacctcccaggctgaagtgattatcatgcctcagcctcccgagtagctgggattactggcgtgcaccaccacgcccggctaatttttgtatttttagtagagacagggtttcaccatgttggccaggctggtctagaactcctggcctcatgtgatccacccgcctcggctccccaaagtgctgagattacaggcatgagccagtgtgcccaactgattagttttgatcattgatcttcactcagagaagcaaaaccttacattgaaccagagtaggagctccatgctttctaaactgaagccaaaaacagtcatagcagatttgtgataatgaaggatttcaaatgggtcttttttctttctttcttttttgagatggagtctggctctgtctcccaggctggagtgccgtggcatgatctcggctcactgcaacctccgcctcccgggttcaagtgattctcctgcctcagcctcctgagtagccaggattacaggcatgtgccaccactcccggctaattttgtatttttagtagagacggggtttctccatgttggtcgtgctggtctcaaactcccgacttcaggtgatcctcccgcgtcagcctcccaaagtgctgggattacaggcgtgagccaccacgcccagccatgtagtgtatttaaaatgaatttttgactttttttaaaaatcaagtttatcacacatcgttgcattaatttaccatgccctgttacatttttaactcttgcattggcatgttctggaaggagctgtgtagctttcacagtgtggagcccttgtgtcagtgttataactcaggtatagtccatattaattacctacattactgcactgctaagtattagacttcctgccaattgagtggtgaatgtacaagaatgaatgggagctctcattctgttgagaaccttttttcttaaagttaggtttgttgagatgtaatgttcatctgttttaagtatacagtttggtgaattttgacaagcgtatagttatgtaaccgctatcacaatcaagatgtagaacacttccattgccagaaaggtcccttatggccctgtatagtcagtgccctctccctttcttagcccctgggtaaccactgatctgctttctgtccctgtagttttgccttttctaggatgctatgtaaatggagtcacagtgtaaataatcttttgtgtcttctttcacttagagtagtgcttttgagatttatttgaatgtgtatcagtatcagtagttcattcctttttattgctgagtaagtatttccttgtttggatgtgccacaattttttttaatccactcaccagtgatggacatttttggctattgtgactagaacagttttcttttagtattctgtaaaaatactttttattgtgcttaccccaggaatcttatttaaattttaagtaattgtatataactgtgataagaatgtcgcttattagatcaagactaagaaaaggcaggccgggtgtggtggctcatacctgtaatcccagcactttgagaggctgaggctggcggatcacgaggtcaggagatcgagaccatcctggctaacatggtgaaaccctgtctctactaaaaatacgaaaaattagccgggcgtggtggcaggcacctgtagtcctagctactcgggaggctgaggcaggagaatggcatgaacctgggaggcagagcttgcagtgagccgagattgggccaccacattccagcctgggcgacagagccagactccatctcaaaaaaaaaaaaaaattagccaggtgcggtggtgcatgcctgtaattccagctactcaggaggctgacgtgggagaatcacttgaacacaagaggtgaaggttgcagtgagccgatatcatgccactgcactgcagcctgagtgacagagtaagactctgtctccaaaaaaaaaaaaaaaaaaaagcagacaacttgcaacattatcttcatccttgtacactaatttgtttttgtttgtttgatttccaaatattaatgtccacccttagtgaatgggtatataaaagtttactgttggccaggtgcagtggctcacgcctgtaatcccagcactttgggaggccggggcaggtggatcacctgaggtcaggagttcgagaccagcctgaccaagatggcaaaaccctgtctctactaaaaatacaaaaattagccgggtgcggtggcgggcacctgtaatcccagctacttgggaggctgaggctggagaatcgcttgaaccctggagacggagagtgcagtgagctgagatcaagccattgccctccagcctgggcgacagagggatactccgtctcaaaaaaaaaaaaaaaaaaaaaaaggccgggcgcggtggctcacacctgtaatcccagcactctgggaggccgaggcgggcagatcacgaggtcaggagatcgagaccatcctggctaacacggtgaaaccctgtgtctaccaaaaatataaaaaattagccgggcgtggtggcaggtgcctgtagtcccagctactcgggaggctgaggcaggagaatggcgtgatcccgggaggcggagcttgcagtgagccaagatggcgccactgcactccagcctgggcgacagagtgagactccatctcaaaaaaaaagttcactgttgctgcatcgtgttatagctcaaaagaactactcaatctgatccagtgaggttgctgagactcagagaggtgacaaaggctgctagtaatgacagaagaccactaactatttagtagcaaagcctctactgggccccagatctctagcttaggctccacaaggagatgtagttgtacctgtacatagagtatttctaaaacttttttttaagcttgtagatcaggggtgtccaatcttttggcttccccgggccacattggaagaattgtcttgggccacagataaaatacactaacactaacaatagctgataagctttaaaaaaactgcaaaaaaaatctcacagtgttttaacaaagtttatgaatttgtgttgggtcactttcaaagctgtggtgggctgcatgcagccctagggctgtgggttggacaagcttgctgtagattttattttgattttgagacagtatctcgctctgtcacccaggctggagtgcagtggagcaatcacagcttgctgtaaccttgacctcttgggctcaagcaatccttccgactcagcctcctgagtagctgggactacaggcgtgccccaccacatgcatggctaatttttaattttttcgtagagatgagatctccctgtattgcccaaggtggtctctaactcctgggctcaagcaggcctcctgtcccagcctcccaaagcactggaattacaggtgtgagccaccacactcagtcaaaactattttttaaaatattttattataggaaaatttaaaaaaatagaatgttatttatcaatgcttctcagccacagggtgattttgccctctagtggacatttgacaatgtctaaagacatctttggttatcacagctggagaaaggtttggctgaccaggaatgctactaaacattttacagtacgtaggacagccttccacagcaaagaattacccggcctaaaatgtcagtagtgccagcgttgagaaaccctggtatgtacttagccccccatgtactcaacagcgcagctcagtggccaatcttatttcatttataaatgaagaagcaaatgcagtatcatttcctctctaaagcttttagaagagataaagcctgttttaagaaaaaagcaatacttttatcatattttcttaatatcaaatatgcagtatttaaattttctcacatttctaatttttaaactgttcaaattagaatccagcttgaattcatacattatagttggctgatatgtcaaatatgctttttttttttttttaattgagatggagtcttgctctgtcgcccaggttggagtgcagtggtgcaatctcggctcactgccaacctctgccgcccgggttcaagcgattgtcgtgcgcagcctcccgagtagctgggattacaggctcccgccaccatgcctggctattttttttttttttttttttttttttttagtagagatggggtttcgccatgttggccaggctgttctcaaactcctgacctcaggtgatccgcccgccttggcctcccaaagtgctgggattacaggcgtgagccactgtacctggtcaaaatatgctttttaaaggcaaccaaacagtttgcatttcagtttatgttctatagttatatggagccacggatacatcctttttctatactggcaaaatgagaaacatatttttcacctgaatttcaaaggatatgacacttcgtaagcctggtaatgttattggccaaagtaccagaggcccagggctttcccagttatttaacagttactgatatgtgtgcatcatgtacttattattagttaatgcaaatagtcccccaaatttctgacctctgtgaaactgatgatgctgttgtctagtcagtcatcggttatgtgagactgaattaacctattcagcaagtgtgaatgcctaccgtgtgtatgatactgtgctaggtgctgtagaggccatatacctgggacacatagctttcctgctctttaggatttcctgctccttgcaggacaaagcagcctgagctttatgaaactagtctgtaactctcaaacttaagcaaacattagaatcacctgaagggctttagaaccgtgatcactgggccctacccctagaccttgattttacccgtagaattggaatttctaacaagttgccaggtgatgttgatgctccaggtccggggaccactcttaagaatcactatagcaggaatttctgatgtttatttattaagaaaaaaaaatcactgccttagtgtgcagtgaaggcttgctaactaaactatactccttttagattgtactgtgactatcaaaggaagatttccagaccatttaattgagttttcaggttccatgagtttaaaaaaaactgtttattaaaaattgtggttctggaaaataacaatagttgccatttggtgatcacttaactgtataccagccagcaatactttgtagagtatctcatttaaaatatgtaatatggttttatttaattagctttttttttttttaaatttcctgaggcggagtctcacactgttacctgggctggagtgcagtggcacgatctcgctcgctgcaacctccgcctcccgggttcaagcgattctcctgcctcagcctcccaggtagctaggattacaggcagccgccaccacacccagctaatttttaaattttattttattttttgagacagagtttcactcttgttgcccgggctggagtgcagtggcatgatcttggctcactgcaacctccgcctcctggcttcaagcaattctgcctcagcctcccgagtagctgggattacaggtgcctgttaccatgcccagctgatttttttgtattttcggtagagactgggtttcaccatgttggcaggctgatctggaactcctgacctcatgatcctcccacttccctcctcggcctcccaaagtgctggaattacaggcgtgagccactgtgccccggcttaatcagcttgtcaacttctaagcacaacctgttgaatcaagctgtttgggccttatcagaaaaaagttggcctatagtttcagctactcaggaggctaaggccagaggatcacttgaggccaggagttccagtcgacctggacaacatggtgaaactatgtatcttaagaaagaaaaaaaaaagttgatctctgaagaattcatgaaaatatttagtcagttttcagggaaagatcttatagacttcaatttgagcatccttatcttatgtatgtaaatgaggtaaaggttgaaatttgcagtaaatagaattttggtcatttaagttatgtagctcatgatatatacattgtataactatttagacttacatggtgcatgatttacattgtaattacatagaggcttatacagtctaataaaaattaatattaactatttgattgcaaagaggattgttctgcattttattactttttttttttttttgagacagagtttcactcttgttgccaggctggagtgcaatctcgtgaccttggctcactgcaacctccgcctgccagcctaagtagctggggttacaggcacacaccaccatgcccagctaattttttgtatttttagtagggatggggtttcaccatgttagccaggctggtctcaaactcctcaccttgggttatccgcctgccttggcctcccaaagtgctgggattacaggcttgagccactgcgctcggcctgcattttattattctaagatatagccaaattttatgcctggaattttttcctgggctggaacaaattcctagtaagagtcagggaatattccgtgacttgtggctttggttaaaaaagaaaaaggagtcagggaatgcagtaccctctgatcaccactgggaggactaaagcagaaaattcatttgtctcatatccattttcaaatttcaaattaaacatgaaggagaaaataaatctcttacctgggaagctttaatgtcctgtctcacacaagaagttaaaggttgtgcttggagttggtctgcaaaagtaataaggaatttgtactcacccgtctgcacctgcttgtacagaacaattggaagggcagaagttggctttgaaagaaaaggcctttttttggaggtgggaggggcatccaattttgtcttcagccgagagttcgctagcactacactctagccactcaagctgctcaactatggttggtcttgtgtacttctgtgtgcactagataagacattgtttctgtgggttatgtgggaccttgaagttcagtgttgaagctcaaacaaagcaggtgttttttctgtatttcttgttgacaggcatttgctttttgttggacctaaatattgtggggtttgtgtatggacatttgacacaaaaatctgtattggtagaatttaatataaaatcagagaagttgaattcacaggttttgttcatagaattttacataactctagtcttttttctttttttgtgatggagtcttgctctgttgcccaggctggagtgcagtggcatgatcttggctcactgcaacctctgcctcctgggttcaagtgattgtcctgcctcagcctcccgagtagctgggattacaggcacccgccaccacgcctggctaatttttgtatttttagtagaaacggggtttcaccatggccaggctggtcttgaactcctgacctcaagtgatccacctgcctcggcctcccaaagtgctaggattataggcatgagccacagcgcctggccacaatcttacactactttcctgaagggatgtgtgatggaaagagtctgggcttgaaagtggaagacaaaaatgagagtctaagactgatcgagataaagattctgaagaggtagaatggacctcataagatggagcaaaaaagaaggaacaacatataaaaggagaaattagaatttagagttatagactggaatttgaaactagtcttgagatttaactgtggacaaattcactcggctgtgcctcatggtttttttttttttaaatcaaaagagaataacatcattcaagttgtgtcttggtttttttgtttgtttacttagatttttatgacttcactttctcaatttcctctgtggccagattcatcaggcattcagtcactttcatctctgtcaggctggccttgtgttctgtctgtctgttctgctgcatagttgtcatcctgagatctcccttcacccatatcctagggattccctttgcctttcctgttcgatccattttcttccccttggttcactcccaggtttcattgcagcagttcctccagtgattttctgagaaagttgctcagaggtaaatttttaaaatcctttcatatctgcaaacatctttattctgttctcatacttgattgatattttggctgcatatagaattctagactgaatgccctttttcctcagaattttgttttctgtcttatatagcatctgacactccgatttggagagagagaatgctattttgagtcttgcttatttttctgtttgtttaaggctgattggaagttttgtgcatttggatggatcttgaatacaacagtgggacacactgttatttctttgtggtgctcttgataccaatatatttagtcttatcacttggcctaggcaagcacggaatgcccatgttccagggagctgagtcgggagagggcagaaggaaagatctgtggctttctgctttctctgcttgttttcagtgtccctgccctcagttgtgccctgtgtccccaagcccagagactttccattttgccctttctaaagaacctccagttttttgcctgagtgggagaggagacccgggggtctgttatttaacagactgatagatcttcttgtttcaggcttacttcactcacacttctagaggtacttgtactaccagttcctgaaccttttgagagttctataatacaaatcaggattttccaatatctccatagctggcttaggattaatctttcttatatgtgttaagtcattttccttctttttttagtttctgaaagtatatctgttaccacttttattttctttgtcttgtggcttttttccttatgccttatatttttttcctttactttcatattaatggagtttggagagggaggggaagtaaatgcagccatgatttataaccagacttggattaggtgtttacatatgtcaatacatgtctttaaaatttagctagtacttgttattataaataacaaactaagattgataggcttcttgaaaaattggcggtaaatttggctaatggtgggttgttgtagtagagtagcgtttccccttttcacccaagctttgttacctcttcttgggtggtgcctggcctgagatgtccttcatctctcataagaactctcctacttgccctttgaggactccatcccttcacatcttggggtaccttttttccttcatctcacccaaatgtgatcatgtcctttgggtgcctagagctgcattatccagcacagtagcaactagccacatgtggggctaccaagcacttgaaacgtggttagtttgaatttaggtgttctgtaagtataaaagataaaccagttcaaagacagtatttcaaaaataggatataaagcctttttatattatgcattgaaatattggggggtatattgagttaaataaaatggtatttaatttaacgtattaaatatgtttctttttacattttttaatggagctactagaaaattgaaaattacatatgtatgtcacattatacacctattggacagcattagagtattcactctgattttctcttggggcaggaattgccccttgtttcagttgctattcccccgttagcaccccgtgtatatcatgagtgccttgaaggtttgacaccacacttttctgtttcttttattccctgctaatgcctaccatatagttgactagccgaaagttactgaataaacattttttttttttttttttgagatgaagtctcactctgtcacccagactggagtgcagtggtgcgatctcggctcaccgcaacctccgcctcccaggttcaaacgattctcctgcctcagccttctgagtagctgggactacaggcacccgccaccatgcctggctaatttttttatttttagtagagatggggtttcaccatattggccaggctggtctcgaactcctgaccttgtgatcctcctgcctcagcctcctaaagtgctgggattacaggcgtgagctaccgcacctggcctgaatcaagatttttttagccacaacttgtgccttacaagttttttattctaaggattagacaagtaaattatttttcaccgtattacattagttcacctactataccagtaacaattattttattcaaaagtgaaacagattttactatatttatgggacaataacagttcccccttcctattcatattcttagatgctttctcataaattcagctgtgaagagtcacattatctttgatccatgtgagactatcttcttgttttatctactcctgttagtctccatatgtcattactcttaccctccaccccacgttactgttttaatgtgtttagtatgtgtatgtgttcttacatagtttattttggtatgtttggtactttatgtaaatattacatatgtcttatctgtgcgcttaatatattgcatctaactgctgaatagcagtgagatgtatgcatctaccacattttaccagtctgctcgccagaggtgcacatgttaattttctccaactctgtcaccacaaaaaaaatgcttcaacatcttcatgcatgtccccttatggagcaatgtaagagtttctttgggatatatagcttggaatggacttgatgggtcacaggaaatgtcagattgttcttctagatggctgcttccatcaatagtgcaccacagtttttgtattcccgtttctctgccaacatttcagagctttctgccttttccctatctaacaggcctaaggtgatactacattgtggttttaacttgtatttctctctgatttttagaatctctttatacattccttggctttgggtgcattcttgttttttgcgggggttggtgatttttatcaaatcaaggacagacatcccattctaatcctagtttgctataggaattttgtgggggctttttggtagagacagggtcttgctatgtttgcccaggcgggtctcaaacttccgggtttaagcaagcctcttgcctcagcctctgaaggtgctgggattacaagcatgagtcaccatgcctggccaagagtttttaaattataaattgttcaatcttatcaaatcctttttctatgttgaatgaaataattgcctagctgctttcaaaagtgaaacgtgactttgtgaatatttctaaagtacaaaatacttggaggacagccatttattgtcacaacttggctttgtagtttgtttttgtttttgttttttaacatttggaaaccatacctatgtgttaagtaagtggcttgtgatttaaggaatagaatgcatgtaagggcacacttcttttgttttacagaagggatcaagttctgttcaggaagatttgaaacatagtgtaaagttgttgctgttttaaacttgtaaacctgattcttctcatgtgggaggtacgtaagtaggcctctcagatttcaggttggttctctgcctggtagatacaagggcaaaactattctggaaccatattgatgttaaaaaaattttttacggacttcctgccggcaaggatttttttaaaagattttttaaatgtgtctaagaaatgttttaatttgtcttctgattatacagtgatttacaattcatgcttcttttatatgtgggcaaaattaagaactaatatgtaaaacaaaatggagcacattcccatttttcttattgctttgagttgatatggcccctatgtcagtagtgctttggctgaacgtcacaaagacctaacacagtgccctaaacaaatagggggtttgtttttctccaaaaagaaatttggggtagggtgcggtggctcacacctgtaatcccagcactttgggaggccaaggcgggtggatcacgaggtcaggagatcgagaccacggtgaaacctcgtctctactaaaaatacgaaaaaaattagccgggcacggtggcgggtacctgtagtcccagctactcgggaggctgaggccagagaatggcgtgaacccgggaggcggagcttgcagtgaatcgagatggcgccactgcactccagcctggggcaacagagtgagactccatctcaaaaaaaaaaaaagaaaaaaaaaaaaaagaaaggaatttggaggtatgcagcgtctagctttggatcagcagttcagtaatattggagttggtggtattttaaggtagttttgtcttttctgtcatgtttgagaccctgtagctacaggataatgttttacagttacagctacatggttgcattcaaggaaggaggaaggaactgtactggcaactctgtccttacccccccaccctccttttttttttttgagatgaagtttctgtcactcaggctggagtgcagtggcggaatctcagctcactgcaactgtcgcctcccttgttcaagcgattctcatgcctcagtcttctgagtagctgggattacaggcatgtgccaccatgcctggctaatttttgtacttttagtagagatggggtttcaccatgttggccaggcaggtctcaaactcctgacctcaggtgatctgctagccttggcctcccaaagtgctgggattacaggtgtgagccacagtgcccggcctccccttttatgataaacaaaggcattaccaacccctaccccctactacattgccacctagtagactttaactaatgagaactggccagaactaagccagatggctatctctagctgcagagaagtttgggaaaacaagtatttggccaatgtggtctccctaaacacgtgttcaacttcttgaagaaggaaatctcatgtctttggctgtattcagcatttttcagtagcagttacatattctagttttcatggtggatgaagtggtaccagcttagttccacaggagggagaagaatcaggactcatttaatccataagaattaaactcagcagcttttgagtacccattatgtgcatagtctgccatgaaatattataaagtagtccaggtatggtggcttacacctgtaatatcagcactttgggagaataagacaggaggattgcttgaggccagagtttgagatcagcctgggcaacatagtgagatcctatctctacaaaaaattaaaacatcagccatgtgtggtgtacgcacctgtagtaccagctactaaggaggctgaggtgggatgatcccttgagtccaggagttcgaggctgcagtgaggtatgatcgatcacactactgtactccagcctgggcaacagaacgagaccctgtctcaaaaaaaaaaaaaaaaaaaagttatcaaagaattatataacattttgtgtgtgtgtgtgtgtgtgtgtgtgtgtgtgtgtgtgtatgcaggttgtttattggctccttaggaagaaaaaaatacgtgtatgaaataattgattaacagtacaagaactcataattatttgtttaaatgtttaatgttggtactgagtgctgtggcataggaatagggaactttttcttagggtcggtgatggattcttgggaaaataaaatgaagggcaaatggaagcaaaagacaatttaatttgcttctgttttaagggaacttttaaaaagttaattcttaaattttttaatttaaggacttcgtcaagaaacatcgaattaaatatattgagtttaaccctaacaagcatcagatctttcagtctgctgtatgaggaaatacaagtttctttctgctttctattatgattgttgatttgcatgagcgtgttttaggttaggctgtgttatgctgtggtaatacataccaccaacatcctcatgatttaacacaataaaaaacttctgctcacaccaagtctgcttgagggctcattggctccgtggaaactgatctccatgtccaggccagtttggtcttgtggccgtccgttttagggcagtgcttagggtcaggagagcaaaacacagggctggagagttaagcacaggcaactaaatgcttcagcatgggaatggcattcattttcactcacaggatgtgttcagcttagtcacatggctgtctatgcctaacctcaagggaagggagtgcagtcctccaggaactcagatgtaaaaaagccagtatgatggatatagtattgtctacaaaaaaaagtagcataatagagttagatacaagcaaagtactctaggatcccagtaaggagaagtaagaaattctgatgagatgcagggagagccttagaagggttcatgaagatggtgacagatgatacaaactcagtagaatgagcaggtttttcttagatttgaagagaagaaaggacattcaaactaagggaacaacactgactgagtcagagctagactcaaagctagagtctactggctgatgtcgtgggagaggaagaagagatgagcgggccttgaattcgtttaacattcagcaaaaatgtattgcatgtctaccatgtgttaggcactgtttcaggtttggggaatatctgataatgaacaaaacacaaaaagcctgtccttgtgaaggttacatgctagtggaagaagcgctaaggagttagtattttattataagcacactggtgagtaagcaaagataggaacattggatgcctgtgaatcttaagattttcctggccgagcgcggtggctcatgcctgtaatcccagcactttgggaggctgaggtgggtagatcacttaaggtcaggagttcgagactagcctggccaacatagtgaaaccctgtctctactaaaaatacaaaaattagccgggtatggtggcgcgcacctgagtcccagctactcatgaggctgaggcaggagaattgcttcaacctgggaggcggaggttgcagtgagctgagattgcgccactgcactccagctgacagagtgagactccatctcaaaaaaaaaaaggatttttctaagatttctattttacattaaatagaaggcagttggtttgcatgaaaattattatttcatcaatttgactgcctcattatagaaaacacatattgaagtcaaataaaacgtagagatgaatctctgaagttaaaatatgttatttgggacgcaagaattgcaatttggggcacacagaccacagggtggtcttcagtatgtatgaagaacaaagtaaaggatggaggttttataaagagaagtgttacatattttgaaagacaggtcattggcactagtaaagttttggggaggtggcaagccctgattggtgagtgacagtggtgggtaatactggtcttagagtcagcaacaagttgtttcagtagccattagataaactggtttcaggttacaataggcagtttcagcagccaggcttacagagaattataatcttggagcaatgttacatccctccccctcccctggccccccaccccatccctgcccctcagctctgatttagttgagtacgaataggatgacccaattagtatgatcagctttcacacatgaaggttgaatttatgaaacatgtaaatttgaaaatacatgtttacattgcaaaaagcttttttaacaaaaattttggccagtagtataaattcagtgaatatgttttcattgcacagatagtaaaaccacttgatacatacctcatggggatatggactgctttatgcgctgctttttaccacaccttaaatagtgcctggttgtgtgtgtgtgtgtgtgtgtgtgtgtgtgtgtgtgtgtgtgtgtgtaactcagtaaatattcaatgaatgaatgaagaaattcagaagataaaaaagagaaatttcccttatttttaaccttctgaacactatagtggttagcatttatatcatttattcagccattctaatatttattgagtagcagttttgtaccaactgctgttctaagatataaggaataataaattcctgttactgttttcatgaaacttaaattctagtgtaattaaaatcatgtagaaataaacataaacatgatcacccagcttcttttaaaactagactgcagttgatgtaataatttgcattacaacagcatgcatcttgtgcacaacaaaatctacctgtttttgtattaaagccttagtgtcaaagctttattatcattttagtcttttatcaactccatatttataaatggtctattttcccaaagttctaatatggaaatcagaatcatttttgttagaggaacaatgtttacaagttgcctagatttgcagtgaggtcataaaaagcctgtttaatctaaaatagacatttgcaataaaaacagaaattgttgttgagatgccatattatgtgataactgagtaaaacagacaagagcctatcccctaacctggtatgtgaatgtgaaaatattagagaaataatgaagaagtagatggagactaatgaggaaattctgaaaaggacatcttttgagaaattcagaggtagatggcgcaagttttaaagcttactttcactttaaaacacctgagtttcatttcctttgatttgagtaaattacaaagcagtttattagttaaatcaggcttgttttgatttataggtatatagagaaagacaggacattttcctggacagaaagttggaaaagagaaacgtgtaaagggggtggaaagtggctgtgagtgcatgtggaatgagaagcctcccttgggcaggagttaacagccacaatggggaaaggattgggacatctaatcctttgagtgtgtgtgggggccaagggagcagtagtagcaggatgcctgcgcatacagccatgtacacagtgtgtacacagaagtgtaattcttgggcctgaatatttcatagggtagagacatattgagtactttattaagtaagcatattgagtactttattcatctatacaacaagggtcgtctattaagggccacacagtctagctgtttctgtaaagcacattgttttgaattactgttagcagtgtagtatagaaggaaatcgggaatccagattctctatggatttccccctgaacagttatgtggctgtatccttatctagtgaatggtgacattagcttttcccctgctgcacgggctgtagtgaggctcaggtgtgcaggtgcacttactaacatatggaaaagttaagcactgtataaccagaaggtagcccttttactcctattttatatgacagccacgtatgcaaaatatctaatttcttcctgaacactcaattgaacttcaacacttcgtatttttcgtctcagaatttttattttcctcaaatttatattatgtggttaaattcctttgaagtgctagatactttaagattaaaattaaagtaggaatgttttttcttcaattagaagctcttagaacttggcaagtactctgtgttctctcatttccttatctttgtgtatgctgtattgcagcacacgtcacatggagatgggcgtcaagaagttacctctcgtaccagccgctcaggagctcggtgtagaaactctatagcctcctgtgcagatgaacaacctcacatcggaaactacagactgttgaaaacaatcggcaaggggaattttgcaaaagtaaaattggcaagacatatccttacaggcagagaggtaaataccagttatgcttatttctgttatgacagttgctctgtttatttccatgtaagagaaagaaaagaatatagatataggccttatttcttttttttaagatggagtctcgctctgtcacccaggctggagtgcagtggcatgatctcagctcactgcaaactctgcctcccgggttcacaccattctcctgcctcagcctcccgagtagctggcagtacaggtgcccgccaccacacccagctaattttttgtagagacagggtttcaccgtgttagccaggatggtctcgatctcctgaccttgtgatccgcccgtctcggcctcccaaagtgctgggattacaggcgtgagccatagcgcctgtaatatatagctactatgtattacatgtattacatgtcaagttctaaccacataatataaatttgtaatacatagctgggattacaggcgcacaccaccacaccacgctaatttttttttttttttgtatttttgtatttttgtagagacggggtttcaccatgttggtcaggctggtctcgaactcctgacctcgtgatccacctgccttggcctcccaaagtgctgggattacaggcatgagccaccgtgcccaacctattttattttcaagacagggccttgccctgtcacccgagctggagtgcagtggctcaatcatggctcactatagcctcaacctcctggggtcaggcagttctcccacctcagcctctcgagtagctgagactacaggcatgcactgccacacccggctaatgtttaaaaaatttttttgtagagacagggttctcaccgtgttgcccaggctggtcttgaactcctgtgttcaagcagtcctcctgcctcaacctcccagagtgttgggattacaggcatgagccaccatgcctcactaattaagctttttcttttttggggggttaggggggtgtcgggggttgggacggagtcttgccctgtagcccaggcctggagtgaagtggcatggtctcggctctctgcaacctccgcctcccaggttcaagcgtttctcttgcctcagcctcctgagtagctgagattacaggcgcacaccaccacgcctggctaattattttttttttttttgtatttttagtagaggtggggtttcaccatgttagtcaggctggtttcaaactcctgacctcaggtgatctgcccgcctcagcctcccaaagtgctgggattataggcatgagccaccacgcccagcctaattaagctttctcaaaagaacatgaaacatatattaggtgtctgggagttttttgttttgtttttgtttttgttttttttctgaggcagagtctcactctgtcacccaggctggagtgcagtggtgcaatctcggctcactgcaagctccgccttctgggttcaagccattctcctgcctcagcctcctgagtagctgggattataggcatgagccaccacgcccagcctaattaagctttctcaaaagaacatgaaacatatattaggtgtttgggagttttttgttttgtttttgtttttgttttttttatgaggcagagtctcactctgtcacccaggctggagtgcagtggtgcaatctcggctcactgcaagctccgccttctgggttcacgccattctcctgcctcagcctcccgagtagctgggactacaggcatccaccactgcacccggctaattttttgtatttttagtagagacggggtttcactgtgttagccaggatggtctcgatctcatctcgtgatccgcctgcctcagcctcccacagtgctgggattacaggcgtgagccaccacgcctggcccatctgggagttcttttgctttcccattactttaaacgttggaaatatcatagagtgtttaaatagtctttacctttaaaaataggtaatgttttgttctttttcagtagcaaatgtctgctaccacagtaaaaattgtctttaacttcaggtatacacttatgtgtatgagctcatgttacttgctaatcaatattattgtcaatatttacagatttatcttcaagaagtttcttaatctctctacttttctcatagcgtatgtttaatcggttattgtgtaggaaggcacatactttcctaacctttgtgaaatggctttctgctcagccccgttcctattaatcaaaaatacatgcattaaaaccacaaaactaactccctcctcttgttatactcatatggtacagagcctgttttgcctctttttttttttttttttttttttttgagacggagtctagctctgtcgccaggctggagtgcagtggtgtgatctcagctccctgtaacctccgcctcctgggttcaagcaattctcctgcctcagcctcctgagtagctgggactataggcgtgcgccaccatgcccggctaatttttgtatttttagtagagatggggtttcaccatgttggccaggatggtctcaatctcttgacctggtgatctgcccgcctcaacctcccaaaatgctgggattgcaggtgtaagccagcgtgcccaacctttgatgtagtttcttgcatttaggtctttgcgcctgcttttccctgtacctgaaatactctttactcttctgtttagggaacatttctgagaagtaatcattgacaaatcccctttccccaggcatgggattccataaaaatcccgatactccccttatatggcacaatttacattgtattggaattgctcgtttgtctgtctccttctctagtttgtaggctgtctccagtctgtaggggaagatgacagaacttaacacagtgcttggaacctgttaggtacttaataaatatttgctaaatgaatgcaataatactgttttttggcgggggggaggtggtgttggcaacagagtctcactgttgcccaggctggagtgcagtggcgtgatctcagctcactgcaacctcccgcctcctgggttcaagcgattctcctgccttagcctcccgagtagctgggattacaggcacacgccaccgcacccagcgaattttttgtatttttagtagagagggggtttcaccatgttggccaggctggtctcgaactcctgatgtcaggtgatccacccacctcagcctcccagagtgctgggattacaggcgtgagccaccatgcctggcctgaatgtagtaatacttttgaaggaagcttttaaaacaaatgctctccctgtgcgagacccttctgatagatgtgccaagactgtgacacatatggcgtagcattcatgcctgcagcccaccaggcctggggctgcaagagcatgagccctgggtctgtcatctgtcagcatgcatcctctgtttgcagcaatgtgccctgtaaatattttcatttcctgtgtgtgcggagacttggaaaaggttgggaagcactggactgtgctaactggaattttaaaagactgttgccagaaatttgccttttgacaattcattaattttagtgataaaattcttgtggatttttagttaagactccttgttgctgagctgccttatagactgcttttggaatctgtaaacagcttgtgtgggcggagctgtccttgttgtccttgattaaagctttcttgagataaggaacggtgagacctctgagtttcttagttcccaccagttccaggtggctacttgccagcttcctcatgtgggcagagatggtgggccaagagagcgttgagacagacgaacctcttccatttaccttacctgatttacattatctagagtctggcctgtggtgtttacttctagtaggttctttctctagaaatgcttgaatatgactagcagagtggtttaatttaaaaactttctcagtttctcagtttttttaaaactttgaacaagttctcactcgtaagtggagttgaacaatgagaacacatggacacagggaggggaacatcacacaccagggcctgtcggggtgaggggcaaggggagggatagcattaggagaaacacctaatgtagctgatgggtcgatgggcgcagcaaaccaccatggcacatgtatacctgtttaacctgcacgttctgcacatgtatcccagaacttaaagtaaaaaaaaaaaaaaaaaaaaaaaaaaaaaaggaaaaactttgaacaaaatcattttactcttgtggggttttttttgcctattgtagatatgacatataaaatgtaaacattatagaaatatagaaattcattatgtagaaagtaagttccttgaaatttgtctcttcaaagacaatcactttcagcagtttggtgtatattcccagagttttttatatagacattaacttttaaaaaattttaacagaaagggactcatggaacatgatgacagtttttttacttagtaatgtaccttgaccatgtctgggtcttagtactcatagatctgacatattagtctaaaggcagcatagtcttcctggctatggtggtaccatagtttatttcctatcagtgggcattagggttgtttctaaatttttgttgttacaaacagatctgcagtggacattctttagcattgcgtgtccttgttaagtgtttctgtaggataattcctagaaatggaagtcctgggtgaaagtggatgactatttgacattgtaatagatactactaaattggttttgaataaaaagtgatgtacctactttattattctaccaaaatggaatagagtgttcattttcgtacatgcttctacactgtagataatttttgtctatctgaaggtctcaatctgtttttgctgctgtaacacaataccagggactaggtaatttataaagataagaaatttatttcttacaattgtggaggctgggaagtccaagatccaggggctgcatctggccagggccttcttgatacatgaagggcgtgatggaagggcaaagagtggggaaggaagggaagaggaggagaaaggaagaaaagagggcagagcccttgcaatctgattgcctctccagggccccatgccttagtactgctgcaacagcaattacgtttcaccatgagtttgggaggggacattcattcaaaccatagcacgtatggacaaaaaaagggtgtagagaaaaccagaagttgctttttcccttttcactacttagatttatgatctttttatatatttttgtcattcataatttctttttgaggcaagttccctggccacccgcagtagctcatgcctgtattcatagtgctttgggaggccaaggcaaggaggatcacttgagcccaggagtacaagactgcattgtgctatgattgtaccgctgtactccagccggggcaacagaggacactctctaaaataaataaaaataaaacaagtttcctgtttatatcctttattcatttttctttttttttaatcttagtgatttaaaccctttatgtttcagtcatctgtctgatgtgtctgttaatgtaggttatgaatatctttccctagattactccttttaactgtttatgatgtctttcttgttttagggaagtttttaagtatttatgtggcaaaatcatttaatctttttctttattacatttgggtttcatgtcttcttgaagatttgtcccgtgacttaaaaaacagttctataggccgggtgcagtggctcacgcctgtaatcccagcactttgggaggccgaggtgggtggatcacgaggtcaggagatcgagaccatcctggataacacggtgaaaccctgtctctactaaaaatacaaaaaattagctgggcatggtggcgggcgcctgtagccccagctgttcaggaggctaaggcgggagaatggcatgaacccgggagacggagcttgcagtgagctgagactgcatcactgcactgcagcctgggtgacagagtgagactccgtctcgaaaaaacaaacaaacaaacaaaaaaccagttttgtattttcttctaatactcctcctatggctcacattttaacgtttaattcatgtggtatgtatttgggaagattagtattaggtgtagggatctgactttttttttccacttggattacaattgtcccagaaccatcagttctctcccaacaattgaagatacctgcgttaacacataataaattctcatatgtgtcctgttatttctccagtctgtttatttagtcctatacccatactgtggtgtttttattactgcagctgtggattgtatgttttaggtcaagttcccctcctgatgattcttttttttttctctctctctttttttggtgagatggagtctcgctctgtcgctaggctggagtgcagtggcgggatctcggctaactgcaacctccacctcccgggtttaagcaattcgcctgcctcagcctcctgagtaagtgggattacaggtgtgtgccaccacgcccagctaatttttgtatttttagtagagaggggatttcatcatgttggccaggatggtctcgatctcttgaacccatgaactgcccacctcagcctcctaaagtgctgggattacaggtgtgagccaccacgcccggccaatgactcttatttttcaaaattttcatagcttttttttttttttggtcatttactcttccacatgaattttagaattaagttgccattttctaaaaacagagcatgaaattttgattagattagttttcatgggattagttggttttttgttttttgttttttttactagtagcagtagaatcttttcaaatatgccttaatataggcgctggggcttgcccgtggtgctcttgatatataaggcccggacattctgccagttttttctcgagcagtgacaccaagaagttaacagccaggtgaatgttatgcacaagctcatcgtctgtcatcttcacgtggccaacagccacagccaaacataacatgttcatatgaaacttgattgtggacttcgcctcatccactttggccaccgtgttttcatcgtgtgtgagcagggaagggaactttactgcctttgttaggcctatgccgaggattcgtgggatttgctttatcagagactctgaagccaaaaatgcatcatacttcttggccagcttcttgaccagattcttattcttgagtttttttggcacctcagtgtccacttggggggatatccgtggccttggtctcgtcacagtgctgctgttcccccaggacccacacttgggacagggagtggacttaagcctgacggtgcccgagaagcgcttgtccttctgggggtcatagttcttcaagctgatctgcaactccaccatcttcaggaacttggggcactttcactggttcccgtgcaggacttcctgcaccgcctcatccagggtgtcgtgagagactttgctgcttatgggttctcatgccacgctaaccagaaaagagggtttagttggttttataaattattaatagtttgggaggaaattgatattttaatgatgccaagtctttctttcttttttttctttcttttttttttttgagacggaatttcgctcttgttgcccaggctagagtgcagtggcgtgatctcagctcaccacaacctccgcctcctgggttcaagcaattctcccacctcagcctcccgagtagctgggattacaggcatgcaccaccatgcccggctaatttttgtatttttagtagagacgggtttctccatgttggtcagactggtctcaaactcccaacctcaggtgatccacccgcctcggcctcccaaagtgctgggattaccagtgtaagccaccacatccggctaatgccaaatgtttctattcaggaatgtgcatgtgtctcaaatttgttttcaggttttgtaacttttttcatctatgttttatataatgcttgttaaattcatttcaagctattttataatttttgttgctaatgtaaatggaacttttttttcctcaagaaggcaataatcatataacttcttgcatttgggaaacttttgatctctcatttggaatgtcgaaaattaagtttatattgttttttaatagcatgctttttttttttttttgagacagagtctggctctgtcgcccaggctggagtgcagcgcgatctcggctcactgcaagctccaccttttggactcaagcaacctcccacttcagcctccccagtagctgggaccacaagcacacagtaccgcacctggcttattttattttattttattttatttatttattttattttattttatttttggtagagatggagtttcaccatattgcccaggctggtcttgaactcctgagcttaagcagtccgcctgcctcggcctcccaaagtgctgagattacaggcgtgagccaccacgcctggtcagttgtctttttttgagaatgtcaaataaaatgggatcatatggtatgtaaccttttgaaactggcttcttctcactcagcatcatgtctttgagattgattcaggctgttgcatatattgacagtttgttcctttttgttgctgagaagtattctgttgtatggctgtgctacagttggtattagctcccccactgaaggacatttgaatagtttccagtgtttggcaattatgaatagaactcctgtacaggtttttctgtgaacataagttttaatttctctaggagtgacattactggatcgtgtggtaaagaattaagtgaattgttaactagaaaactgattttatataacagtataatattcctagtagaaagaaacctaaagcctctggtctggtctgtgaattggtgtatttttattacttagtacttttcttttctttctttttttttttttttaaagatggacttttgctcttgttgcccaggctggagtgcaatggctcaatctcagctcaccgcaacctccacctcccaggttcaagcgattcccctgcctcagcctccctagtagctgggattacaggcatgtgccaccatgcccagctaattttgtatttttagtaaagacagagtttctccatgttggtcaggctggtcttgaactcccgacctcagatgatccgcccgccttggcctccccaggtgctgggattacaggcatgagccaccacacccagctacttagtacttttctcagctaagatctttatttttgtcagcgttctcttgccctgtgatgggaacgtgatgtatcttgcctattgaagaactaaaacctctgaagaaaacccagagggttgtgggaagagtggcattgatgatttggggacttaatttgttctgagtcagtataagttaaaggcttattgtgtattatgttgagagttttaactgctatccttggggtaagaacagagatgtagaattatatcgtgaaaagaattttctgaaagaagggagtagggacaatctatatcatgcatttaagtcacaaggatgtcgtgaacataaaagatactcacgaaggccgggcatggtggctcatgcctgtaattccagcactttaggaggccaaggtgggcagatcacaaggtcaagagatcgagacctgaggtcaggagtttgggaccagcctggccaacatggcaaaatcccatctctactaaaaatacaaaaaatagccggggatggtggtgtgcgcctgtagtcccagctactcgggaggctgaggcaggagaatcacttgaacccgggaggcggaggttgcagtgagccaagatcatgccagtacactccagcctggcaacagagtaagaccttgtctcaaaaaaaaaaaaaaaaaaaaaaaaagatactcatgaaaaactatatgttcgttggaagaaagttgttttaatttaacaaacatgttggaataagaattataaacaagatacattaatatgtacactctgaagaccattttaaatcaagcctttaaatagcctagttatggtgtaagttcagtttagatgagacttcccacaggatgaccatgaaccaatcagaaatggatatcaaaatgctcattttatatatttttaaaatacatgtaccagttgtgaaattcatctgatttagctcttaaatgaaaatgctacccattatccatattgtcctggaagcatctatcccatatttactatgaatctggggatgttagttgcatctgctgtcttgcttttgaccaacttttcatagcttatggttattttggtgtgaaatattgcctgttttacaccacagttttctttcaagttcattattttccccccactaattttcatagcctcccagagacctttcccctcacacgaactacagaactcacttgtttcagtcatttgtactttattggagttatttattgtttaaaaattattttcctaaagtaatgcatgcacatagcttaacaagtcaaatatactaaaaagttctaatgacaatcagaagtttcttttcttatccctctttttcctcagcattattactcaaaggccccaacttttttaagctctttcttctgttactccaatagctttctccaaatttatcattttaaacatcattgacttccacttcccacttccatatctacatttctttccctagcttttctattgcagtgatatatttggcttatttacttaaattacgactgtgtaagtattgttgagctttggctatgatcatttattttcttatataattgtaaagctttgtctaaaattaatagttgtttctttttctataaactcttaggttttatgtgttactgctaattggccaaaatgttctagcttatctttcaaatattttgcagtactcacacatataatataatgtattagctcaagagagaatcggtgagtataaattagagacagcaaggtagctctttctaggcacagataagtgggatggtagctacagggagacattaggccaaggtattttttagaagatggacaaaatatcaacatatttctctactaatggggataatctcataaaaaggaggaaattggtgctgtcgaagagattttggaataggtgaggggatggtggaggcattggtctttggataacatggacagttcttccatagaaataggaggaaagcaagccaggcgtggtggatcacgcctgtaatccctgcacttcgggaggccgaagcgagtggatcacctgatatcaggagttcgagaccagcctggccaacatggtgaaacctcatctctactaaaaatacaaaaaattatctgggcatggtggcgtgcccctgtaatcccagctactcaggaagctgaggcaggcgaattgcttgaacccaggaggcagaggttgtggtgagccgagatcgcaccactgcagtccagcctgggcaacaagagcaaaactctgtctcaaaaaataaagaaagaaaataaagtaaagaaataggaggaaagcagagggtgccggcatcagtgcaggtgaggggatccttatggtagtaggagcttgtagaaattttctgagtgcaaactgttttttcagtaaaatggaaagcaaactgatctgctacgatgaggagatgtattagagatgtgaggaggttaaaataattgccagataagcaggagagtgaatggactagagaaatgtaatagaattgccaggcagccttaaggcttccctgaggttggtgaccaaggatttaaagtgggaagagtcagcatggcgttgtgctactctccagccacattcagttgcccagctgcaggcatggcatttgcagagattggggttttgtcacattagtatagtgaaaggacaaaggagcattgttatacaacaccccaggagcattgttatacaacaacatcacaatgaaattagtgatataattaggaactaagaacttgaggaggaagactgaccctatgaaggtgtggggtcagtgaattacagatcctggtaagttccaacagttattagagtactagattgagtgagcaggaaggtagaagaagttagttaaagaatgggaagctcaaacttggatcatgaaaggttttcagatattgggaatgtcaaagactggagtataaccatgtaagtagcttaagtatgtaatattttttttctttctggaagtttatccttggtttttagaaattagccattgaggtgccaagggttagtcttcattcattgttcttggtgctcattggacccttttaatatagaggtttttgtctttcagttctggaaaattgtctcttttttaacttaaaaatcttcattctggaatccttaagcagagactggagtgcttgaaaagagcctcaaaatctatcttctatctctatgtttttactttctgggagatatttttaacttcatcttccattctttctgttaaaaatgtgtgtgtgggccgggcacggtgactcatgcctgtaatctcagcacttggggaggctaaggcagaagtgtcacttgaggtcaggagtttgagaccagcctggtcaacatggtgaaaccctgcctctactaaaaatccaaaaaaattagctgggcgtggtggcgcgcacctgtaatcccagctactcaggaggctgaggcaggaaaatctcttgaacccgggaggcagaggttgcagtgagccgagatcgcgccactgcactccagcctgggtgacagagcaaaactctgtctcaaaagaaagaaagctgtgtgtgtgtctcctcttctctccccagctcactctttgatcattttcatctgtttgttgttactgtctttacagcatctagccctggtattatgaatgttgtttcttctgctgactccctgagaatagtaaaggctttttttttttttttttttttttagctcttttataaagtagatttttgttccctgcattgcttctctttttttctggggttctttcttgttaccgctctttcatatagagactttctctggatgtctggtagcctctggttgtctgtacctaatgtggagccctaagcatctgatcacaagctgtgtttgtatgaataggacatgtttgaccacagagctttcctattgggagttgtctggtgcttttattgaagaccccagatatttgtgtccttagatttctgagagtatccagtttctctagataagaatcttctcttctgcctgggaggaactgatgatcccacccctcagtcacttagtcctcccccgcctgccttttcatctgttgcttcactcctgaaaccacgtttcttcatcctggggtgtgtgaaacttcctgagactttgcataaatgcttatgtttagtcacgagtttgttggtgaagactatgttaacaactttacagaaagtttggagaatagagaagaaaaaccccacaatcctaatattctgaataccatttttgtttttgtatattttccatatacatgttttttcaacatatttttgattataattttgtatcttgttttttccgccctcggaattttatccaaagcagttttctacgttgccactaatcgtcataattgttcatttcagtggttgtgtacaatgccattgatgagaacagcagttctcaaacgtttctgtctcagaactcctttaaattgaaaattgaggctgggcgcggtggctcacgcctgtaatcccagcactttgggaggctgaggcgggcggatcacgaggtcaggagatcgagaccatcctggctaacatggtgaaaccccgtctctactaaaaatacgaaaacaaaattagctgggcgtggtggcgggcgcctgtagtcccagctaccaggaggctgaggtgggagaatggcgtgaacccgggaggtggagcttgcagtgagccgagattgtaccactgtactccagcctgggtgacagagcgagaccccgtctcataaataaataaataaatagaaaattgagaactccccaaagcttttatttattagggttatatgtattgatagctgctgaattggaagttattacttaggaaacttaaaatatatattaattcatcaaaaataataatcctgttacatggtaatgtaaataacatatttttatgaaaaacaactattttccaaagcaaattattgaaaagagtgaattgtttaaattctttgcaaacccctttaatatctggcttaatagaagttagctgggttcctgtgtctgctctgcattcacactatttaagtatgttgttttggttgaagtgtataaagaaatgtagctacaaaaggaagggagcatattaataccttttcaggtgattgtggatattgttctttgacattataccaaaactcagcaagtggtttcttgggggtgggtagacagtgatgaatttttattcaaaacaactgtagtgactgacaaaaaaagttaaaacccagaatgatttgcttcaattaaaaattaattatatcccaagagcaggggtctaccaggttgtctgaggggaggggtgaactggcccagaaacggagcaggtcaaaattcctctgctgatcagtgggatggggattgggatcaagattgcttctgtgaatagccactgcctggggaacatagcgagatcctgtctcttaagaaaaagaaacagaaacttttggaaacaagcagacaagggtgaaagaaagccttggtgtaagatataatttatatattccatataagatatagaatacatatgttatataactaaaaagcataaaaacagtcagcatgcttttagtacaacctggaggtatggttaatgtgcaggaaaaaagctccatataagcctaatccctatatataaaaaatcacggaattccacagttttgaacatttttttttctttttgagacagagtcttgctctgtcgcccagcctggagtgcagtggtgcaatcttggctcactgcagctctctacctcctgggcccaagcagtccttccacctcagcctcctgagtagctgggaccagaggtgtgtactaccacatccggctgattttttgtattttctacagagacaaagcatccccatgttgctcaggctggtctcgaactcctgggctaaagtgatccttctgcctgggcctcccaaagtgctgggattaaagggatgagccaccacacctggccaacactttttttgtgtgtgtggtaaaatacatacaacataaaagttataattttaaccattttttaagtgtgtagttcagtgacatcaactatatgtacattattgggcaaccatcaccactattcatttccaggcagatagttaatactcatttttttgtggtttctatatttgcaaatttacctgttcgaaaaaatttatttgtaacacccaaatcagtacagcgctttggtaatccttttcggacatatgcagaacggtgaaaaaatatgcacatccctagttgaggttcaacaaggggacactttgctttctttttttcagtctttgtgccgtaaaccagtgtcttttttgtgatctatttaatgccttttttttcatttttgtactttttgttgatgattttgccatttaaaatgggccccaagcatagtgctgaagtgctgtctagtcttcctaacgcacccttgagtgaaacttacctaacacctgcattttctttgtaaggcacatcatagccttgccatggataaaactctggacagttgagtttttccttgcactgcacatggctatggtgctttacaaagaagatgcacgtgttagaagtttcactcaagtgtgcgttacagtgctgtggctgtgaattcagtgttaaccaatcatatatagtaaagaaggtgttcttaaacagacacacacataaaacaaacttatgtattaatctgctgttgcaaaatgttgtgaccagaggcttgcagaaacctaacccccagaagcaatgatttcgtattcactaattcagtgagcacagtaactgcatagaatgaacaatgagaattgactgtagctccttttttgaaagaagaggcttaattatggagcaaggcatcaggaaaaatcacaggctttcctcatttgtgtgatttttttattttgttcatgtcttcaagagtggagccctaagaagaaagctgagagctcccagtaaaggggtgacgagtgcctggcttagcctcatagaggccagaggaacgtcggtctttacactgggacattccacacacgcaacacagagttattttctatggacagttgagtttttccttttccaagcatattctagggttgtctttctgtgccctgctacatgttccactgtactgctgtcagatttttatctcccagaaattctttgaagtcacttgtcttctggtggcagcccttcccttctcttggccattctttgtcatttggtctttgttcttcagtgggcctatcaggtggcaggacagagaaatgcatgtgatcaatatgccatctttaaccaatgtcctcattatggttatgaaaataacttttcatgtaattatttttattcaagttacatattacacacagtttaaagagtcaagacttgttaaaaaagagtcccctagactcactggtttccttgtctcccaggatggccacttttaatcttttaaagtgattctttagtcttttaaatgattctttcatactttataacatgcttgtagtcttacttgtttttcaggtttaggcattatctattgacattttatttaaagtcatcattgactttaaaaacacaaaaactctttactgaaatgtaacacaggttgggtgcaatggctcatgcctgtgaatcccagcactttgggaagccgaggcaggcagatcacctgaagtcaggggttcaagaccagcctgaccaatatggtgaaaccctgtctctactaaaaatacaaaaattagctgggcatggtgtgtgtgcctgtagtcccagctacttgagaggctgagacaggagaattgcttgaacccaggaggtggaggttgcagtgagccaagatcgcgcgactgcactccagcctgggcgatagagcaagactccatttcaaaaacaaaacaaaaagaaacgtaacatacataaaaagtgcccaaatcataagtgtacagcttgatgaattatcacaaagtaaacacatttgaataaccatgacccgggcaaaaaatatactgtgacccacaccctagaagcctccctttggcctccttcaaatcccttcactaccccacctcctcaagtgaaccactgtgccaccttctaataccataggttttgtctgtttgttgttttaacattgtactaatagaatgttagagtattttaataatagtgtattattttgtgtctatttcttttactctacttcatgcttgtgatattcttccatgttgaggttttcatttgtaaccaactgttgtagttgtttgacttggcctccatttgctatggattgaatcgtatgcctcaaaattcatatgtgtaagccctaacccccagtgtgactgtatttggtgatagggtctttatagaaggttaagtgaagtcgtagtatgaatcctgattgatagggttagtgttattacatgaagagacaccagaacgctagctttttctaccacatgagaacgcagggagagggtggccatctgcaagccaggaagaaggtcccctccagaactgtgagaaaataaattactgttaagtcccccagtgtgtggtattttggttatggcagtccaagatgactaatgcatcattcttcaggccactctatccccctagaggacttgcagtcttttttttttttttgcctcctcttttactgactgagaatgttgttaacactttcagaaacagggtgttaggatcttttgaccgttggtgaaccaacagaaagtggaagataaggatttttctccagtgggtgtttgctgtggatttgttgggagaagcccatctcatgtatgagctgtcccatccctattttgtaatattccactttgctgctggcatcagagtgaatgtaaatggaatttcccagaaatttccacagcaagtggctttctcacttagtgagcccccttggtgtttgttgagtctccctttacccaaccccacaatcactggaataaaggggtggtcttctctccagtctacacctttctgaggcactgcaatcggggataccccagttaccacctcttttggtgaccccaaggtttcagctttgcctgagctctccaggctccagctctgggccaaggtgattttggtggagtcatcccagcggggagctaggaggaagaggggattaggaactcccgctcaggcttccttgctgcacgtacacatgtcacatcaaatgatggtgtttcactctggggacatagttgcttttgataaaatgacttttctgcagtttggttaagctgaatgaaacatatttgagctcctatttttgcttcagaggctattgaatagcagtacctgaagatgaaagtgtataagaacagaatcagtccgggcgcgatggctcatgcctgtaattccagcactttgggaggccgaggcgggtggatcacctgaggtcaggagttcaagaccagcctggccaacatggcaaaaccctgtctctactaaaaaaatacaaaaattagctgggtgtggtggcacgtgcctgtaatcccagctacttgggggaggccaaggcacgagaattgctcgaacccgggaggcggaggttgcagtgagccaagatcacgccactgcactccagcctgggtgacagagcgagaccctgtctcaagagaaaaaaaaaacgcagaatcagaatctttggaatagtgaccggatgccgtggctcatgcctgtaatcctagcacttcgggaggctgaggtgggcagatcgcttgagcccaggagtttgagaccagcctgggtaacataaggagacctcatttctacaaaaaattagctggacatggtggcacgtgcctatagttccatctactcgggaggctgaggtgggatgatcacctgaacctgcggaagtcgaggctgcaatgaactgtgatcatgtcactgcactccaccctggacaacagaatgagacctcgtctcaaaaaaaaaaaacaaaaaaaagaatctttagaataggaggaggatattgagcagaaccataagaaactagtgattaagagtccaggtgtgaaaatagaaaccacgtctcagaagctcagagagaagaagaactggaaaggcagcatctttgatggatttggccatgaagaggaggaggaataaagcagaatggaggccagaaaagagtgtgtatgtctaacggtttcattggaattgggagatctaggtataccatgtaaaattacttatgaaggtaaagtttgaagaaaattcattcgactttgatttatataatttttaaaacctcattatctgttaaaacaccagaagccctgttttttggttactgattatgagtgttcaaggcctcagatcaactcagcatttatttatttatttatttttatttttttgagagggagtctcgctgtcttgccaggctggagtgcagtggcatgatctcggctcactgcaacctctacctcccaaattcaagcaattctcctgccttagcctcccgagtagctgggattacaggcccatgccaccatgcccagctaattttttgtatttttagtagagatggggtttcaccatgttggccaggatggtctttgtctcctgacttcatgatctgcctgccttggcctcccaaagtgctgagactacaggcgtgagccaccacacctggcctatttatttattatttatttatttatttatttatttatttgatggagtctcattttctcgcccaggctggagttcagtggcaccatcttggctcactataacctccgtttccaggtttcaagtggttctcccgcctcagcctttcaagtagctggtgggattataggcatccgccaccaagctcagctaatttttgtatttttagtagagacggggtttcaccatgttggccaggctggtctcgaactcctgacctcaggtgatccacccacctcccaaagtgctgggattacaggcatgagccacctcacccggacaactcagtatttattgagtactccttatgtgccagttagggctataaagatgaataagatgtcttttccccagttgagatatgcataagacagttcgtgtttgcctgtttcagtagtcagtattttcttttgcttattcagtttccactgaaacttatgttttccaaatacaaaattagaattccaactttgcgtttttcaggcgcacacactcgttttccctccactccttccccagttctgatttgcttcctcctgaaaatgggggttatagcccatccactccagggtcagaattgctggataccttgttgcagtgattttttctgtagctcctctggaggttatagactcatagggaataaataatgtggtcaggtggaggctttagaccaagttaagcagggtttttaaaacatggtgttaatgtacataatgcagccattctcaaaagtatgacatggggagacccctggaggttttctgagacccttttaaggagtctgccgagtcaaaactatttttgtgatactagtaaaacatttgcttttttcattctgtctctcacaagtgtagagtggaattttccagaggttacatgatgtgtgatatcacaacagattgaatgtagaagcttgtatgaaaatttcatacaaatatattatttgtgttataatgtgcttattgttattttgaaatcaattgttaaatacttttttttttttttttttttacagtttctcagtttttatttgtattttggtagatattcgttgatacaacccacatttgggggaatgagtaatctttaaaagtgtaaaagggaccaaaaagtgtgagaatgtttgatgtagagaaactccaagctcattccctggactttggctatagatgctttcttcaggggtgggtcttctgggcctgtgtcctgcaggatgcccagtaggaagcacagcctctttgatcttatgggggtgggctcatttgctgttttggagctcaggtgcaaagccgagttacttgatattccctggtcatggcaaagcctctctccacttttcttcccttctattgtcacttccattctttttccatagtccatagaaatcatttttacgtgacagtgatgagctgaccagaagctatagaagctatagtacttcctatatcctaatgggttttaaaaacactggctggggcatactcaccctttctgaacaaaggctgctaggtgaccctgctgttgccgctctgtatattcacttggttagcccacagattggtttggacctaattccctttccttctttaactgcccaaagggcttttctatttaaaaaaaaaaaaaaaaaatttttaaagttttcagattcaatacccacctatttgtatgcttacccatcccagagtcagctaaatttaaagtgtcagtaaattgtaaagaaaagatttgctacattgcatatgtttttagaagtgctttctgtgtataatctctctctctctctctttttttcttggtttggaggagactttccccttgtctataagtaacttaaatataaaatgttataacaatacgtttattagtttgaagccccaattttcttttttttttttcttttaagtgaaaacaagtttataaaagaagtaaagaaacaggccaggcgctgtggctcacacgtgtaatcctagcacattgggaggccgaggcaggtggatcacctggggtcaggagttcgagaccagcctggccaacatggtgaaaccccatctctactaaaaatacaaaattagccagtcgtggtggtgcgcacctgtaatcccagctactccagaggctgagggagtagaaactatgaaaacttgggagatggaggttgcaatgagccgagatcatgtcactgctctccagcctaggcaacagagggagactgtttcaaaaaaaaaaaaaaaagaaacaaaagaatggctgctccatagacagagcagcagtatcagctgcttgactgagtctacttatagttatttcttgattatatgctaaacaaggggtgaattattcatgagctttctgggaaaagggcagagatttcctggaactgaaggtccctccccttttaggggactatttagggtaacttcccaaggttgccgtggcatttgtaaactgtcatggtggtggtgggagtgtcttttagcatgctgatgcattataattagcttataatgagcagtgaggacaaccagaggtcactttcatcgccatcttggttttggtgggttttggcctgcttctttaccacatcctgttctatcagcagggtctttgtgacctgtatcttctgccaagctcctcctatctcaccctgtgactaagaatgcctgacttcctgggaatgcagcccagtaggtctcaggcttattttacccagccccttttcaagatggagttgctctggttcaaacacttctgacatatttcccccctcccttttacagggggacccttaatccttaagaattgtagcgggacaaagatcatctgtaacttcttcaagccaaataggggtgatgatattcctgcctattagggtctcttgtatttagggtagggagaagtttagttagaaagcattgttatagaagcccttattttcagttacacaattttataaagttacaattgcttattgtaaccagctgagttttaggttttgtggtttgttgcttgcttgcttgcttgcttcttaatgccatatatcttggcatttatcagtccataattactaaattcttaaaatccataaatatttattattctttctaggttgcaataaaaataattgacaaaactcagttgaatccaacaagtctacaaaaggtaagattggttcaatgtctagtactttttaaaaaattatcggtgctaattgccatctaatttgtcccttaaataccccaactgttattttatgtttaatgccataaagcttcctattcctcaaatgaatgcaacttaatgtagtatttcatgaaaaattgttgggttatctttggtcggagattatttttaaatgttcttaacagcacaaactaaaggctgtgctttttttttgtacttttttattgatatagttgtacgaggctgtactttttattgaatattcttaatattgactagagtttttttaaaaataatacagtacaaaaatattttcatgtaattgatattgtgcaaatttgtaccttatagctaatactgaaaattttaaagtgaacactttggcttccttaaactcttgacacaccacatctgattaaggactgatgattaatataaaagggaaatgttaaagtaaaactgaaagtggaaaagcatgttcataaagcagtattgccattagtatcatttaacatagatcaagtctttgccctagtgccttttagaatcacctgggcagatttttgaaagtcttaacacttacataataatgcctaagcaattaggttgggcccaggcataggtatttcagtggtaggacatcagcaaataattaatgatcttcataataaaatccttctagttgtttttagcttcgcagagtctttttacatacttcatttgatttctagatttgacctgtagtagttgaggggggtacagagaccatgaagtaggaacaggaagtactgaatttcagtcctggctctgccacttagccgaatatctgaccttgagcaaggcacttaactttgctggaccttgggtttctcatctttaaaatggagataatttcatcttcttatgatggatgtgagtattaatgaaataatgcatataaaagggctttgtaaactgcacagcactgcacagttgtgcgatattttgataagagcagtgctctatatacatttctaatgtattcctcatggttatttatatcctggtaattttgaagccctgtccctgttttgtgtttgggaggtggggagggagatagactttctctgcactaaaaatgttatttcaacaagtggttctttgtgatctgcaacccataatgggccttaaggcttctcaaggtgggcatgaaacatctaaaaattccagtcctttgtcctgaagagtaaattttatctatttccttaaacttccatatcttcagctatctaaggatttggtactaataaatacattagagtttaatacaatgtggtattcagaactaaaattaacatacaaggatgtttaatgaggactctaattgagtattctatgatgttacataccttccactattcatgtgtacctggatataattgtaatcctaacagttttcccggaaaaatttttaccatggtgttgtatcaagttggctgcagtttttccttcttgtttgcttgcttcctttagtcattttttattttattttatttttttggtaatgatttttcattgctgctcttcgtttattatttgtcacatcattatcagtttagtgcatggtagtttggttagcccattagtgtgattatgcatatttgcatctgaattaattttgacttataataataattaaaactttaagatttgtttttggtattattcaagtatgaaccattcactgaagacttattctaaagccagctctatcccaagttaaataacttgataagtataatattttcagtttataggccattgtttaaaattgtgtatataacttcatatgcttatgaagtaaattagaagcattttacatacatttgtttccaattctttttcaccaagtatcttatccccagcccccccatcttcccccacccccagcaattttgcaacaatgtagaatgtaccaggcaactttgtcagccccctttgcagtcattcttgcatccttttttcttctcagcaccattcatagttgtatcacacttgcttcaggaacagctctcttagatagtgatttaaagctgtggagcatgccctagcagctaacattcatcataaggaacattctgccatcagcagtgtgcaatctcttttttaccaccactaccgaaaaaggtggactggctcattcaggcagtattttaacagtgaacacacgtgttaaaatatcggtttcatgatattcaggcttgcatactgggtcatgaacatttactaaatgcacatataagtaaacctgagttgactatgtttgcaaattgatattattttcacagatgagtctcttcatttttcctttgtatttttgcagccattgaattaataaacgttagattctggtgagagatttatttttctccattgttttttaagagatgggtcttgctctgttgtccaggctggactcgaactcctgggcttaagcagtccttccactttagcctcccaagtagctgggactacaaatgcacaccacagcatctggctatataccttccaatgtctcactagtatatctggaatactattctattcttacgcatcttttaggtcaattttttgtttgttcgtttgtttttgtttttgtttttttgagatggagtctcgctctgttgcccaggctggagtgcagtagtgggatctgagttcactgcagtctccctctgcctcttgggttcaagcaattcttctccctcagcctcccaagtggctaggactacaggtgtacgccaccacacctggctaatgtttgtatttttagtacagatgggggatttgccatgttagccaggctggtctggtctcaaactcctgacctcaggtgatccacctgcctcagcctccacttgctgggattacacgtgtgagccaccatgcccaggccaaggtgtgtggatcacttgaggtcaggagttcgagaccagcctggtcaacatggtgaaaccgcgtctctactaaaaatacaaaaattagctgggcgtggtggcacatgcttataatcccagcttctcaggaggctgaggcaggagaattgcttgaacccaggaggcgacagaacaagactttgtctcaaaaaaaaacaagaaatttgtaacatgtaatgaaataattgattttttgtaatgtatttatgatagctggttagttagccaaccttgagcacattcagggatggagacacactccttcccgtagcatcttgttccagtgttcagtggctttgctattagagccttttccccttacttcagactagcatctgtcttctagaaacttctacaacactgtttaccatttgtcatatggagttatagttactccaaacataaccagcccttagaagttgctattttgggtcttgttgattttctcttatgcagagtaaatcccctcagcctccttgggtactcccacaggagtttcgctgaacagaagcctactttattccatacttggaattgtttcccccctcccacctgaatttgtttgattcctgctaaaattcatttaattgattttctgccttaattccagtcttttgggggattttggaataatgggtcatttgtattagctgctatgtaaattagatatggatgtctccatccaattaaaatattaaacaagacaagaacaagacttttcaatggagaattcatccaagttgatactgctgacccagtagtaaagcattttttgagtaagatttaaccaccattcttaaatctagactgagtaggacagaaagggaaatccctgtgtttttaaattttaatgagatttacagaggaagaaaaaaaggaacattaaacacaaatatatgcaaaatacccagtaggatttattaaagcattattgactatggatttcatcagggtctttgtggggaaatcctgcttatacccacctcaatcttcctccctcccttccttccactggccttatcgtgattgtaaaatagggcaacactacattccataaaatagaataagtgtccctatgagctgagcagaagttggctttagagacaggcaaaggctgaagaaggctgaggcaggcccggcacagtggctcactcctgtaatcccagcacttggggagcctgaggcgagaggatcactcgagctcaggaattcgagatcagcctaggcagcacagagagacccgtctctaccaaaaaaaaaattaaataaattaaccaggtgtggtggtgtgtacctgtagttccagctacttaggaggctaagatgggaggatcacttgagcctagaagttggaggctgcagtgagctgtgatggtgcccctgcattccagcctgggcaacagagcaagaccctgtctcaaaaaaaagctgaagcaaagaacaaagagtgtattggtcctttcagaattccttttttttgtaaggcagggacagggaaacagaacaatagaccacaatagactataccacatagaaaagtaaccgattagttaatgtcaggttacttcacactacatttttttctgtaaggattaaagcagtaggaactttgttattgtgccaattgaagttttttcttttcttttcttttcttttcttttttttttgagacagagtcttgccctgtgacccaggctggagtgcagtggtgtgattttggctcactgcaacctctgcctcccgggttcaagagatacttctgcctcagccccctgagtagctgggactacaggtgtgtgccaccacgcctggctaatttttgtatttttagtagagacagggtttcaccatgttggtcagactggtctcccaactcctggcctcaggtgatctgcctgcctcagcctcccaaagtgctgggattactggcctgagccaccgtgctcagccaggacagtttaaatcttcaatcaggggctggacgcagtggcacacgccaataatggcagtactttgggaggccgaggcgggtggatcacctgaggccaggggttcgagaccagcctagccagcatggtgaaactgcatctctactaaaaatacaaaaattagttgggcgtggtgacataccccagctacccagtaggctgaggcacaagaatcgcttgaacctcggaggcggaggttgcagtgagccgagatcacaccactgcactccagcctgggtgacggtgagactctgcctcaaaaaataaataaataataaactgtcctgtttgggaaattagctgttatctccttttcttctgatttctaggaaggtcagataacaacttaatttaggtttgggaatgtggaatcttagcagggattactccatttttaattttaacctggtttcctggggcctaatgcaggagtttagtcccaaacaatggcttcctataatttttatttaacaattcttcccttttggtcaggctttcacctaggtaagagtgtaaccaaaacctaggatatccctgctgttctcagttgccatcattttgagtttcccgtttcagcatgccgttgacagggtgttctcattatcgtgtgtttcttttgagtttttgttgttctagccagagagaaccatttgacatctgataggtggctacatggagacacttaacactctgggaggatacagcgtaccagagagactaccattatgactatcatgaggatcacaccaagcatttagagtatgctcctaagccagggtttttatgaaccaaatcaactaaaattgtatagccaaacaaggagtctgccaattttaaccaagttgtccgctctaccatacccaaatcgcaacgagaagtgtcatgaactgcacagattcctccatgtttagtaggcatcccagcattccgtgaccgggctaagtataaagcagggagtgcaagttacccacagaagctactgactgtgaaattttagctacagcatgatcctgccaaactgaaagaggtaggcattagtaaggaaaaattaagaggggcaaaagcattgttatgaagtcttgttattatgacagtcttgggaaaagctgtccatagcatgcagtccacaacttctcgtcctggttcgcagtttgaatgtctctggttgtggcatctggcattctggtgaattctctgtgtggcctacacatcaggcatgagactcgaaatttacatcaagctgtcagctttggtttatagggcttctgaaattgagcagctcattcttcattggcaagttgtagccagatattaaagaaaactagaagaattcagaatctagttcagtcaggaataatcttatcaggtcatttctggaagtcaattctgtgaattaatattttagcagcgttttttgcttctaatttcaaattggaaggtatagggttattcattgtgcccctcaagcctggtccactccgatacccctcaagcaccagacacctacccaggaagagggaggctgttttctttttaaagctagtatttgctttggagccactgttagtgcttagagctctgtagcagtagcagtagtggccttttttggcgtcctagggaatcttggtcatgggatgtagcagggaaacttataatttgaaagcaaggagaaccagttcatgcttttcatgtggtctgtcgtgtaatgacttttactgctgccaccactgggttattttgggcactgttgatttagttttcttaagccagtacttttcaacccttcttgtgcattagaaacatttgtggagtttgaaaaaagcatatttccttcacagtactttcctccctagaggtcctatcttggcgggtctagaaatgtggtgatctcagtacacaccccagatgagaatggctcctagtctgtcttcacttcccccaaagttcttaatttctctcttcttccaattttacttatttttatttatttatttatttttttgagacggagtctcgctctgtcacccaggctggagtgcagtggtgcgatctcagctcactgcaagctctgcctcctgggttcacgccattctcctgcctcagcctcccgagtagctgggactacaagcacccgccaccacgcccggctaattttttgtatttttagtagagatggggtttcaccgtgttagccaggatggtctcaatctcctgacctcatgatctgcccgccttggcctcccaaagtgctgggattacaggcgtgagccaccacgcccggcctatttattttttattgattgagtgattgattgatggggtcttgtcctgttgcccaggatggaaggtagcagcaagaccagagctcactgcagcctggaattcctgggctcaagtatctttccacctcagcctcctgaggtagctgggactataggcgcgcaccaccacacccaactaaagtaacctattttatttatttatgagacggagtctccctctgttggccagcctggagtgcagtggtgccatctcggctcactgcaacccctgcctcccgagttcaagtgattctcctgcctcagcctcccaagtagctgggattacaggcacccgctgccacacccagctaatttttgtatttttagtagagacagggtttcaccgtgttagccaggctggtctcgaactcctgacctcaagtgatccacccgcttcagcctcccaaagtgctgaattacaggtgtggccaccgtgcccggcaaagtaacctattttaaagatgaccccttccccaaatattctaagtttcatagacagctgctactgccactgccactgctgaatattttctccctctctggaactcttcctaggaatgccttagtacccagttcctggcctcctttctctattgggtgaagcacaagttattttggaaatccttttcattgaacaactcttttcatctttttcttttctttcttttttttttttttccaactatctttctctttcattttcttatattgacttttcaggccattaacaaaagtagtaaccactgtaaaaatagttgttacagtcttgtctgttatttaaaatccagtgtctgcattcacatcagtgtcataaatctgataaattaatacaaataggagatggcaaatgaaatccaagacaggcacttcttatattgattgattgaggctgggtcttactttgtagcccaagctgaagtgcagtgtcatgatcatagctcactgtagcctggaacttctgggcttaagcaatcctcccgtcttggcctcccaaagccttgggattataggcatgagtcaccacccccagcctgattatacatatttaaaatattgagaatagactgggcacggtggctcactcctgtaatcccagcactttgggaggcccagctgggtgggatcacctgaggtctggaattcgagactagcctgacgaacatggtgaaaccccgtctctactaaaaatacaaaaaaattagccaggtgtggtggcgcatgcctgtaatcccagctacttgggaggctaaggcaggagaatcacttgaacccaggagacggaggttgcagtgagccaagatggcaccactgcactccagcctgggcaacaaatgagaaactctgccaaaaaaaaaaaaaattgagaataaaactgtatatatgtttgtttatttttagatttcaaaagagaagaaatagaaaaaccggctttcagtattgttgcttctttattccttataaacttttaaatttcttgccagacttatttttgttttggcaataaataatacgggttgatatttagaatacattataaactcgggaagctgaggcaggaaaatggtgtgaacctgggaggcggagcttgcagtgagccgagatcacgccactgcactccatcctgggcgacagagtgagactccgtctcaaaaaaaaaaaatacattataaactgagaatagtagagtgtattttagagattgattgtttgtttttagaattgaggtctcactatcttgcccaagctggtctcagactcctgggttcaagcatcctccttccgaggattccaatctgccttccaaggagctgggattacaggcacacaccaccatacccagctaaagtatatttttcattgtaccaaggacttattatgctattttagaaaagtcaccaaggaaccaagtattttaagtgggttaaacttagagcatagcctggacccatttgcagaaaatataaacttgggtgcaaattaggcctttgtgagagaattataacagtaacatcagccagaatcacaaacacatgtcaggagtttattgtgtgccaggtgctgttccatgcactctgtatgtcaagccatcctttcattgtagaggtgacagggtcagggaggtcaagttacctagacttagtgagtggtacagctgggttgggattaggtagtatagctcctggaatcaaattctacacacactttatcttatagcattgcatgtacttttcacaacagtcctgtgaagcagttgttttctttttttttctttgagacagagttttgctcttgttgcccaggctggagtgcaatggcgtgatctcggctaaccgcaacctccacctccctggttcaagtgattcccctccctcagcctcccgagtagctgggattacaggcacccgccaccacgcccagctaatttttttgtatttttagtagagacagggtttctccatgttggtcaggctggtctggaactcccgacctcaggtgatccacctgcctcagcttcccaaagtgctgggattacaggcgtgagccaccacgccaggccgaagtagctgttttcaaaatctatcttataggtaagtaggttaaagctctcaagattttgtggtttgttcactcatccagtgaataagggactgaactagccttagaacctaaatttataacatcaaatagctttctttgcataagttcccttggagccagtcactcatagtactttccatatgggaaggataacaaaggaacatatggaaattcagcttgcatgtggtagatacctagtaaaatctgataagttaattttgttagtaccaaattcattttaacactaaattaatttttcctgatgttgctctgattctaggaatcttgaccaccagaaccttgagtttgggagatgggaagattcttagtttgtctttgaaatatttgatcataaaaaacacattattggccaggcatggtggctcaagcctgtaatcccagcactttgggtgaccaaggcaggcagattgctgagctcaggagttcaagaccagcctgggcaacatggcaaaaccctgtctctacatacagaaattagccagatgtggtggtgcgcacctgtagtcctagctacttagggggctgaggctggaggattgcttgagcccgggaggtcgaggctgcagtgaaccatgttcatgccactgcattccagcttgggtgacagagcaagactccttctctaattaaaaaaaaaaaaaagcacacacattgttgctactcttattttacatttttagaaaactgatttgttgtattactcagctaaagctaagcaattttttaaaatttagtttttaatttttattaaatactgactgcatacaaaagaatgttccatgtttagcatataaatatgtatatgagatgagcacccttatactacctgcttcaagaaatagatcttcaaccatacctttaaaccagtcccatattgtgcccctcctcaacctgattccccttcttcattgcccacctactgggtaaacactaacaaggattttgtgttattattttcttgctttgtccgtgtaattttaccacatatggatcactcatcaatgtagtgtaaaggttttttttggtctgttttttgtttcttttgtgtttgtttgtttgtttgtgactgagtctcgcactgtctcccaggctggagtgcagtagtgcgatctcagctcactgtaacctctgcctcccaagttcaagcgattcttgtgcctcagcctcctgagtagcagggattacaggcgtgcgccaccacacccagctaatttttgtatttttagtagagaccaggtttcaccatgttggccaggccggtcttgaactcctgacctcaagtgatccacccacctcagcctcccaaagtgctggaattacaggcgtgagccaccgcaccccaccaatgtagtgtaaagtttaaaaaattgtataaatggactcatgctatgtgtattctcctattggcttttgctttgcttccttttttttgtttttttgagacggagtttcgctcttgttacccaggctggagtacagtggcgtgatctcagcactgcagcctctgcctcctggattcaagtgattctcctgcctcagcttccaaagtatctgggattacaggtgtgcaccaccacacccagctaatctttgtgtttttagtagagacgggttttcaccacgttggccaggctggtctcgaactcctgacttcaagtgatccacccacctcagcttcccagagtgctgggattacaggtgtgaaccaccatgcccagccgcttttgctttcttttacctacattgtgttccatgttgatgtattttgctgtaattcaccttcactgctatgtccattttcaagaatatgtagtatcccattatgtgaatatgccactctgtatttattctgtgattcagagacatttggattgctttttgtattgcaaacatgactgctgtgaattgtcctctgtgtgtcctggcacacttgtgaagagtttcttaaatatatatacttagaattcttgtatcacagagtctgtctgcacatcctccttcttcattagagaaggccaaattattttcagagcaggtatgctaatttatatttccatcagtagtgtgtaagagagcacaagtaatgtagcatcctcatcaaaatttgattttctctgattttttaaaatttgtgccatcacaggagaattgcttgaacccgggaggtggaggttgcagtgagctgagattgcgccactgcactccagcctggcgacagagcaagactgcatctcaaaaaaacaaaaaaattgtgctatcaatttggtaaatataaaagtgatatttggccaggcatagtggcttcctccttaaattccagcactttgggagcctgagatgggaagatctctccaagccaggagttcaagaaccagcctgggcaacagagcaagactctgtatctacaaaaagattttttttttttttaattatctgggcatggtggcacatagctgtggtctcagataattgggaggctgaggattgattaagcccaggagtttacagctgcggtgagctgtgattgcaccactgcactccagccagggtaacagagcaggagcccctcttaaaaaaaaaaaaagaaaagaaaagaaaaatctcattatggttttaatgtaacattttcctaattactgatgaggtcatgcattttttcatatttaggttttttgtttcttctgtgaagtacgtattcatcttttgtttaatttctagtggattttttcttagttattttaggatatcattatatatcatggatactattatatatgtggcacacaccttctacttgatggtatatcttcactctcttgatactgtctctcagtgaatagcagaggctcctaattttaaagcagttacatttatcagtctttttttaatatgctttgcactttttatgtcttttttgtttttttgtttttttgtttttgagacggagtttcgctctgtcacccaggctggggtgcagtggcacgatctcggctcactgcaagcttcgcctcccgggttcacgccattctcctgcctcagcctcccgagtagctgggactacaggtgcctgccatcacgcctggctaattttttttgtatttttagtagagacggggtttcaccgtgttatccaggatggtctcgatctcctgacctcgtgatccacccatcttggcttcccaaagtgctggaattacaggtgtgagcccccacgtccggccttttttgtgtcttctttaagaaattcttctctacctggggtcataaacatatttttctctgttgtcttcacatgtttaaagtaatctttaagccaccagcagtcatgtgttacgaggtagggatccagtttcatggtttttcgtatgtataatcacttgctgcctcacctctcctttctttgctgatctgcatcgtggacagagtctccgtgtctaaacacacactttgttcttcagaagtggttattctggttcacttaacaattgccatttgaaaagcaattatttttattttattttcatatttttaaattttatttttaatgataggacaccaaatgataaccagaaccccaaaatacataggtgaaaatctgagctaaattaatagaaacacaggcatgacagagaagactttatcacttaactctcttaggccattcattaattacacagtaagtagggggaaaaggtacatatcttaatatacagcacctccatggccaggtgcggtggctcacacctgtaatcccagcactttgggaggctgaggtgggcggatcatgaggtcaggagattgagaccatcctggtgaacatggtgaagccccgtctctactaaaaaatacaaaaaaattagctgggcgtggtggcgggtgcctgtagtcctagctactggggaggctgaggcaggagaatggtgtgaacccggggggcggagcttgcagtgagcggacatcgtgccactgcagttcagcctgggtgacagagtgagactccgtctcaaaaaaaaaaaaataacagcacttccattagcccatagtatagctgttttaatccccttttcaggatacataacagctgtgtgctaggatattatcgtcataactattccaatgtgtgatgactatgaggtatattattttctcagagttgggcaatacataacatttgaataagccagactaacatctttctaggctatagttctaatgtagagcaataaaaatagaaccaaacaaaatatacaaacatgtggaacctaaaacacacagaattcttggatcaaagaaaaattgcaaacaaaaattacagtatatctaggaattaatgataataagctgtgtgtcagaacctatgtaatactgctttttggtgctccgggaaatttgtagccttaaacacattattaaacaagaatgacaaggaatgcattaaacattaaactaatagtttagaaaagggaacaaaataaatctcaggaataaataataatgtaaggagtcagtaaagctaaaggcagaaaataatgaatttgaaaacagtagaaatggtaaatccaaaactttggtgggtgtccccccccctcccaccgacaaggaagtgagaagagaggcaatgaaatagataagctactaagtgctgccagggggaagggagagaaaacacagaaaaatgagggggaaataccagatactgaagaatttaaattattataaaggaaccttttctgcaactctgaaaaatgttagaatatccaaagaaattgataattttctaggaaaacatgacttaccaaaattaactctagaaaagaatcgatacacatcagtaacaacagaagttgagaaagtagttaacatattgccaaacctggaattcatgattgaattctttgagatctactgtgagtacatactctgcctctgttcagctgttccagaacttaagaagaggaacttccaaattcttttctcaaattcagaaacaatgctattgaaatatattggaaacaggaacgaaaactacagttcagtttcacttataatatccattctaaaattgggaattaaaaatactagcatataggactaaatactggtacatttatctttgtttccccaaagattcactaaatgatggtaacggaattaaaaaggaggggaaaagagtccaggaattgagtactgaggcattctcaggaagagcaccaagagagggaggagatacccagcggtcacagtggaagtcgtctttgagacttagagcgtttgaggaaggggtcgtctttaaaataggttacctacctagcacttgggagaccagaccagcctgtggcaaccagtgacatcagttcctttgagtctttccagagatactctgtatattaagaagcaaatttttttttccttttttacacaaatgcattttcttgaaaattccttctcatgaactttgccagcctctctgtcttggtttgtctgagagggcctttgatgcactcttccatttaggtgctgtggtagttgaggcaaagggacagtttctgtagagtgatgagggagtgacttaggtggcctggtcttctgtcccttatctgtgtatctggagaagggagcctgaacaccttcattgtgatggtttagatcagttttatgtctgtaacccccgtgttctcttttacatactcattttactttcgtatcggttggtaaaattgtctttttttttttttttttttactagagactaaaattctctctctcttttttttctacttgtcaaaaggtaaaattttatttttccagtggtaatacttgacaacccccaggtcttggctattgggacatgtttctttacttctctgataccgtagatttagtgtccttgatatccccattgccaggattccaaatctttgccttcaaaggtatttattctcctcttgtgtgccagttccatagaggatgtatagatgtgaaaatgtgtggaggatatagattgatcagtaaggagagaattctttcaatttatacgtttccatgtaatttgatttcttttttccaactaacatctatttaagattgaaaagggaatgtggagaaataagttgtattaagatagtagaaataggctgggcgcggtggctcacgcctgtaatcccagcactttgggaggccgaggcgggcggatcacgaggtcaggagatcgagaccatcctggctaacatggtgaaaccccgtctctactaaaaatacaaaaattagctggacatgatggcgggcacctgtagtcccagctactaaggaggctgaggcaggagaatggtgtgaacctgggaggcggagctttcagtgagccaagatggcgccactatactccagcctgggcgacagagcgagactccatttcaaaaaaaaaaagtagaaataaggtgagtttctcttatttaaatggccttttacaattacaaaactttaaaatttttctggtatagtccttatagggactttccttaaagttcacatttgcctttcagtacattattcctatccaaatttaactatctttggtcatcagattctgagattatgaagtctctggcatttttatctcacttgtatgcaaattgtcaacttcgtaaaaagctctgtgccagtacccacctgttgctctggacttttctatatcagcagcttataatttgttgatttttttttttagttaaatttctaaggtagcaatgtggaatcctgagatgaacgtagactttggagtcaggcaacccacaatgagaatcctggctccagcatatattagctgagtctttggatgagtttcctaacctgtctcagtcgtctgtctctgtatactggagatgatcatactcagctgatagagttgtgaaaattaagcttagataagactgtgaatgtgaagcatctggctctatgcgtcagacacagcaggcactagataactgttagcttcctgcttcctccctgtcctgcttgtttaacttagcataaagcttatttacacatttgctgcctgccagtatctacctaatacataattccaatagagaggtgaatacataaagttatttgggctaatatcctgccactacctctcttgggattctttggctgctctttttgcctacggaattaaatttttactagtcttctatctggtcccatttacctgtcctttttgttttcacattgcatccctggtatgacctctgctgtaactcaggagttctcgcattttaatatggtgtctgcagaatattagttatccactgctgcctaacaaattcctccagaacttagcaacttaaagccaaatcttttgaattcctgtaatagtccatctttttcctgctttttggctctaattcactttgtttcatttctgctgtactgttagtagagacttaaaaatgattgccttcatttgacctgctcccctgtcatcagaactgtgacaactctgtaacaagcattgtgctgcggaggatttaaaagctatgtggtcattagaatgctgaggctggctcagaccgcagttgttggtagttagtgctttcatgcaggcatttatcaaacaaatgcatttcagttgtgtgccagccttggtttcaggtatacagtagtgaaaggagacaggcatgctccctgtgggtgacacaaggataacaaacaggtgcacaaaaatgtgtcttcatagcttgaaagacatcccaggaaagaagtgaacagatgggctatgatgtaaaacaaggagacctacttagatacgttttcagagaatctgcctgagacttaaaggatgaaaagggagaagacatttaaaggaatttagtatgttctgtggccaggcgcggtggctcacatctgtaatcccagcactttggaggccaaggcagacaaatcacctgaggtcaggtgttcgagaccagcctggccaacgtggcaaaaccccgtctctgctaaaaatacaaaaattagccaggcatggtgggacctacaatcctagctgctctggaggctgagacagaagaatcccttgaacctgggaggcggaggttgcagtgagccgatattgtgccactgcattccagcctgggcatcagagtaagactccgtctcaaaaataaataaataaacaaacagtatgttctagtaactaaaaggagttggggtgactagaacgtacctttgaggggtatgcagaagttggcaggttgcagggatgccatggccatggtcagggtttcattctcagtgctgtgtatcctgagctatattgatatggcatccaaagtggagattgttgtctttttttttttttttttttttttttgagttggagtcttgctctgtcacccaggctggagtgcagtggcatgatctcagctcactgcaacctccaggaggtgttgtaatttagcagttgggaagtaattgggagatttgaattctagctaccaattcaactataatggattggaaaacaagatttctgtgttagtttaacagaggagagctaaaaaagaactcaggcctgaatggttgtcaggaatttacttgggtgactatcttctcatctcagaacataaaatgtaggaattaccacagttgcaaagggagatgtttatgttggagataaaaatgctcctcccttcaaaaatgagacagtattttagataggaaaggttatttatctgattacatgttttaaaattctgagcgtaaggttatatgtcaaatcctgtccatgggctgggcacagtggcccacacctgtgatcctagcactttggaaggctgagggggaggattgattgagcccaggaggtcaaggctacagtgaactatgatcacaccactgcacttcaacctgggcagcagagcgagaccctgtctcaaaaaataaaaataaattaacaaaaaaatctggtccatgtccatctcctcttagctgctaattcaattttagattagacacagtggacaaggacaagtatggtgagagtcctgtgatttctcaccagcttcctttccacataggccgctgcttctcttcttccaaggtttttccccgcttttgcctcctggaggttgtatcctgggtgttaggagactgggttccggacacattccccacagaaggatagcaggaccttagaagatctttttctttcttttcctggtttcctcttgtttgcaagagggttgaataggatggtctctaaaatcctgttgtttttctgggttatattaacccaggccataatgataagaacctgctctgaattcacaacatgtatttatacaacagcaatttaatatttcttattctgtggaatggctaggaagctctgctggtcttggttggatggttttttgtttgtttttttttgagacagggtctcgctttgtcgcccaggctggagtgcagtgacgccatcagctctctgcaacctccacttcccaggctcaagtgattctcttgctcagcctcccgagtagctgggactacagacacatgctactgcacccagctaatttctgtatttttagtagagatggggtttcaccatgttgcccaggctggtctcgacctcctgagctcaagtgatccacccaccttggtttcccaaagtgctgggattacaggtgtgagccaccgtgctcggctggtttttcttaaggtctcacctgggttcacttgtgtggctgaattcagctggtggtttggcaggggctggatgcagttacaacagaggatctgtctctttaaataactacccttcatccccaaagaggccagaccagctccttcacagtgctccaagagagcaagccatgacgcccaagcattttatccagcctctgcttgcttcagtttgctaaggtcccactggccaaagcagattacatggccaggtctaatgtcaatatgaagggggcactccacaaaagcgtgaacatgtaaggcatgactcatgagggtcactaatgtaatagtcaccacaacctccatgctaagttacctatattctccagtgaggatttctcaaggtggttttgttcatagtcttctaatagaattatttggaattatcagtttaatatgcttatgatgtatttcactggaaccatacaggttttgattcgcagagttgggagccctgggtagatactgaatcagactaagtttaatcacagaaattattcctgcgtaagtctgatcttatgttttcaagatagcattgtaaaattcagagtatgttaccatccccctttgagacctctgctgtttttaataaatggaagcatttgggaatactatttggtaatagtttattaaaactacttcagagatattctggactttcatattagtcttagatatggattaataaacattagcaatgaatctgttatctaagagaaaaatttaaatttatattacaacagtggaatataatgtttaataacttgtgttggggggattatgtgttttgtttgtttttttttttagctcttcagagaagtaagaataatgaagattttaaatcatcccaatataggtactttctgcttttttaaatattttggggtctaaatacgtacttgaaattatgtcataaagctaaacacgtattctagaaatggtagagtacacttctagtaaaatatatatacaagttgttgatcatttgtattagctttttgaaattgctgaagacaggttaaaagcttaggtattaaacgttgaatttaaagctttaatctggtagaaacatctgtactctgattataattttctaatttttaagtatattagaaaatataattgtattgcatgagtagatagaagggaattataggaagtcagaattaatattttcaaaggggctgggcacagtggctcatgcctgtaattccagcactttgggaaaccaaggcaggaggattgctggaggtcaggagctcaagaccagcctaagcaacagagcgagaccccgtctctccaaaaaaaaaaaaaaaaaaagtaataataataataaacttaaaaatttgtaaaaagaatatttcagaggtccaatactttttgctgtgtgccctaagaaaatacttatttgaaagatggaatacttgctatctaatggaattgtgataggaattattttataaatcaaagatttgttttctgtgtcctctgtgtgcacaactctgtgctgggtgctagtaggtgtgtttaaagatgaggaaggagcgacatggtcctacccttagagtaactgtagaaacaagaagagaataagcaaatgacttaatactgacccaagaaaaacttttgatcccatatgcattgtaatagggcttttaaaaaattacataactgcttttttgtatagtgatagatcatacaatctaaaaataatatttcaagaatgaaatcactcttaagacagcccataatcagcttaactgtcaacatcagttttaggaaatgaaaggattgatgtttagtatcaaggatagcctatcaagaatgcatcaggcacaagaatagaagagtaacacagaaccaccacaggaagaaagaagcttttacagagagctgcttttttaacaaaaggcgtatgccctatttcatcagtctaaaccaccattactttaaaggtgttcttgtttccttgtttcatatactactaagagaaatgctagcaagccttcatcctgatatcagggatattaattaaaatgtgaaaaaaaaatttagaatcaataagtatggttgaagaaaaaaccacggaacaacttcatagttggattaaaaaaaaatcacaaggaatataatagtgggaagaaaatcttgtttccttgattttcatttcaatcctttggggctagctagccaactctggatttcaaattccaacttttcacacccgtcctcccgccccccacaaaaaaactttatcactgttgcctagaacaagctaacgtaaacatgtttattttgtcttttaattacttaaattgtgacctgattagagttttgtacttaaaacttgacatatctttgataataaattgaacttttaaaaaattcctattgcattaacatagttttcccagaagacccaaagtttcgttggaagattagaagagttttattttcatgcagcttaccaacacatgtgccttaactttctgaagtggcttttcttcacagtctgaacgtatcagagtctagggaatggtatgatagctttattcatcagttcatcaaacatttactgactgctatgttaggcattttgtttggcctgatactctattaaagcctcagaaaattgcttgaaatataaaacactagcataccccccagttttgggtaaacttaaagtaaatattaacataataaagtagatatgcacaatggtgatttgatagcttcagggatttactccagtttcatttttaaagtgtgtgtgtgtgtgtgtgtgtgtgtgtgtgtgtgtgtgtgtattctttttttttttttttttttttttttttgagacagggtctagctctgttgtccaggctggagtgcagtggcatgatctcaggtcactgcaacctccaccacactggctcaggccattctcccacctcagcctcccgagtagctgggactacaggtgcatgccgccatacccagctaatttttggcatttttttgtagagagggaattttgccatgttgccgagggtggtgtccaactcctcagcagaaacgatccacccgcctcagcctcccaaagtgctgggattacaggtgtgagccaccatactcagccaaaaatgtatatatttctaataaggttttatgaattagcagtgatagaaatatttccatctgtaacaaaagactgctgtaggaaaatcaccctgacctactgaaaatgattcttataaaaaagattccccccctcaattaattgcagtataatccctctacttctttccatctttggcatcagaaaagtaacaaaggaaccttgttctttgaaagttgtcataagtttcccaagcaataaaggtctcaaatagaattacatccttaaagccataatcataagcagctagatttgcatttgttggagcagagtagaactgagcagttgctgcaggctgaccacttttcctggggtgctgggagggcagctagccaacacagacatgctgaaggacagtgagggtgacagaggaagtgagctcaggtacaccttgctggactgctgagcacatatggaagtcacactgaacattcagaaattatttttatggaattccatgctttcatagactcttttctgttgttgtggtatttgataaaattccctaaaagcattttttagagggccagctattaaaatctttaacagggaaaaggttgcttttcatagttagagtttatatgtgcatggtttgtgcatacagacatttgtctctttttcttccgtgtcctctcctctcccgcagtgaagttattcgaagtcattgaaactgaaaaaacactctacctaatcatggaatatgcaagtggaggtaagaacatttttatatatattgggttttttttctttctcccttttaaaaaaatacacaaccatactgcccatatgggtcatcattaaggtctcatttaacgtccagagccataatacgctaggatgagagtcggaaaagctgactcttagcacttctaggggttgccatgaagtgtttcactattagcattgttaattggtaatatctaaatacctggatattttttgtggtaaaacatgcatcactgaaaattatcgttaaaatcatttttaggcgcacagttcagtgacattagcatgttcacgttgccctcaccaccacccatgtccagaatgttttcattttctaacacgaaactctatacccattaaacactaactctccatttctccttctcccagtccttggcaaccattctcctttctgtctctatgaatttgactactcttggaacctcatacaagtggaattttacaggatttgtcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctactacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccaggatttgtctttttgtgtctggctgattgatgcagcatagtgtcctcaaggttcatccatgctgtagcatgtgtcagaatttcattcctttttaaggccgaataatactccattgtgtgtgtgggacacacacctcacattttgtttatcttgagtatgtggctatttaaacatatgaatgcttagtctgtttgaaacaaatgtgtgctttggtttagatgcttttctttaccagattttaatgtcgctggtgtctgtcttccccaaggccagaaatgatggttacagtacacatcactagagtttccttaaaataaagattaatgactagtaactatttgcctatggttttgtaaaaatgtagacattttctgaaatgcgtgtttatagctgctgtcttttataatgatttgtattttatggttgagattgggctgggtttgtagtttgcgaccacacgtgagtttcattgtctgtgaagggcagaagctttcttgttcatctttttgtgtcccctgcctctagcacactgcctggcacacagcagatactcaacagataagaattagactgcatttaggaattataaactactgggtacacattctgttaaactctatcgtaattttatcattagcactttgatccatgttacaaaacctgaagatagaaagttggattatagtctcatttgagtgagtttaccattgaaaataaaaagattgtaaacctgttgtggaaaacaatgagttgtagtaagcatacctttgacaccacttttttatactcctaattcattattagttgtgtattttatactttatatatgtctagtttgggaatttcattgggattttcaaaacttcaggggtagtagaaagaggggaaggttaatttcaggaccaaaaagctttatggagttctaatactttctgtgggcaaacaacacagagtaatgttcatagccctcacgttgtacagcctctacagtgtacaaggtgctttctcttaccagatctcctttgaccttcacagcgactccatgctgtggccaggcagtgagcgatgggctttttacccatgaggaaatggaggctgggaagtctcactgtgggcgctctgggcctggaccgccagtgctctgacagcagatagcctttctagtttgttggtcagtcacggctttctgttcccatctgttttagctacccaggtcacagagattactcatataggggcaagacaaaaacatctaagagtcatccaggtttagtagaaagaggatgggctctggaagagacagacatggagtgaatccagccagtggccctcattggccatgtgacctggcaagtaacatgtgctgagctgagcttcacggtgagcataggaaccccctctgagggctcagtgcacttggcaacattgtaagagcctttaatcatttaatcgaaggtggtggttctgtattaccttgggtttttttttttttctttttggagacagggtctcactctgttgcccaggctcaagtgcagtggcgccatctcagctcactgcaacctctgcttcctgggttcaagcaattctcctgcctcagcttcctgagtagctgggactgcaggcgcacaccacacctggctaatttttctaatttttatagagacaaggttttgccacattggccaggctggtcttgaactcctgacctcaagtgatccacctgccttggcctcccaaattgctgggattataggtgtgagccacagcacctggcctctttaacagtgttttgttgagtttattaaaacaatttccgggacatatgttttattgttgatgtgtttgccattgtgaaaagttttattaaattggccacccattccaccattgcatctcccccacccgccagcctgctgccttttgatttggtaaactcatagaattttagaattgaaaataatcttagaaattttagggcagcggtctaatttttacagatgaaactgaagctcagaaagtttgttctatgccaaggggtccatagctagttagtttcaggacctgaactagaactaagggctttctgaactggcctgtcagtgtccttccatccagccacctgttcctgcccaggcaggagagccactctttgcttcttgtttcttttatctctaataaatagccttagtatttttcagttcagctgcttaacctgaatgttaatacatttttaataaggaaaaaagatctggattgaattcctggtttaaaagttgaactcctgaattataatttagtaattatgagtgtgacatatggttccacaaatctcttaagaggtttgtattgaattcaaatttagaaaaaaaaatctgtcaattatattgacagacttggattttatctgtgttactctacaacagctggtaggcttaatcgtttaatttttttaagtgaaaactctcctatatgatattcactcatgtttagttgtttttgcttattaaccacttgttttgacattgtgtgcttttctgcaaataggtcattcgcatagaaaatgctgacactttaccgagctgacatttaacttcataattcatcatagttaagtgaattgtgtcgtgtaaacttgacagtatgtaatgccttttaaaagatcattatgcaggctgggcacggtggctcacgcgtgtaatcccagcactttgggaggccaagacgggcagatcacttgaggccaggagttcgagaccagcctggccaacgtggtgaaacccccatctctactaaaaatacaaaaattagccgggtgtggtgacgcacgcctgtaatcccagctactcaggaggctgaggcacgagaattgcttgaacgttggaggcagaggttgcagtgagccaagatcgggccactgcactacagcctgggcaacagcacaactctgtctcaaaaaaaaaaaaaaaaaagcattatgcaatcaagtaataacatgaaaatatttgtgcccattcattatgtaaaatttattctttcagagttagggttaataagagtttcaaagtcagataattgtgtaattcatgatgactttcaagtatcaaaatattttagtttaatattttcactaagctgatggaggtattccttatttgtatgaagtaaagatgtttcctgaaaacacttatatctaattttctaaattagtattcttttctattgatttcagaggtggtgattctttattctacattgataagcagttgacagtgctaataatatattccttgaagtgtcacctttcttccctaaataattaatgttgtgtaaactgccacctaggcgtgcatcagctggttctgttgttttcacctccattgtatcctgagctcctacttctcaccaccactgtgcttcccactctagtccccgtcactttcatgattggtttgattattgtactgatctccctcttggtcttcctgtcccttcccgtcattggaagcctcttccccgctagcagccagtgatccttttaagaggtcagtcttttttcatctctgcttctcatctcacttgtagtagagccagagtcctcaccacggcctacaggactcttcctagcctcatgaactaccctcttcccctcattcacacttctccagccctgtggccttcttgctctttctcttaattactgtggaatcttaccccagataactacattgtccacaccctcaagtagtcagcaaaacacaagggtgtgcacacacaggctcacttgtctgtctctcctactttttctccacagcacttactgtcctctgatacactatatgtttattcatttattgccccctcccccaactagaatgtaaactctatgaggaaaaggatcttgtgttcactgctgcatctccccagaacctacctagaacagtgccttgcagttagtagacattcaggaaatatttgttgaatgaatgaatatactcaggaaatgctttgttgtcataatcctgcagtgaggatgtcctcttctaacacaaataacttcatccattttaattttctgttttaattgcttagtttttattaaagcctattgaaaacgctctttaaaataagagttatataatttaagtatagggaatttaattttaaggcttttcttcagcttaaagattttgttggtgaatttaaatgcctgtagttaaagccagcttagttcaaattccacatatttctggctaactttatatctatatttaaaaattagagcattgctaaaagtgaaacatcaatttatgggaaaattaatactcagaagtaggatttctacttacttttatttctctcacctataggtgaagtatttgactatttggttgcacatggcaggatgaaggaaaaagaagcaagatctaaatttagacaggtatgaattaatgtgtctttactatgtcaatttgataatttatctcacttaaaccctgaagcaaacaagtgtttgcctccataaatgcttataaggcctgttggatggcaggggttggccattcaattcaacaaaaattgatgaagaacttttcatacctaaggcactgtgctggaggcagccatggttctattcctagctttgtaatgggagcattagtcttatacttaaccttccctttttacaactgagccttaaaaatctagagcctttcaaaaacacctgtgattacattaattaaagccatttcagagtttttagcaagcagaatgtcagaaccccaaaattcattattagctttgtctgacataaaccaaggccaagtgtaactgaaactgttaattagtaactttacttcttgctttgtttttactctgctttttaaagagactcgggttttaataagcaggttttaagcaaacaggttacttgactctcctgtctttattaataataattactgttatctattgaccatgccacacactgagataagtactttaccaacattaaggtaaatcttacagctgccttgtgagttaaggactgttatatccatttgctaaaaaataagacaactgagacatgggaagattaaataacttgcccagaattgcctttctttttttctttttcccccttattgtggagaacggggtctcgctgtattgcccaggcaggtcccagaattgcctttcaagtaggagacctgccatagactcagagtcccaaaccctctgaccccaaaactcagatttgcaatcattatattgtgctattatttagactgggaatcagcaaacttctgtaaagggccagatagtgaacattttaggctttgtgggccacactgtctctgtcgcaactatttaactctcttgttgtagcttagaagcagtcgtaggctgggtgcgatggctcatgcctgtaatcccagcactttgggaggctgaggtgggcggatcacctgagggtcaggagttcgagaccagcctggtcaacatggtgaaaaccctgtctctacaaaaacacaaaaattagccgggcatgatggcaggtgcctgtaatcccagctactggggaggctgaggcaggagaatcgcttgaacctgggaggcggaaattgtagtgagccaagaccgtaccattgcacttcagcctgggtgacagagactccatctcaaaaaaaaaaaaaaaaaaaaagaagcagcagctgtagacaataccaaatgaatgaacgtgactgtgttccaacaaaactttatttacaaaaacagggatgggccggatgtagccagaggccataatttgccaacccctgatttagacgaaggaaaggagcagtgcttcactgcttttaaattaattctgtattctcacaaggcctacattgaaatggaattatagcctcattttttcttagaacctttatattttgttttattcatatacagggttgtcaagctggacagactattaaagttcaagtctcctttgatttgcttagtctgatgtttacatttgtaagtgataggacttattaagtttcttataaacgttgcttatattttgctgttgcttaaatactaatggtactttgaattcaaatctagtaaaaccaaagtaaaaatcagctttggctatcatttaacttctctgatcctgtttttaaagctataaaaaaaaaagaaattattcttgatgaattccatagttctttgcaattctaatataatttgattgtatggtctattaaaggaaattcagatttttattagaaaaaaagtgtgtggctctttccataactgtactcttaatttttataaattggccacctaaaagggaacatttttttgcttcatacaatttacattccttcctactcagatgaatctgacttgcaaacatgtgtgaagatggcttattgactatgaggaaggggctggtgtcacccagcaagagcttactaacctaaatcttgaggaaattactctaatttttattgtaaattccctgcagaaattctgaagcctttatttgaggagcctgttagttggactaggaaagatggtttgtatgtatgtgttttttcaattagcaaattgatttagagtgctttagaattgaccctttcttccatggtatttgcctaaaacagctccattagacttggaaggatacgcatcatattggtgtttccacttttctgtttcaaatgctgtggtttctttgttttttcgtttttgagatggagtctccctctgtcaccaaggctggagtgcagtggcccgatctcagctcactgcaacctccgcctcccaggttcaagcaattctcctgcctcagcctcccaagtagctgggattacaagtgtgcaccaccacgcccagctaattttttatttttttttttgtaattttagtagagacaaggtttcaccagtgttggccaggctggtctcagactcctgatctcaagtgatctgccctcctcagcctcccaaaatgctgggattacagatgtgagccatcgtaatgtggcctcaatttctgtgctttctaggagcttataagtcataattactttgactaagtaaaacaagtttttctatttatgacaaaaaggaaggtatgccacacacaaagtacactgtgtgtgatcccttttccatattcatcaccagatgggttttccccttctgcttccttcaccatgcccatcctagttactgcttatgacattttaattttttggttgagctcattcttttccaagaaaaagaatagatttccagctccatctttttttttttttttttttttttttttttttgagacaaatctcgctttgtcgcccaggctggagtgcagtggcgcgatctcggctcactgcaagctccgccccctgggttcacgccattcttctgcctcagcctcccaagtagctgggaatacagatgcctgccactacgcccggctaattttttgtatatttagtagagacaggatttcactgtgttagtcaggatggtctcgatctcctgacctcgtgatccacccgcctcggcctcccaaagtgctgggattacaggcgtgagccacgcgcccggcacagctccatcttttttacttacctctttattggtgggctggtaatattgatgatttgacgctcttttatgtatgattgaaagtgaattaggttaaatcatagtttaacctaaataacatctgttagaaatcaccatttctacctggtaatagaatgcaaaaaaagcagtaagttcaagttgagtcttttcagcttattgtggcatcaggttagctttgagctgttttggagctaaagagagagagaaatcctttgatctctttgagaaagggcaggaaatcaaatctgcttcaaaagcagaatttgaaaataacctgtaagagaaatctcaatatgaggaaaaactaatataaattctgaatgagaaaaggaaaaagattagataaaatttacctgtgtcctaggtgacaaagctatgactttgttttgggaaaacaaagctattttacttttcaagttttcatgctgactgaatagaacaatagtgataaatccaaagtaacagatgctctaaaacccgttttttggcattggaatttttgtaccttttgttaattataagtgggtctgatattctgaatgttaattttaaataatgaagctgcttagtaaagtgctgatttttgttatcatctcatcctaaccccagttcaccttgtccttgctgcttattctgaaccaaaatattatacagccctctgagattttatgtccacgggtgggtccatggggcttagagctaagagttgatgatgatttggaggaaccaacagtaattttattataacctcagttttgtgtatatgtaatcatatgtgtctaaatatacatgcagaataccaaagaaaagactagatgcaagtacagcaaaatagcaagacatgttacctctgcttagtggtaatgcaggaatatatttctatagacttttctgtatttcctgaaatttctacaatgaccatataaagctttaatattagaagactttttttaagtgaccgtaagtgtgaaatttcagtaaaacaattgtttaatcataggcatgactgcaagttgactaaataaaagcatactatttactgaaagtgggaggaatccttaatagtgcacgtagtagttttcatagttcacgtacgtcgcaacattcattcctccattttaataaaggaagaggaaactgaccctcagagaagttaactaacttttgctttccatgatccacatcagttagaaggaagactgttgcagggagcaggctgagaagggcacttacagaagagagccaacctggattaacacctgggtatgggcaactctctaaccgctggtttggtttggagttgactctatgggtatggaaaggttgcaccaggccgggcgcagtggctcacacctgtaatcctagcactttgggaggctgagactggcggatcacctgaggtcaggagttcgagaccagcctggccaacgtggtgaaaccccatctctactaaaaatacgaaattggccgggcatggtggtgcacacttgtaatcccagctactcgggagactgaggcaggagaactgcttgaacctgggacggggaggttgcagtgagccaagatcatgccattgcactctagcctgggtgacagaacgagactctgttaaaaaaaaaaaaaaaaaaaagttgcaccagagccatcggagcctaggggcagccagggtcctccagatctaggcaatttgttgggtcctggcactacactgtaagtggaatgtcaacggatagggtccaaaaagagacttcagttaaaacagtagaaaacggaagaacgtcctcacctatttgtttttgccctcacccatgaatttctccagactggaaagttcaaggcataggaaaattgtttttagaaatccacacggacattcgagcgtatactgagtattcattatgtgtgaacattaacaaagttattttcatcttaattacgaatctgcaccagtgatgactgactctgcgtctctcctattcagattgtgtctgcagttcaatactgccatcagaaacggatcgtacatcgagacctcaaggtgagtagaagtgcctcactcagtgtatgctctgtctgtttgtgtgcagttctctcagtggtcattacacaaatgaggtatagattagccttattagcattttttaaaatcccacaataattgaatcctcttaatcaagttatgggaaagagcattaaaaataaagaaaaataaaggttattgaaagtattttacatttcagttacggtgactggtggttgatctctggagaacagtcatcacacagccaaacaaatgtgggcctccagaaatgtatggtcacgcccacagcatcctcagtgccacccggcattcatttctgctgctttcatcagtattctctcccgttaacagcagtgcctgtttgagacctctttcaaggtcctcagcctctgccctcactctggcataggatgaggtttcgtatcgcacagagaaaatagaaacaccatgcagaaactctcattttctaccaggccctcaaacctagcagcacctacccccatccatcacttctttcctcctgttacaggaaagtggggtgcttctgctctgagctctgggtcctgattccctctgggggctgtgctctgtctgatgcctcttttctctccgtttgtttattcactctccttctctactggcttttcaccagcagcatttacacatgctcaagtctatatacctttttttttttttaactaaaaagccatgcctgttcctctttcagatacacgctttttctctcttccctttcatagccatatttctctaaacatttcctagattctgtgtcttaacttggcactcactttcactctccccttacgtaattgccattgacttgcttgttctctgcacccgcccctagagcattcacattcactctctcaactgcagtggccaactgtatgctgatggccccaaatccattcctacggccagagcactcttctgggatccaggacccagctgagcaaagggtgtcttcatataagcatcccttgggtgcagcaggttcaaatcctataaacatgaatgttcacttctcattcaggtgtctgatgtccctcaagtaccttactctcctgtgctacccactcagtcaccaggtccttttgctgctgtgttccaagtatctcttaagctcactcttttatgtccctgttacactatccaaggccagaccaccattatctcataggtgattccgacactactttcttatatgttcttctctgtttctagtgcctcttcctcccatgtatgttttctacactgcacccaaaatggtcttttaaggaaacacaaataagatggtcatttctctgcttgaacaactcttcattggcttcccattgctcttacgatgaaaacccaaacttctcaagtacaatcctttgtgattaagccctgaccatctccccagccccctctacacatctctatctcacatactgtctttcaatttcttgtgtgaaacatactgtgtctcacatgggttctcagactctttattctgcctgaaatacccctcatcaacacatccattatgatcagatgcaccttctggtgctttgatttcacttcatctgggaagccattcacacctttcagtgccaacccacaactccctgtgcctcttcagttatggcattttgtctcaggacagctgcttatcattctccttcttcccttctaaactgtgagctactgagggtagggctttatctgtcttgttcatcattatccatccagacactaatatagcatctgctgtggagtagccacataggaaatgtttcttaaagtgactgtgatttgtctctttttttttttttttttttttttttttgagacggagtctcactttgttgccctggctagagtgcagtggtgcgatctctgctcactgcaacctccacctcgcaggttcaagcgattctcctgcctcagcctctcaagtagctgggattacaggcgcccaccaccatgcccagctaattttttgtatttttagtagagatggggcttcaccatgttggccagactggtctcgaactcctgacctcaggtgatccacccgcctcagcctcccaaagtgctgtgattacaggcgtgagccaccgcacccagccatgatttgactcttgaatgaggtttaggattctcccctcctcattaacagccgttttatagctatttagccgtttttatgaaatgcccctttttaaaaaaagttatttatgttttgagacagggttttactctgtcacccaggctggagtgcagtggcacagtcatagctcactgcagcctcaaactcccaggcttaagaggtcctcctacctcagccttccaagtagctgggattgcagatgtgtgccaccatacccagctaatttttaaaaatcttttgtagagaaagggtctcactatgttgcccaagctggtcttgaactcctgggctcaagtgagccactgtacctggccctgccccatattattcttgttttttggttttgagatggagtattgctctgtcgcccaggctggagtgcagtggcacgatcttggctcactgcaacctctgcctcccgagttcaagcaattctcctgcctcagcctcctgagtagctgggattacaggtgtgtaccaccacacccagctgatttttgtatttttagtaaagacagggtatcaccatgttggccaggctggtcttgaactcctggcctcagatgattcgtccacctcggcctcccaaagtgctgggatcataggtgtgagccaccgtgcccagcccccatattattattatcaattgaaaaactcaaggcttttcttgatcttgggacattgatgtttaaattagtgctagaattaatctgtacttcatgtttgttattgttaatattataaaataaggagttctgacttgtctcctgtttttttctctagaaagaatgttttcacattaattaggaggtaacttcatatcattacagaaagcttttctaaaatgcctaatcctgtcataattctaattctattttggctaaatttcatttttgtcttgatgttttccctctaggctgaaaatctattgttagatgccgatatgaacattaaaatagcagatttcggttttagcaatgaatttactgttggcggtaaactcgacacgttttgtggcagtcctccatacgcagcacctgagctcttccagggcaagaaatatgacgggccagaagtggatgtgtggagtctgggggtcattttatacacactagtcagtggctcacttccctttgatgggcaaaacctaaaggtataagaagctgcacccatgtacttcactaaactaaaagaagtttcctaatattacatggcttaatatttttaacattatatcagtgcggggggtttcagggggttttttgttgtgttttgttaactaaacctaaaggttgacttactcgttttctttcctctgtacctctccaaaggaactgagagagagagtattaagagggaaatacagaattcccttctacatgtctacagactgtgaaaaccttctcaaacgtttcctggtgctaaatccaattaaacgcggcactctagaggtaatcatgtaggtggaaacaagcagtaactttggagagtctttagagtgaccttagatctttgcttgatttgtatgccatactggatatatcctgcggctttttaagcaagaattgaaacattaaaaaatattttttgagtttatgctttgaacgatagtcaatgaaatgttgaaaataaatttttgtaaatattacggttatcagaatatttcattttactctgctaatgaacagtttaccttttttagcaaatcatgaaggacaggtggatcaatgcagggcatgaagaagatgaactcaaaccatttgttgaaccagagctagacatctcagaccaaaaaagaataggtaatcactccatgcctgcatgttcatgtgtttttgtctaagtaacatatttctgttttgactcatgtctgtgcctaaaatgtgaataatggaaagttaagcacaagtcatatgaacagtttatctgttctgtcatatttaggaacgtaactacctgcagtttcctataatggcacccagtaactctgaaacaagtgcccatttatgttacaaaatatatgtaatatgtcatcttttaggtcaaatgaaaattattttaccctacaaaagaatgatttctggccgggcgtggtggctcacgcctgtaatcccagcactttgggaggccaaggcgggcagatcacctgaggtcgggaggtcgaggccagcctgaccaacatggagaaaccccatctctactaaaactacaaaattagccaggcacggtggctcatgcctgtaatcccagctactcgggaggctgaggcaggagaattgcttgaatctgggaggtggaggttgcggtgagccaagatcgcgccattgcactccagcctgggcaacaagagtgaaactccgtctcaaaaaaaaaaaaaaaaaaaaggatgatttcttacccaaacaaaacacataaactgtattatgcccttcttttagatattatggtgggaatgggatattcacaagaagaaattcaagaatctcttagtaagatgaaatacgatgaaatcacagctacatatttgttattggggagaaaatcttcagaggtaagagtaatcagaaagagctgaaataccctgtatgtaattattagtttatataaactgttttcttagtttttatcttttgaatatttgtaacatttgatacatcattttttagatttacttgcaaatagcaaatctaaatcctatgactattataagctattttaacttaacccttaatgatggatattggccaggcgtggtggctcatgcctgtaatcccagcactttgggaggccaaggcggacagatcacttgagaccaggagttcgagaccagactggccaacatagggaaactctgtctctgctaaaacaaacaaacaaacaaaaaattagctgggcgtgttggcgcttgcctgtaatccctgctccttgggaggctgaggcaagagaactgcttgaccctgagaggcagaggttgcggtgagccaggatcacgccactgcactccagcctgggtgacagagcgagactctgtctcaaaaaaaaaaaaaaaaaaaaaaagatggatgttgtcataaacctggtctttcataaattaacctgtagtcattaatagcttagaaatgacgtaaagcatcagatgaagtaaatacaacatttaaagttatttgagaaagcctggaaagaaaatcataaataccttacctttagtgtctttccagccgtcagaaaactacttttgcttgagtttagggttgtcatttttgtacgttgtgattcctcctctctctgaatgaacggtttatgagaggtctgtgttaatgaaaagtttaacttcctaataagccatttgggttcgtgttgtggtttgctctgtttttctcattttctcttagctggatgctagtgattccagttctagcagcaatctttcacttgctaaggttaggccgagcagtgatctcaacaacagtactggccagtctcctcaccacaaagtgcagagaagtgttttttcaagccaaaagcaaagacgctacagtgaccatggtaagttttggagtatcccagtgccttctcttagagtccaggcaagaggtctcctagcactgggaagcattctcttgctcagagcctggcttgatgtcctttcttggcattgctttctttctttcttcttttttttttttttttttttttttttttgagacagagtctcactctgttgcccaggctggagtggagtggcacaattttggctcactgcaacctccacctcccaggttcaagcgattctcctgcctcagcctcctgaatagctgggactacaggtgtgtaccaccatgcctggctaagttttgtatttttagtagagacggggtttcaccacatttggccaggctggtcttcagctcctggccttaagtgatccacctgccttggcctcccagagcgctggaattacaggcatgagccaccgtgcctggccagcattttttcttagtgttcctgcaggtgctgccatgattacatattacttcaaggctcttatcttctttatacatgcagtagatttttgctggataaagcttagttgagtggaaaccttaccatttgcccttctagaacctctgctttaatctgtagttttcctttttttttttttttttaaatggagatgggggtctcgctatgttgcccaagctggtctcaaactcccaagttcaaactattctctcaccacagcgttctaaagtgctaggattacagacgtgagccaccatgcccagcgctagaactgggcgctgtaccgaactgaatagaactgctagtctgtagttctattcactctcttcacctctgcattggatttactttgtagagtagcactgtccagtagaactttctgagatgattacagttttgtgtatctgtgctgtccagtcaagaagctactggccacttgtggctatcaagtacttgaactgaggaaatgatttttaccttttttatttctatttattttttattatttttatttatttatttatttatttatttttcagatggaatctggctctgtcgcccaggctggaatgcagtggcatgatcttggctcactgcaacctccacctcccaggtcccagcagttctcctgcctcagcctcctgagtagctgggattacaggcatgcacaaccacacccggctaatttttgtatttttaatagagacagggtttcaccatattggctaggctggtcttgaacttgggagctcaagcaatccactcaccttggcctccaaaagtgatgggattacaggtgtgagccaccgcgcctggccttatttatttgtttattttttgagatggaattttgctcttgttacccaggctggagtgcaatggcatgatctccgctcactgcaacctcagcctccgaagtagctgggactataggcacacaccaccacacctggccaatattgtatttttagtagagacgggatttcaccatgttggccaggctggtctagaactcctgacctcaggtgatccacccaccttggcctcccaaagtgctggattacacgtgtgagtctgtaattggcctggctgatttttacccttttaaaattttcctggccggacatggtggctcatgcctgtaattccagcaccttgggaggccgaggcgtgtggatcactaggtcaggagttcgagactagcctgaccaacgtggtgaaaccccatctctactaaaaataaaaaaattacctgggcatggtggtgtgtgcctgtaattccagctactcaggaggctgaggtaggagaatcgcttgaacctgggaggcagaggttgcagtgagccaagatcgtgtgactgcactccagcctagtgacagagtgagagtccatctcaaaaaaaaaaaaaaaaatttgtacttaagtgtaatatatagccagttgtggccagtaactctcataatagacaggacagccctggagaatatatggaacctcagttttgccttaattggtttaaatgttgtactgtgtcattctcatccatactcttgctgttagtgtggttaagccactctcccttttaaacttcacctagaagccagtcctttatgagacataagactcccagtgggtaggcttaccaggctctacagttgctctgccttcaaggcagcctgtgtgtcagagtcctgaggctagcgtgtgtgtttacttgcccataactataaatgttaacattgcagatatttcctttaattctactattccaggattcaggaactaaatctatttttttttttttttttgagatggagtttcactcttgtcacccaggctggagtgcaatagcgcgatctcggctcactgcaacctccgcctcctgggttctagcaattctcctgcctcagcctcccgagtagctgggactacaggcatgcatcaccatgcccagctaatttttttatttttagtagagacggggtttcaccacatttggccaggctggtcccgaactcctgaactcaggtgatccatccacctcagcctcccaaagtgctcggattacaggcatgagtcactgcgctcggcctcattttatttctcttctctggacattttccatcttaatactttcatcttgagatttgacacttaggactgcacagggcattttaggtgtggacagctttgattttgtactaaaaatgattacacttggcttgatttccatttctcttccttctgttgcttgcctttctacatggtttagactgaagcaacagtgtactaatatcactagtaaaccatctacagtgcctgctattctagggtgtaactgagagctcagaactcattctcacatcaggatttgtgctcctagcatttgtaggtgacgtgttgatctaggtctgccttttttgtgttcatgttagtcactaacaaggggggtttctagtgcttatggaccacatggcaattaaatgcccatatattgccctgaaaccatctggtttaacttgtccctcaatcctagaagaaacctgacaatgggattttcacatttctctaaggaatatgttagtaagttattccttaagcacatagattccatccagattattagtgcctttttccccccagctcaattttagagataaaaagagctttagacatggtattgtacactcaccaaacctctgttttatccctaaatagaccaagagagattaccaagtctcccaaggttacatagtaaatgagaaacacctggggcagagctcaggcctgctggtccaagccctgtgttttttctccactgaagcacctcattggagtagctttttcataatcctcatctttcttggaatttctgaaggcaggcaagcctgtatagccgggctaactttcacctcatcctcctgcctcgtctcacctctcccttcccttttccttgcctgtggatgctgacctctgcatgggtgcctgcttctctaaagctacgatgtaatctgtagctgtccttcctcgtttgagacccacatgtgaacaccccatatgtgtgcactttttctgcgaatggtgatcatctgattttcaaggggttagcttgttttttaaaaaatgaaaaaaaaaatcactgtttactaatcaatgagtggtattggggcaatttggtagttctcagaaaaaaaattaatttggatcaatttctcacatcttatacaaggatgaattctaattggagttaagatacaaatatagggctgggcgcagtggctcatgcctgtaatcccagcactttgggagtccgaggcaggtggatcacgaggtcaggagatcgagaccatcctggctaacatggtgaaaccctgtctctactaaaaaatagaaaaaattagccaggcgtggtggtgggcacctatagtcccagctactcaggaggctgaggcaggagaatggatgaacccgggaggcggagcttgcagtgagccgagatcgagccactgcactccagcctgggcgacagagcgagactccgtctcaaaaaaaaaaaaaaaaaagatgtaaataaaactccagaaatattgaaagaaaccttgggattatttgctttgtaacttggactggtgaaggtgtttctgtcaccccaaacaccaaacccatgaaataaaagacttacaaatttgattacataaaaatgaaatttctggccggtcgcataatcccagcactttgggaggccgaggtgggcggatcacgaggtcaggagatcgagaacatcctggctaacacggtgaaaccctgtgtctactaaaaatacaaaaacaaaatcagctgagcttggtgtcaagtgcctgtagtcctagctgctcaggaggctgaggcaggagaatggcgtgaacctgggaggtggagcttgcagtgagccaagatcatgccactgcactccagcctgggccaacagagcgaggctccatctcaaaaaaaaaaaaaaaaaaaatgaaatttctgtgtgacacatccataccatggactactactcacaataaaaaggaacaggctgggcgcggtggctcacgcctgtaatcccaacactttgagaggccgaggcaggcagatcacgaggtcaagagatcgagaccatctggccaacatggtgaaaccccgtctctactaaaattacaaaaaattagccgggcatggtggcaggcgcctgtagtcccagctacttgtgaggctgaggcaggagaatcgcttgaacctgggaggtggaggttgcagtgagccaagattgagccactgcactccacagcctggccacagagcgagactccgtctcgaaaaaaaaaaaaaggaacaaactatgatgtgcacaactcagatggatctcaagggaattatactgcatgaaagtacacaaaaggttacattccatggatgcccattcatataacattcttgaaatgacagaattctagagatggcgagcaggttagcggttgcaggggtttagcaaaagggagagtaagagggaagtggctgtggctatgaaagggtagtctacagggtctttgagatggaaatgttctgaatcttgactgatggtgaccacatgaatctgaacatgtaataaaagagtatagaatgagatacacaaacatacaaattagtgcaagtaaaactggggaaatctgaacgaggtcagtggattagatcaaggtctgtttctcttcagaatctcaaatcttaaaaggttttgtattttctaaacacaaataaaagctggaaagccaatcagtagtaatctgaaagttcacaatgtcagtagacgtctcatggtattgggaagaaagataagcattgaggctaatatcaccctatgcttgattaagtttttgttttatatgttaaaatcactaaaccgaaagcttagttgttgttctcccacaaataaaattaagccctcatttacttttaattcagttccaaataggtttgccatttagatttttgtccaagaactaactcctccccactcccggtttttgtttgtttgttttttaaatttatttattgagacaggttctcactctgtcacccaagccacatgtagcctcaaactcttgagctgaagccatcctcccacctcagtctcccaaagtgttggaattacaagcatgaactaccacacacctcccacctttaatatatctaaaatataaattctcttctgccttagaaaaaacaggctgggcgcagtagctcatgcctgtaatcacagcactttgggaggccaaggtgggtggatcacgaggtcaggagatcgagaccatcctggctaacactgtgaaaccccgtctctactaaaaaaaaaaaaatatatacaaaaaaaaaaaattagttggcatgcgcctgtagtttcagctactccggaggctgaggcgggagaatcccttgaacccagtaggcagtggttacagtgagccgcgattgcgccactgcactccagcctgggcgagagagctagactccgtctcgaaaaagaaaaaacaagcatttgactctgtcttttaagattaccactggattatcatatctgaggcatatactagttatcatgttcatttccaagattctttgccctctgaatctcctgtgctgctattggagtctctatatggtttactacaggacattagtctgtcatccacatgtccctaggcacatgtccctggacacactcctcctggagtggcaggaatgactagtgacctccaccgacttcctccctgtcgcttgcatgattcctctgcttctacaccttcccctgtctactcaaactccggtttatctagaagattatgagtgcttttaaaaagatccaagataaaacttcaaaagaagtggcccataaaatctatacttttctcttccaaaaggtgatggcatctctcctacaaaagaggatgtaattcactcagatgtacaagatgaactggttcattctgcttgttacgtatgcatctaattagtttgaatctatgcagtaccaccaccttaagatgtttccaaaggacaactctaaactcttactattaaaaaaaaaatgttttaagtagaaaggagtattaagtgaaatttcaatattgaattcattgcataaggcaaacattagatataagtgggaaacatcttagaggattttactgttttacattttttaggtgaatagcaaccttagatcatcttacaaaatatggttactgtcacaaaataaaacttgaaactatattcagtcatttaaaaaatgaactctttattttagctggaccagctattccttctgttgtggcgtatccgaaaaggagtcagaccagcactgcagatagtgacctcaaagaagatggaatttcctcccggaaatcaagtggcagtgctgttggaggaaagggaattgctccagccagtcccatgcttgggaatgcaagtaatcctaataaggcggatattcctgaacgcaagaaaagctccactgtccctagtgtaagtgttgttgaactatagagtggtcttagggtggtagggttggaaccagctagacaccaggtgttcattttactcctgtggtctctcgtactggaatgccctctctactaggcagccatgcccaatcttaacttacagaaatcctacctgctgcattgtaggtatttattgttgacactctcttagttcattcttgctgctgtaacaaaatacctgagactggctaatttataaagaaaagacatttatttcttaacaattctggaggctgagaagtccaagatgaaggcaccaacaagttccgtgtctggcaagggccctgttctctgcttccaacatgatgccttggtgctggcatcctccagaggagacaaatgctgtgttgtcatgtggctgaagggacagaaggggtgaactcaccccctcaagcccttctataaaacactaatctggccgggtgcggtggctcacgcctgtaatctcagcactttgggaggccgaggtgggtagatcacgaggtcaggagttcaagaccagcctggccaagatggtgaaacgccatctctactaaaaatacaaaaattagctgggcgtggtggcaggcacctgtaatcccagctgctcaggaggctgaggtagagaattgcttgaactcaggaggcagaggttacagtgagccgagatcgcatcactgcactctagcctggcgacagagcgagactccttctcaaaaaaaaaaaaaaagatactaatcccttcatgaaggcggagccctcgtggcctaaacacctaaaagactcatctccaaatactgttttctcctatgggagataaagcttaaacatgagttttggaggggacacattcagagcatagcacacccaccatagacactagatggtgataggtcctttatttcaaggcctggttccagttatttcggacacctgctgagccttaggttgtcaggtgctgagacatggaaagacctcacagtctaacaggaagtgaatgaaaacagtgacagtgcagatggaagcctacgtgcacacacggggaggtctgactgccagtgccccaaagatgtggtgttcacactgagtcttcaaagagctctaatgatgaagagtgttggctgagttcttaccatgtgccaaggaccatgctcagtgctttttcatggattagctacattttaaggtgaaaaaaaagttgggtaattgcctaaaattacactgccaacctgaatccagctcttaatccctatctgtaacaaaatctccccagtaagtagataatatttactaaattaaattgaatccattcagcttcagaaacttttttctgtgtattgaagtatgttctatctaacctaacatattaaagaatttgcagagaagtaaacaatcttaagattattctgtaagcacgtttttccctacaaaattaacaatgatgcagccctgcctccaactccagaaaaaccctggactgaggaggctgtggagaaaccctgttgctctctgaaagcccttcattgttccattctggggactgggtgcatgaaggaccccaaggggctttgcatgtttcatcctctgaccttatgcttagtcgaagtaaaccctgtgtgaaaagtttattttggcctccaaatgccatacagtaggattattgtttccatactcctgcagttaaaattccgtctccaacgtttgttgacagttaccagagaagatgagggcattattccctgccttcatgacttctcttcccctttgctcttgtctacacacgctgcccttctgaaagtgaatcatgagtattttcagtccacccatactaaattacttacaaaggaaaaaaggtagttagcaacattattattttctcccatgagtctttgggatttctctgtagatggtctgctcaagctgtagtaaaagtgactgctctatctttgtttaaaaattatctgataaaattccatagctatggccaggcacggtggctcacacccgtaatccctgcactgtgggaggccaaagtgggcggatcacttgaggtcaggagttcaagaacagcctggccaacatggtgaaatcccatctctactaaaaatacaaaaattagccgggtatagtggcgtgctcctgtaatcctagctattcgggaggctgaggcaggagaattgctttaaccgagaagatggaggttgcagtgagctgagattgtgtcattgcactccagcctgggtaacagagcgagactccatctcaaaaaataaaaaaaaaagtccatagctgtgacttgttccttgctttttagttttttgttttggaagttaaattcatgtgaatccacatgacaatgattaaccattttaaagtgggcaatgcggtggcatttggtacactcacagtattgtgcagccaacacctgtctttagtttcagaactttttcagctccccagaaggagcatctgtttaggctgggcacagtggctaacccctataatctcagcgctttgggaggctgaggtgggaggatcacttgagcccaagagtctgagatcagcctgggcaccagagtgagacctcatctctacaaaaaaaattaaaaagaaaatagctgagcgtgatgatgcacacctgtagtaccagctacttgagagcttgagaggctcaggtgggaagatcatttcagcccaagaggttgaggctgcagtgagtcatggtcacatcaccatattccagcctgggcaacagagcaagaccctgtccttaaaaaaaaaaaaagtggccgggcgcagtggctcacgcctgtaatcccagcactttgggaggctgaagtgggcagatcacaaggtcaggcgttcaagaccagcctggccatcatggtgaaaccccatctctactaaaaatacaaaaattagccaggcatggtggcgggcacctgtaatcccagctactcgggaggctaaggcaggagaatcgattgaacccaggacgcagaagttgcagtgagccgagatggtgccactgcactccagcctgggcgaaaaagcgaggctccatctcaaaaaaaaaaaaaaaaagaacacctgtatcccttaagtaatcactttccattcctcctctcccctctgcccccctcccttccccctcattccctggcaaccaccagtctgtgttctgtctctggatttgcctgttctgaatattttatataaatggaaccatttcacatgtatccttttgtgtctacttctttctttgactcagcataatgttttcatggttcatccaatttgtagcatgtattttcttttccctttttttttttttgagatggcatttcgctcctgttgcccagagtgcaatggcacgatcttggctcactgcaaactccacctcccgggttcaagcgattctcctgcctcagcctcctgagtagctgggattacaggcgtgcgccaccatgcctggataattttgtatttttagtagagacggggtttctccatgttggtcagtctggtctcgaactcccgacctcaggtgatccacccgcctcggcctcccaaagcgctgggattacaggcgtgagccactgtgcccagcctgcagcatgtattagtactttgtttcttttgggggtaatattccattctgtatatatactacaatttaactgttcatctgttgatggacatttatattatttccatgtattggttaaaatgaataatgctactataaacaattgtgtacaaatttctatgtggacttaaatgttttaatttctttccttctttcttggggaggagacggtctcactctgtcacctaggctaaagtacaatggtgcaaacacggctcattgcaacttcgacctcccagacccaagtgatcctcccacctcagcctcccaaatagctgataccacaggcatgcatcaccatgcctggcttattttttctgtttgtttgttgtggtagagatgaggtctccctatgtagcccagccaggctggtctcaaactcctaggctcaagcagacatcctgcctcagcctcccaaagtgctgggattataggtgttagcctctgcacctggctgtgttttcatttttcctgggtatatatttaggaataaaattgttgagtaatatggtaactccatgtttaattttttgagaaactgccaaactgttttcctcacaactgtaccattttatccagcaatagtgagagtccctgttttcttcacattctttctaacaattaataattattttattatttaaagctttcctagcaggtatgaagtagtacctcatgcttttgatttgcatttctttaatgaccaatgatattgggcatcttttcatgtgtttcttggccatacgtatagctttttttttttttttttttttgagactgagttttgctcttgttacacaggctggagtgcaatggtgcgatctcagctcaccgcaacctctacctcccaggtttaagtgattctcctacctcagcctcctggcctcctgagtagctgggattacaggcatgcaccaccacagccagctaattttgtatttttagcagagacgggttttctccatgttggtcaggctggtctcgaactcctcacctcaggagatccgcccacctctgcctcccaaagtattgggattacaggtgtgagctaccgcgcccagccgttgtatagcttttttaaagaaatatctattgaaggtgccgattttaaaattaggttgtcaggccgggcacctcaggaggctgaggcaggagaatcgcttgaacccaggagggggaggttgcagtgagccgagatcgcaccgctgcattccagcatggcgacagagcaacactgcatctcaaaaaagaaaaaaaaaattagccaaatgtggtggcacatgcctgtattcccagctacttgggaggctgtggtgggaggattgcttgatcctgggaggcagagccaagattgctccactgcactccagcctgggtgacagagtaagaccttgcctcaaaaaacaagtaaataaaagactgacattcctatttatgtagataagttcattttttctcattgtactgtatttaccaaataaatttaagacaaaaatgcccttttttatagagtaacacagcatctggtggaatgacacgacgaaatacttatgtttgcagtgagagaactacagctgatagacactcagtgattcagaatggcaaagaaaacaggtaggagattctacctgtttgtaagaaaagttgtttttcccaagagaaatggaagcatgttatttactgctttgttcttataatcattttcaaattaaaactgtaagtattctctgaaggtaagttaaatttgtatactaatttttagcaagatactagaattctaaattctttttgttgtccagagcatcatcctcctgcctggctgtgtatgatgattaaaaggcttgagttaaacccagggggtttcctagaggaagtagatagtaagctgtggttatgttgtagaacagtgaataaggaaatggagattgtcttgtgctcattaataacttgaacaaaagccgaaagtgggggaagataaggacgtgaggcagagagtcatacctcaggagaatgtacagcaccaggtagcattaaaggtccgcagtttaccaaagggtccagatggctgagtctaaatagaaacactggagaagccaagagaagtggaaagtccagccttctgaatgcttttaatttggctacatagcaagcatacataggatgagcgtgactttaaaaagacaatgatgttacatgtcaataaggagagcatcctatcatgcacatgattttcttggggttttgaaataaaataagtagagtcagtaaaatgggattggataggtgtagagactctgaggtggggttagtctgggtggagagaaaagagaagttagattggtagagaatagctaaatatgctatattctgttcagaacaaatttcccaggctggcatggattttccttctttgtttttggaagagcagtaagtgtacatcattcttttaacttgaacattgtttgcatcagaattgttctgacatttactttctgcagttacggtgtgaggttctgtttcttaatcctaacctatgtttgatctcattagtcaaacaaaatgtttgatcactacattttgtgacagcctaatcaaaaattctctcctccttcatccttagttccaaactgcttatcacttccctgttccataggccacttaggattgagttgatatgaggagtaacatttgttctgtaagattatggttattattcgttgaatttttagcaatatttacattctcttgttctcttttatgactcgtgtgtgtgtgtgtgtgtgtttcaacattgtcttttcttatgattaaaaactactaagaacttgagtatagcagctggggtagatagtttacagataatgattgatataggtatttctttttttttttttttttttttttttttgagacagagtctcactctgtcacccaggctggagtgcagtggcctgatctcggctcactgcaagctccgcctcccgggttcacgccattctcctgcctcagcctcccgagtagctgggactacaggcgcctgccaccactcccaggtaattttttgtatttttagtagagacggggtttcaccatgttagccaggatggtctcgatctcctgaccttgtgatccacccacctcggcctcccaaagtgctgggattacaggcgtgagccaccgtacccagccaggtatttcttaatagtagtctactctctggtagatttgtattatagttcagttcttaactttcaaatttcttctagttcaaaagtgacttaatagaaaatatcaatagaagacttaattagaagtttctggtgttacagattgtagtctacaggactacagaaatgtttcatggtcaggcacagtggctcacacctgtaatcccagcactctgggaggccaaggcaggtggatcacttgaggtcaggagttcgtgaccagcctggccaacatggtgaaaccccgtctctactaaaaatacgaaaattaaccatgtgtggtggcacgcgcctgtagtcccagctaccagggagactgaggcaggagaattacttgaacccaggaggcagagtttgcagtgagctgagatcgcgccactgcagtccagcctggacaacagagcaagactcatctaaaaaaaaaaaaagttgtttcattacctttactacttctaaattctgaaaatgcactacccagctccttctgaactttaggatatgtgactgtctgaggtgcagagtcagtctcctcaagggtgttaagactaagatctgctctctgcttccatcctgtgctacacgtatcatacaccaggcacatgcatatatgcctgtgtcttctgattctcttttcctaaaatttttcgtttcactctttggaaataatatttaagacttctttaatttctttggcaatatttcctttctgcattccccctggagacacctgccttgttggggccaactctttcatatcctgacctgtctcgttgcttctcttagcatcagtcattgaaatactttgcttctgaaggtgtcgtctttctctttagtcaaagagagtctcaccgccaaaccttaaaagacagggcccattgttttaataatatttggactttcctttcctatcttataaatgaattaaaagactggaaaattattgggtttaacttctttagttaaggcactaaatgtgacagctttcccttaaaattgatgcttgagtcttcagtgagatacaattagctttccctgcacagatgacttcttcggcaaattgttccttttccctctcttcacccacccatatatcttatttcttcactaatttaaaatatgagtgagctgtaggatgcctggacctatgttaacttctgaaacaaacatgttaagttccaattttagccttaaatattttcgacatttagccttaaatgttttcttctttatatgagtgttcatacggaatttcaacatgagaataatgatggctgattttttaaaaactgtgtgaaggtttaaaccagagactccacatatcttaagcccttactaccttcaaaatcctactgtaaacaggatattttaaaggcttactaaatgcaaggctttttctcgtcataggcaatataattaattttaattattttttcttttgaaaattagttttattaattggttcttactaggccaatctttgttttatcagctttcctgtgggaacaataaagttaatgacacagggagcataggttagggccagttgttactttggcacaaacacctgtgattcgttttctgagactagttttaaactggtcgtgctgaaggccagcccactttctgctgtaattattctgccttctgatgttattctcgaaaaatggccagattccaggcgtgactaatggttggtgtaaactaggcatgagaaggtttgattacaccttcaattgtatgattctatcatgatggtataggtttgcagtgagtcttaaaccacatagcactgacacgtagtgagtgctcaaacaaatgttagctttcattattaattatagactgttcagacaaggttatgcagaattttcttagtttgcactgactaaacctaatctttcaagttaataatgttgctaaaccacctacatagcagagacactctgctcctacgatttcatatgctttagatacccggacgacactgtttagactacttcatttaaagaccccagagaagtgacgtgctggtgttacagtaatgcaaacagaatcttttcttttttttttttctttttttctttttttttctgcgatggagtctcgctcttttacccaggctagagtgcaatggcacgatctcgggtcactgcaacctccatctcccgggttcatgcagttcttctgcctcagcctcccagtagctgggattacaggcacacaccaccacacctggctgatttttgtatttttaatagaaatggggtttcactaggccaggctggtctcaaattcctgacttcaagtgatccacctgccttggcctcccaaagtgctgtgattacaggcatgagccactgcaccaggcccagaatctttcaaataaattttagatattggatattactgtaaagtttcaaaattgtgaagtggcttattattttatccactttaccctgcatcaagtcacatagagattgagcagagaaggattgaggacacttagcgtatgtatctttggactacatataaaagttgctttttttaggctgggcgcggtggctcccacctgtaatcccagcattttaggaggctgaggcaggtggatcatgaggtcaggagatcaagaccatcctgaccaacatggtgaaaccctgtctaaaattaattagctgggcgtggtggcatgcgcctgtagtcccagctacttgggaagctgaggcaggagaatcacttgaacccaggaggcagaggttgcagtgagccgagatagcgccactgcactccagcctggcaacagagcaagactctgtctcaaaaacaaaaaaaaagggctgagcacagtggcttacgcctgtaatcccagcactttgcgaagctgaggtgggcggatcacctgaggtcaggagtttgagaccagcctgaccaacatggagaaaccccatctctactaaaaatacaaaaaaaaaaaaaaaaattagccaggcatggtggcgcatgcctataatcccagctacttgggaggccgaggcaggagaatcgcttgaacccaggaggcagaggttgcggtgagccaagattgcaccattgcactccagcctgggcaacaagagcaaaaccccatctcaaagaaaaaaaaaaaaggctgcttttttttttttttttttttttttaagatggatggagtcttgcagtgtggcccaggctgcagtacagtggctagtcacagacatgatcatagtgtactgtagccttgaactcctgggctcaaatgatcctcctgtgttggcttcttgagtagctgggactacaggcatggaccaccacacctggctaattttttattttttgtagagatgaagtcttcccatgttacccaggctggtctcaaattcctggcctcaagggatcctccagtctcagccttccaaaacactaggtttacaggcatgagccaccatgcctgtccttggactatatttttaattctgcttttgcccagtcacttgagtatgcttttaatcagcagccaatacatttcttatcagaatgttctgataggggctagaggtcatagcaacaaattcaaagtgcctatcctttagtaaccttaagtggattaatgttttagaaaagatagtcaagactgggcacagtggctcacaagccctgtcatcccagcacttcgggaggcctagacaggaagatcacttgaggccaagagttcaaggtcagcctggacaaagtagcctgagacccccgtctctataaaaatatatatattttttaattttaaaagatagtcatgaatacaaaacagttgggaagattaataggaactctcttcatgcaacttgaattttaagaaaaacattgctatttctatcaattaaggtttaaatgtagaccaggcatgatggctcacgccaccatgtaatcccagcactttgggaggccatgacaggaggattgcttgaacccaggagttcaagaccagcctgggcaacatggtaaaattccatctctaccaaaaatacaaaaaaattagctgggtgccaggcacagtgcctcacacctataatcccagcactttgggaggccgaggcaagtgcatcacctggggtcgggagttcaagaccagcctggccaacatggtgaaaccccatctctactaaaaatacaaaaattagctaggtgtggtggtacatgccggtagtcccagctatttgggaggctgaggcaggaggatggtttgagcctgggagatggaggttgtagtgagccgagatcacaccattgtattccagcctggacggtagagccagacccagtctcaaaaaaataaaaataaaaaaattaatgtaatacagctactatgaacccacaaaaactttaaaaaaattttttaattattaaaaaaatgtaatgctgctactgttttgcttatgtagattgtgggctagaataggaaataaaactatcatttttaacacttttctggggggaaatattattcgaatttcataacaattagcttgatgaccttttagaatatatatgtagaccattgtgatgttggggctgcctgttgtaaataggatttttgtgagcttgattgtacaaaattgaaatttgcaaacatcttactgagtttactgtttccttctgggtgttaggcctactgtagaaatcagaaaaatcggaaatattttgttgcttgctttgtgaaactcatgatgtgacatggattaaatttctaaaaagtttatttaattgcctttaaaattagtatgtcaaaaagtttatttatttatttatttatttattttaatttgaaacagtctctctctgtcacccagactggagtttagtggcatgatctcagctcactgcagctaccacccccgggtttaaacgattcttatacctcagcctcctgagtagctaggattacaggggcccgccaccacacccaactaatttttgtatttttagtagtgatgggtttttgccatgttggccaggctggtctggaactcctggcctcaagcaatccacccgcctcagcctcccaaagtgctgggattacaggcgtgggccaccacgcccagcctcaagttaataatttataatcccagcactttgggaggccaagacgggcggattgcctaagctcaggagttccagaccagcctgggccatgacgaaaccctatctctacaaaatttttttttttaatttataatgagaaaataaatttacatttccttcttaggtctctagaggatccattttttttctgcaaagcatctgtccacaccctcttaccatgcttgtatgccttaaagatctagcttggcctgtcagcagtgtgcttcattgggaatcgatgcagcaccctcctgcctgcaagctgactaaaagccttttccttctccaaagactttgggaccatttgtattcaccagggaaagggtcaaacaactcctgcatcttcttcccctgcttttcttggcacatctactgatactagctcctaatttgggcaagaaaaaagtcaacaactggaggtagagtgtgttgaccctggactcaccctgaaaggtaagggcacaagagatagttgtatttagctgtatcttgttagaaaaatacatttgtgtagccaggcgcggtggctcacacctgtaatcccagcactttgggaggctgagccgggtggatcacgaggtcaggagttcaagaccaccctggctaacatggtgaaatcccgtctctacgaaaaatacaaaaaattagccgggcgtggtggtgggtgcctgtagtcccagctacttgggagactgaggcaggagaatggcgtgaacccaggaggcagagcttgcagtgagcagagatcacactgcactccagcctgggcgacagagtgagactccgtctcaaaaaaaaaaaaataaataacatttgtgtgcattcatgtgtacgtgtgtctgtacacatgtacaagaaacaaccgagcatttctttaaaaaccttagtcagttagaactgtctctgttgcaggtgacagaaaacccagtctaaacaggcttaaatataaaagggctgttagttcatataactaaaaaaagtccagggctagagttacggtccatctgcttctgcctccttggccgtagttccatgattgggctcggcaccatcagacataacttcttcccacacacagctgtgctcaagcagaagccctcaggtggtctccttgatctgtgtggggcctagagttacttccaccacagcaaaatctcattattgttgctgcaggaaaagaatggatactgagtggcagaaatacgaaactggataaatttttgcctttataagacatttgtttccagtccttctcagactgtataaattctcccaagtcagagagcagaattctcaaacaaaaatgcagggacagaaccaggcacagtggctcacaaggcctataatcccagcactttgggaggctgaggcagaaggatcagttgaacccaggagttcaagaccagcctagccatcatagtgagacaccatctctacaaaaaatttaaaaattagccaggcatagtggcacactcctgtggctgagataggaggatcgcttgaccccaggaggttgaggctgcagcaagctgtgatagtgccactgcactctagcctgggtgaatacagcaagaccctgtctccaaaaataaaaatttaaataaaaatgttttaattcagggacaagcagttcttgattttaaagacgtatctgctttatgttggggctatcagaattccagttgctaattgattaatctgctctgttaggagaacgtttgttgaatacctgccctgccaggctttctgcttacactggtggggggcacattgacaagattttgggctgtgttttcagggacctccagcagagaagggtcactaggatacaatgtggcatgcatgagctaaaaacagaagtgatttaactctcagagggaaaatggatcagataacacttcatagagatgacgacatctggttcatttttgaagagtgaatagaaagatcccagccctccataccaagagaataactcctgcaaacattttctgacctggtgcctgaccaatggaccacacatcatcaggaaggctagaaagttgagttccaggagggaatgatagaaggcaaagcctagagagatggcaggggccagacttcaggggcctggggatgtgtacttgcactccaagtcgaggagactgaactttttaccaaagacttggtgttctgtagaagtatgagcagatgagtgacaagatctggtttatatgttaagaagttctcagctgtaaggtgaatagattggaggtgttggggcaaaggcaggggacccagtgaagacaaggagcgaggctctatactgaggccctggtagaagtggagcagatgggccacctgaagagctactaggaagttgacaccaataagatgtcgttagtctgtgtatggggagtgagggaaaggaagaacttgccagtttccaggttttaatccttccaaaggatttctgcagaaagacactggaagagctgtattcctacttatccttaaaggaaagaaactgcccttgaattccaaggacatgattactgagctggaattccaaataatgtgtcccagtgagactcctgggggtagttttgtccggtaactgtgtgtgttagatgaaactgcagacttccagccactctatcttaccatgtctgttaacagttaatttgctctgatgaatttgcccatcttggagaagggggctctgctgactgttttttatcttggagtaaatgtcctttgattaggaaggttctagactatattgttaaaacaacattggaaggctgggcatggtggctcatgcctgtaatcccaacactttgggaggccaaggcaggcgtatcgtttgagcccaggagttcaagaccagcctgggcaacatgacaaaactctctctactaaaaatacaaaattagccaggcatggtggagtgcgcctgtattcccagccacttaggaggctgaggtgggagaaccacctgagcccaggaagttgaggctgcattgagccatgatcgtaccactgcactgcagctaggtgacagcaaaaccctgtctcaaaaaaacaccaaacaacataggatactgttatataacagctagttcctatacctgtaatcttattaattcatttaaaatacatcagtgcgggccgggtgtggtggctcacacttataatcccaacactttggaaggccaaggcgggaggatcacttgaagccacaaatttaagaccagcctggataatatagcgagaccctgtctctacaaaaaaaataaataaagaaaaaataaaatatgtcagtgtgttttgggaacaggttgagagcatagcatgctcatattatatattcattttaccacttagatttgaattgaggcatctcttagaataggttttattttgtgcataccctcagaggacattgtccctctcatagaaacagatattcaaacatgtaatctgctattttattttaaggtaatagatttttatgattactgtttggaaaaaaaaaaaagcaactataggttagcagttgctccagaatctccaaaacaagcttaggagatttttattctttaccagaaatgagatggcttgggaggaaggtgtgtgcattacacacaggttgctctgtggtcactgctccttcatactgtgtttctgcctctgcctgaacccaaacccctcccagcctgacagaaatgttcgcttacgcagctagccctgcctcagtttgtacatctacctgtcggctgagacatcagaagtcgatgtccatgtcagcctctgggcaccccaagatgatgttacctccaatagacagtgaaggagataacttcaaggctatgtaagaaaaatgcacattctttgtgaaactaatgtgtacccactgcttcttaattttgtgctgtggattttatagtctgagattttgttacagttgtccacaaggcgtccttcctccatgtgattttagttaagcacatcttttgtcatgatgtcctcggttgtgtattgtgtgtcttcgtgccttcgcgtactacaaaatgtataagaagttcctgctcctcccaagttgctttcagcatgtggaattttatacatatatcatttgtttacttccaaaactttttagttgcctgttcttcagttacgccagcatatcctttatttctttcgtattggcacagttctctatgtaagcaatttgagagggaagcaaaggggaaaagtttgagttagctgttctctgtcctagaatttccctgcattaatcttgtccttgaaaatatatataatactggtcccttaaactccatgaggctttgtctcattatgtattgttcttttggtaccctttcccacttaacttaccttttgctcctaagtcctataaaataccccttggatctggattttttatacccgattttctccactgtgtataaaaggtatattgtgactgtaaatttttgtatatcatgttctgagagcttcttactttctgatctcatagcactattcctgatcagagaactccagttgcttcaacacacagtatcagtagtgcagccaccccagatcgaatccgcttcccaagaggcactgccagtcgtagcactttccacggccagccccgggaacggcgaaccgcaacatataatggccctcctgcctctcccagcctgtcccatgaagccacaccattgtcccagactcgaagccgaggctccactaatctctttagtaaattaacttcaaaactcacaaggaggtaagtgctaggtgctggttgttttggagtgaacacatagagcaaaaggaaagatgtcttttttgttgtgtgaagccactgctacctggatgcttttcagtctgccttcagctcatggttttctggttttatatatatctaactttatactttaaaacctttaaagtagaaattgtagagctcagagtcttcataacactaaaagttaactagcatttaggaggtttttgttactgttctttaattattgttccttttgctcacgtatctgtctgcatggcatgttcgttgttgttgagcaggcagacctcgagttctggtgtggggtggggggctggcactctgtaacaatcagcaggaaagaccatgcatgtctttcataatcatctccagccccagaggaaagagacagcttctcttttctcactttattgttgttaaggagcagtaaatttcttaagagtccaaatcttgaaagtttctctctcagtcttagtaatttatattgagagcaaggtaatgtccttaaatggtatagttttggagataaaatctctggtttattatcaaaaaataatgttactattattaagttatttttattaaatgctgcatgattcttggctgatggtcctggaaattttttaaaatgttccatgtgtctagtaggctagcatctggggcctcagtaaactctcaagggtcctttgagattaacttcatttccgtaaccttgttacctgttacaaaagcccagaaatactggctgcttcaagaggaaaaagaaaggataccactttgaaccgtaaacaatagtgaaaggcacctttccgagaaggagcccaggaaacccaagagcccctgcagtttcaggacatccttggagaaatgttttgaaattaagcctagctgtggatgagtctgtctgtggtatcttgcaggtttgcctaggacggaccctcttatttgtcatctgtagcttacaggacagcagtaggagtctttcccgagtctgaaatgatcagtaccctcctctgtttttctgcattccctatggcctatagcctattacttcatttcactccatctccattatttaaactaagctaaatgtaatcttgtattcgatcatctgaaacttcggtgagtcacattaaagtctgatctacttattattaggacatggaatagattagggagtattccttttttttttttttttaattttttttttttttttgagacggagtctcactgtcgccaaggctggagtgcagtggtgcaatcttggctaacttcaacctccgcctagattagggaggatctctgacatccattagcattaactagaagtcagacgcatcagaaggtttctatttaccctcttactcacttcttagcccctttattaagccacctcattttaaactgggcaaaacagaatcagccaaagagctttgccaggtttgggacacccattcatgaccagccagcaagagagacagtgagttcaatctgagaagagtctggtgactcccagaataaaccattccttcctggccagccgtggtggttcatgcttgtaatcccagcactttgggaggccaaggcgggtggatctcctgaagtcaggagtttgagaccagcctgaccaatatggtgaaaccccatctctactaaaaatacaaaaattagccaggcatggtggtgggcgcctggagtcccagctacccaggaggctgagacaggagaattgcttgaacccggaaggcagaggttgcagtgagccgagatcgtaccactgcactctagtctgggtgacaaagtgagactgtgtctcaaaaaaaaaaaaaaaaaaactttgagtttatttttcttctttgtactcttttttcagtcattttaagactagtattgggctgggccggatggctcatgcctgtaatctcagcactttgggaggccaagaggggcggatcacctggggtcaggagtttgagacaggcctggccaacatggcaaaaccccatctctactaaaaatacaaaaattagccaggggtggtggcgctcgcctgtagtcccagctactctggaggctgagccaggagaatcgcttgaacctgggaggcggaggttgcatctagccaagatcgcgccgctgcactccagcctgggtgatgacagagcgagactccatctcaaaaaaaaaaaaaaaaaaagactagcattgattggccaggcatggtggctcacgcctgtaatcccagcactttgggaggccgaggcaggtggatcacctgaggtcgggaatttgagaccatcctagccaacatggagaaacccagtctctactaaaaatacaaaattagccgggcatggtggcacatgcctgtaatcccagggagactgaggcaggagaatcacttgaacctgggaggcagaggttgtggtgagccgaggtcacgccattgcactccagcctgggcaacaacagtgaaactctgtctcaaaaaaaaaaaaaaaaaaaaagactagcattgattttattacatgtatataatggaaaaaaggaaacaagattatcattgataaaaatatcagctacctctttttttttccccacagagtctcactttatcgcccaggctggagtgcagtggcatgatctcagcccatggcaatcttcgccttccaggttcaagtgattcctgtgcttcagcctcccgagtggctgggactacaggcgcccaccatcgcgcctggctaatttttgtatttttagtagagacccggttttatcatgttggccaggctggtcttgaactgctgacctcaagtgatccaccgcgcccagccaaagctaccattatttgaatgcttattatgtgctaaggtagatgtctatatacatagatacagtcatattcattttatacatataaatatgtatgtacattatatatatgcatattttatgtataaaatgagtatcatatatatacacttatatgtgtgaaatgagtatatttatacacatgtacaagtgtgcacacacactcatttaatttaatctccatagtccaccccattttgtaaaagaaactgaaggtgaagtttggagagattaaggcacatattttaaaaagtatcagggcctggtgcagtggcttacgcctgtaatcccagcactttgggaggccaaggcaggtagatcaggtagatcactcaaggtcaggagttcaagaccagcctggccaacatggtgaaaccccatctctactaaaaatacaaaaattagcttgatgttgtggcacatgcttgtaattccagctatttggaagggtgaggcaagaggatggcttgaacccaggaggcgtaggttgcagagagccaagatcacaccattgcactccagcctggcgacagattgacactccatctcaaaaaaaaaaaaaagtatcaggctgagccaggtctatctgaccagactctgcccttttagccactacactgtgctccctttagaaaaaacagttgcaggcgtgacagttgcattacatttatttcatatatttgaattaaaattggagactcaggcttgttgtttaaaaaaattctaagtggtcatcttgtttacaatttccaggctatttccacacccccagatttttgcagaaagatagtcttttatcctgtcttgttaaagtttattaactgaggtctgttgtctcccttagtgctatacttaatcagctactgacagtttgttcttaaaaacaatcaaaatccttgctagagtggttgaaagttcttatcctcctttagcaataattggtaggattaaaattgcattgcctgaaaggctgaggtgtttgcacttagatgctgcaagggagacctggtgtggccaggtctggagagggctgcagtcaggaagcctgcactctgcttggagagcacatggctttggagagctatgggctatttgtagtcgggagcaaaactctctctccttaggatcaggcctggccttgctcagagactgcagagtcacccataccctgcaggcagaacagccaggcacacgcaagtgcctctgccctcaggttgatccatgttgccatgggcagtgtgaaggcctcctcctgcagctgcctccttcctctttatacctcaagggattataggaggaaaagttaagaaaagcacttctatagtaattgaccagtaaccctgatttttccggtggaagattaggaaatgtccaggcaccatggctcatgcctataatcccagcactttgggaggctgagccacatggatcacttgagcccaggagttcaagaccagcctggacaacataatgagaccccatctctactttttttttttttgagacggagtctcgctctgtcacccaggctggagtgcagtggcacgatcttggttcactgcagtgtctgcctcctgggttcaagcgattatcctgcctcagcctccccagtagctgggactacaggtgcatgtcaccacgcccagctaatttttgtatttttagtagagacagggtttcaccatgttggccaggctggtcacaaactcctgacctcaagtgatccgcccacctcagcctcccaaagtgctgggattacaggcatgagccaccacacccagccttttatttttttaataaaaagaaaaaaagttgggaaatgggccaggcactgtacatggctcatgccagtaatcctgacactttgggggaaggtgaggcaggaggatcatttgaagccaggagttcaaggctgacctgggcaacataatgagacccccatctctacaaaaacattttttaattagccaggagtggtggtgcatgcctgtagtcccagctacttgagaggctgaggcaggaggattgctcaaacccaggagtttgaggttacagtgagctatgatcacaccactgtactccagcctgggtgattgagcaagaccttgtctctaaataaataaatatttaaaagtaaaagaaaattaggaaacgaaaatatatcttaaagacttttaatcattttcaactaaaatattttggataatactgccttatatttaggcagtatatattaaagattttcacatgcatgattgtactgtcgatgaccctgctgtatactactgatctgattatgaagtggttggcagttatttatagtagttagactttttttaaattggtagattaatacctaaagcaatgccaaagttatcccaaccaaggatttcattaatttagtcattcagcagatatagatgactgcctgctatgtacagttacagaactggactttacaaatagaaattaacaaactcagcctatttttgcccagggaagctgatcgcattgatcataaaaacctcattcgtagtttgaaaaatattttgtcagattattttcagcacaacctgcacatctccttaaatttttttaatgaccagagttaccccttttaaatagaattcttcgtgtttactacataaaagtaaaattcatactgttgtcttgacacttagtttttattcattttgagatctaagactgaaaagtctacttgtttaaatccccaatcacctatttttttcttaaaaagtgatttatgtcataccactgtagcaaataatatgttaatgtttgtttcattttcctgaaagaagtaatgatttttacttagtggttaaatattttataatgaaatttttaatgtttatgtaataaggcaagatttttgttcataaggtattctgaagaaaattgaaaaatgttttattactagtacattgcaaatgtcttgtcacttctttaacataagacataaattttatcttagaaagtgtatctggccattgcagtggctcatgcctgtaatcccaacactctgggaggccgaggtgggctgatcacttgaggccaggagttcgagactagactggccaacatggcaaaaccctatctctactgaaaatatagaaattaactgggcatggtggcgcgcgcctgtgattccagctactcaggagactgaggcacaagaattgcttcaacccgggaggcataggttgcattgagctgagattgcaccactgcactgtgacagagtgagactctgtctttaaaaaaaaaaaaaaagtgtgtccatctgaagaacttttaattacagctaatgtcaatatgtactgctaaaccttttcttacttttttttgatatattaaaagatcacatactcatttaattacctgtaataattttactttttcaacaaatgtcagcatttctttgttcattggccagagaaggaaccctgctttgttttttttctttctctctgtaattgattagattttctgtttaatttgtgcgagttatttttgttaatttttttttttttttacttaatttcttttagaaacatgtcattcaggtttatcaaaaggtaggatttatatatacacatttatttttcaatcctcactcccaaatggctcctgcaattaacattaggtttggctttctggccctgttttttccttataaactaaactttctgctgataactaaatacttaattccttgaaaggaaattgaaaagaaatagattaactctgtcaggcattttaaagggactatggtacccatgcaacaaaaggctgatgcatgctctgtgtattttctttctttggtagaattatttagcatccaaataattctgtcttcatactaataacacttagcatgctcctgtttgaagaatgagatgctcagtaatgttaatgtacaattaatgattatccacaggcatgcaaaaggtaagtattagttgtgttatttttatttcactgaggatggaattagcaaaaggctttaaaatgacaggaaaattagctaatacagaaaacaagcataaaattcaaagctacagcctcatttgatttggctttttcagaaattaaaatgtgaacagctgcgtagcagaaatgttttaatattttcagagttgaaagccactttccagcaaccactgaagaaagagtatctcattatttttacttaaagcactacagaaagtggtgttctgattttattaatattttttaggccaggcatggtggcttatgcctgtaatcccagcactttgggcggatcacttgagcccaggagttcaagaccatcctggacaacatggcaaaaccccgcctctacaaataatataaaaattagccgggcatggtggcacgcatctgtggtcccagctactcaggaggctgaggcaggaggatcacctgagccctgggaggtcaaggttgcagtgagccatgatcatgccactgtgctccagcctaggggagtgagaccctgcctcaaaaaagaaaaacatattttttgatggtgataatcaagaaaccaaaaatattgctttcttaatgcacacatgaggcaggaaatctttcctgaagggctacattgtacctgtgcctctcaagtcaccagaaggccaagctgcaggtcaaaactgcgggaaaagcactttcttcctgttggcagttccattctattattattttttaattgatcttcccacttgtctgatttttccttggacagaacaggtaataactgaatatagaatccagctgatagcctcattggcttttaattggaaacccattatactgtgtggcacaattagaaagtgagaataaccccattctgaggccgagtgtgctcaggctgaagagccagcaggagtgcccgctgtgcgtgcgtggtgtgcggtgtgtgcagtgtgcagcgtgcagcggtatggcatgcaatgtgtgtgatgtatgcagtgtgcagcatggagctggcccctgtgcacacccctgcagccttgtggaagaaggtagcgctggctcagtcaaatgagaggaagagttttcataagcccggctggtgtttaaaacgtgttttggctttgttcattttatggtgttggtgttggtattggtggtcatgtactggcatgtaagatttcttttctctttccctcttctctctgcttctacattctgttcattgaggcttccaactgaatatgagaggaacgggagatatgagggctcaaggtgagggaaatgatttttacttaaaatttttttcaggtgtttacttcatttctgtggcagaggcgactattttctgaatgttccctactgtattcctgctgtctctgtaggagttacgtagagagggtggccacaagggggcgccagcctgccatgagcaccgtccagatccagcttggcctccgctctacatttgtgtttgtgttcaaagcacggcgaggccttcagccttcctgcctgggcgttaacagcctttggaggtctgggttgggtagcagtgctcagagaaataagccctcagttcatcactgacccctcacatggttctcttcacaaggaataaaagcaaagtacttaatagaatgtccatatttcaaactagatatgttttcttctaagaatggtgattatatagttgagtgttttgcttttcttttttttttttctgagacacggtgtcgctctgtcacccagtctggagtgtagtggcgtgatcagggcttactcgagttcccaggcttatgcgatcctcccacctcagcctcctgagtatctggaaccacaggcactgccaccatgctggctaatttttgtattttctgtagagatgggggtctcgccatgttggccgggctggtctcaaactcctaggctcaagtgaacctcccacctcaacctcccaaagtgctgggatgacagacatgagcccccgcacccagccttgcttttccattttgtatagttatcattgcatggatttgaggggaggcaatcaccaggtagccttaggactctatgtcccttgttctaggtctcttccacttgtgccctttttttatgccagtcaccagcaggctatttcaggtcctcattcaccgtttgtccttttggtctttctaaaagcccgcttctggtcatatgacctttctgaattaaaaccttcagtgacctccactatttcacctggccacgtccctgcgaggccctgagtggcgtggtccaggctgccccagcagccccagctctgctgccccatcaaggcagagcactagggtgagtgccaggcagcattccctctccaggcctacccatcccagccaggagcaggctctagatcctggtttgtttccccacccataataggaaggtgacataataggacctacgtgggcatcaagtaagttggggcctgaccaccacaagtgctcattaagtgccaccagctgttgtgggggtgatgacactgtgcctccagttccactcagtctgtgtactttattatgccacagacacatcctgtactttcctacctcccctttggctgtgatcccctctactcaaaacaaacactcttccctatcttcattgcattttgttgaaatcccatggctcttcatagctctcctcagatgcaggcccacccccacccgtgctgtttcctccttgtctcatcctgcctgtcacgttctcctgctcggcgggctccacctcttctgctgccctctaggagatggccagcctttcctgtgctgccactgttgtctcaccttacagtcttcctggctccagatgagtttgagagcttttgcttatctttgtaacccatttagtatctaacgtggcattttatacataggaagcttctctcatcagtattggtggatgtgaaccaaattgaatactggcaggttggtgacacggagagctatgtgcatatgcaaaagctgtagcccctcacctctggttagttggccataggatggagtgtacttaaggtacatagactattttactcccaagaatgctaggcactcactgtcttaattgaggccaccagatacacacatgagaatataaataacggcttgtggcaataatgactaaatgccaaggagtggctggtaaaccgcggtgttccctagagaccccggcctgggctctacttaggctgcctcttggacatcagaccaaggcttacattctgaatccacagggcatccacatgggtggtgtcagtcccccacagacagagaagtgtcccgttgcatttttccatctattccagtagtaagattgtgtcatttgagattttctttaactgtataattggacgtttaattaacaaaccagagaggaggaaaaacaatgaggtgggtagagcatcatgttcagcctcagggctgtacagcaaagcaattttagactgcggatgttgagtctccagttaccctgagtgccagttacagtgattcacatctgaaagaacagtactgcaggagagggacagcccagggtggatgggtggggtgggcaggagctggctggcaactccttccctgagctgggcctgcagagccctgaggagtggggcatgctgtcctttttgcctgatttccaaggattctgcttaacgaattacttcgttcattttagtaagcacaggtggctggtgaagattttccagctaggtagatctttttgtgtgtggcttatgacttttagggggtgagggaagaaaatagacgaaaatagacttagttacaaatgtgagtctgtgcaggaaaatgtggaggtcagtcgttagttgtgttgtatcaaagacgtgaatgaggaactagctgaagtgtaagaggttgattttcctgtacgattaaaaataaacctgcctctatgcatttcagtcgcaatgtatctgctgagcaaaaagatgaaaacaaagaagcaaagcctcgatccctacgcttcacctggagcatgaaaaccactagttcaatggatcccggggacatgatgcgggaaatccgcaaagtgttggacgccaataactgcgactatgagcagagggagcgcttcttgctcttctgcgtccacggagatgggcacgcggagaacctcgtgcagtgggaaatggaagtgtgcaagctgccaagactgtctctgaacggggtccggtttaagcggatatcggggacatccatagccttcaaaaatattgcttccaaaattgccaatgagctaaagctgtaacccagtgattatgatgtaaattaagtagcaattaaagtgttttcctgaacactgatggaaatgtatagaataatatttaggcaataacgtctgcatcttctaaatcatgaaattaaagtctgaggacgagagcacgcctgggagcgaaagctggccttttttctacgaatgcactacattaaagatgtgcaacctatgcgccccctgccctacttccgttaccctgagagtcggtgtgtggccccatctccatgtgcctcccgtctgggtgggtgtgagagtggacggtatgtgtgtgaagtggtgtatatggaagcatctccctacactggcagccagtcattactagtacctctgcgggagatcatccggtgctaaaacattacagttgccaaggaggaaaatactgaatgactgctaagaattaaccttaagaccagttcatagttaatacaggtttacagttcatgcctgtggttttgtgtttgttgttttgtgtttttttagtgcaaaaggtttaaatttatagttgtgaacattgcttgtgtgtgtttttctaagtagattcacaagataattaaaaattcactttttctcagtaaaatcttgcattgtctcctaatgctgtatttaacacatcctcaagttgagcagaagtaatgtgtatgaaggcttggggccacgtggaccttcgcaggggtcccagcattttgtgattaccagcatattttttctcccaaggcaataaagagagaagatggccctcatggtgacccaagaaggaagggaatccagagcagctgcagcttaaccctgggagttgtggcacagccctatggagaaacaccaggtcttgacagttctgggttggttctctgtgaagtatgtaaatttcctttctcctttcttgtgattcagtacatgaatcagacctgcagcttttgtccaacacctacatggttgtgtaggggtaatgagctcataactcattgtgttgctttattctcacagggaagttgtcacactgattggtgtgctattctgggttctgggtttgttgttggtcagagtatgaaagtctggaggccggacacagtggctcacacctgtgaacccagcacttttgggaggctgaggctggaggaacattgagtctggtagttcaggaccagcttggacaacatggtaagaccccatgtcttcaaaaaataaaaacatgggccaggggcggtggctcacgcctgtaatcccagcaatttgggaggctgaggcaggcggatcacaaggtaaggagatcaagaccaacttggctaacacggtgaaaccccgtctctactaaaaatacaaaaaaattagccgggcatggtggcgggcacctgtagttccagctacttgggaggctgaggcaggagaatggcgtgaacccgggaggggagcttgcggtgagccgagatcgcgccactgcactccagcctgggcgctagagcaagactccgtctcaaaaaaataataataataaaataaataaataataaaaacatcagccaagtgtggtggcacacctgtggtcccagctcttcgggatgctgaggtgggaggcttgagcccaggaggttgaagctgcagtgaactgtgattgtgcacagcactccagcttgggcaacagaatgagaccctgtctcaaaaaaaaaagaaagaaaaaggaaaaagtctggacagtcaatcagaaatattgttgtctctctctagcgtgggcaaggcactgttgtgattgagatcctcagcaaaacagacacctctctccttgagcctgacattctaggcagtggataaacaagtaagttacctagtatggagcacagcagcacgtgtgagagagcgcagagcaggcacgggtttcatcagcactctgggtgtgaagagtgctgcttgggcagaggcctgggtgggcacgttcacacagatttctggggaagagcactgcttgggcctgaggcctgagtgcatggcgtgcctggagcagagcgtagagatgcttctcctacatggcagcagctgaggggatgacaagggccttgtggccttgggctttcagaggatcaccaggcagctatgtttggaactcactgaaatggggcaaggagaagctgggaaagccgcctggaggctctcagcagtaatacaggcaagaggtagtgcagccttgggtgaggatgggccttggcgctgatggtggttgggttttggacatgttttgaaataagaggcaactgcattttccctggagttggatatgaggtgagtagagccaaggacagcttcatgatttttgatctgaacagcaaaaaggccggaattgctgtttgttgagatgcggaatgtggctggggagatgtttgggaacaggaggggaagaagatgaagagagcaagctggaatgtgctgagtttgaagtccctttaaacactgagtggcaacgtctagtgggcagttggataaacgtgaggggttcggccaggcgcagtggctcactcctgtaatcccagcacgttgggaggccgaggtgggtggatcacgaggtgaggagatcgagaccatcctggctaacacggtgaaaccccgtctctactaaaaatacagaaaattagccaggcgtcgtggcaggcgcctgtagtcccagctactcgggaggctgaggcaggagaatggcgtgaagccgggagacggagcttgcagtgagccgagatcgcgccacagcactccagcctgggcaacagagcgagactctgtattaaaaaaaaaaaagtgtgagggttgggagaggtcgggtctgggagagaccataggaagccctcagcaggtggaaggctcctgctcaaagctgtgagacagaggagaaaccaggactgagccctggacacagcacggggagaggccccggggagaagaagtgaagctggcaaggcagcagcaaggagggagggccctccaggtgtcaggcaggtggacatcatgacctaaggctcaccttgcgggaactttctaacttgacttttagcaagtaagtccccttccctctctctgtccagtgcctttcagagtggagtcctctaacggagctgattgtgcccagtcacagacagtgaggacttccccagctttttttgcctggtgcaagctggtttttatatcccattaaagcatcataaagccaacccggacaagagaattgggatgtctctctgcacacatgagcctttttgtttgtttgtttgtttccccggagacggagtcttgctctgttgcccaggctggagtgcagtggcgtgatctcggctcactgcaagctccacctcctgggttcttgccattctcctgcctcagcctcctgagtagctgggactacaggcacccgccaccatgcctggctaatttttttgtatttttagtagagacggggtttcaccatgttagccaggatggtctcgatctcctgacctcgtgatccacccgccttggcctcccaaagtgctgggattacaggcgtgagccactgcgcccggcacacatgagcctctttaaggagatctacacacagacttctctccccctttgctgtccttgtctgtcactgtcccttctgctgagcagaaaaccaaggagatgttctgccataaattacttcctcctctgggtagatgtttctgagctgttctatgaaattcatgactacgaaactgacttccttaagattcctaccccaaggccaggcgcaggggctcatgtctgtaatcccaacaatttgggaggccgaggcgggtggatcacctgagttcaggagttcgagaccagcctggccaacatggtgaaaccccgtctctacaaaaatataaaaaaaaattagccaggcatgtggcgcacacctgtaatcccagctactcgggaggcggagacaggagaatcgcttgaacccaggaggcgaaggttgcagtgaaccgagatcttgccattatgctcaaacctgggcaacagagcaagacttcatctcaaaaaaaaaaaaagattcctaccccagaaacacccatcacagcaggttcctgtgcataatttctgcagaggtggagcagagccctgccaagcagaggctgggccacagcggacttcctcttccttatctttgtagctgggactgattttgaattgttttccatttttgcattctcaaggacacattgagtactagaagttaaattcctttaagaaaaatgagtttctggaatgccctgatgcagtggccactctttatgctcgtattttcttgaggggctcacttgtcataagcagtggctgcgttttaatgtgttacttggtcaaataaggagtgcgtgtctcagagactagtattcatccacagaaagttacccaagtgcgttatgtttataagactatgttactaattgatcttggcttgattttcatggcaacatgggtagtattccctttacgaaggttaaaatgtgaaaactcattcattactaaggttccaggccctttctatagattctccattctcagaatgtgacatttttattctgcatacaatgaattttgaaaagggatattctacgaccattgaaaatcaaaagagactgcatttttccctcatcaaccacctggaaatctctcagaagtgaggtgagacacctagtggggctgtgctgctggtttgatttacctgccaagcagagcattctcctaatcctgacaatggtgttcctcttcgttgagtgccgacttccctctcttctacatcaggcacattagaggaaccaaaaccatactcctacaagtaagtgaggtgcccagctctcaggccacctttgcatttctgaaagtgagggtccatgcagaaaactgttacagaaacatgactggcttttaggagcacagccgtgatcattttcacagcatatgcttctccaaaagcctagacaataatgatttctattttattttattttatttttttatttttttaagacagagtctcacgctgtggctcaggctggagtgcagtggcgcgatctcggctcactacaagctccgtctcccggcttcacaccattctcctgcctcagcctcccgagtagttgggactacaggcacctgccaccacgcctggctaattttttctattttttagtagagacggggttttgccgtgttagccaggatggtcttgatcacctgacctcgtgatcctcccgcctcgacctcccaaagtactggaattacaggcgtgagccactgtgcccatgatgatgcttagaataatgatatttagaagaaaaacctccatacatgggcctgtgaataaattatagtcactatggaagctgcgtcaggcagcccctacccagtaagcgaccttcgtgctgaccttcaggtctgcagagcagttgccccttccatgggtgtggcaccaggcagagcaggggcagaagaggggtgtttcccacgcactgtcccttccagtccgtctcagaggggcatcaaaatgagaaagagcttgtgctcaagagttgaaaccttacgactctgttgcaggttttttgtttctttcattgctggtttgccacgcagctcaggggccctttagacgggagagattgttgctcttcaagggagtgaagtgaagatggtgccttagaggtgttctgacagtgcacggggagtcccggagtgactcctccatgagtggaaggaactcagtgtcattgccagtcgaggagaaaggaaacagttcaacagctatttttgtttgttttgtttgtcttgggtttgttttgtttcgttttgtttttgagacagggtttcgttctgtcacccagactgaagtacagtggcgcaatcacagctcagtgcagccttgacctcctgggctcaagtgatcctcccacctcaacctcctgagtagctgggaccacaggcttgtgcccagctaattttatttttcgtacagacagggtcttgttctgttgcctaggctggtttgaattcctgggctcaggcaatcctcctacctcagcctcccaaagtactgggactacaggcgtgagccacctcacccagccccaacaactatttttgaatggttccttgaaaagttccattaaaggccaggcacagtggctcacaccaataatcccagcattttgggaggctgaagtggatggatcacttgaggtcaggatttcaagaccagcctggccaacatggcaaaaccccatctctactaaaaatacaaaaattagctgggcgtggtggcatgcacctggagtcccagctacttgggaggctaagacacgagaatagcttgaacccaggaggcagaggttgcagtgagccaagattgcaccactgcactccagcctggatggcagagccagaccctgtctccgaaaaaaaaaaaaaaaatcacacactaaccctcttctcttcctccctctcctggcttagccagtgcagtcaagtccttgaatggcgtgctccctggccctcaggagaggacattgcctatcgagtggagacttggtaaggaaattgttcccatttctaagatggagagttctggactctggaccttctattaggagtttacaggcctgtactgccacctccctgggccagagcttttgcagatattcctagagaacaggtaaaagcaatgagcttggggtaagagcttagaccaactgaaggctctctgcctccctcctcctctaagaggcctgccctggctgtgacaccaaaaagcgcactcgggcctctgtgcccaactctgccctttcaccatctgcccctgtcacaccaacgtcagcatgagttacacagttgtgttgccctttgtggctactctccccacacttactagaatgtgagccccatgcggcagcgatcttcatcctttttcttttcctctattccaagtacctagaatagtgcctggcaaaggcacttagtgcacaattagtgttttttaaaaaaaaaatgataggaagcaagcaggagatacatagcaagtacaagacattttcagtggcttgcagtcaaaagtgtcactgaggtccccccagctgcccctgccccggctggcccaaggatgagataggtggctgctctggggtcatgtcttgctttatagcctggcctgttgggtctccaggagccttttgagtcttgcctgtttgacagagaagactgaggcccagaggacggaagggatgggactggcacccagtgagcttttcccttcatcaagatgcttacacaggtgatgtccatcattcagcttgggtcaggtgcagaccatgcacgtggtggtggtgcgtgcgatggacatgaagtagctgaccctgtgtagagatgacatttcccatcgggtgtggaactgggagttcaaccctttggcttaccaccctaatctgcatccacactagagagtcacacagcccaggtagtatttggatttcaaccccgggaaagaatagcaacctgccgcttggtggcagcatgggagctggggtttagtgaggaggggaagcagttgtgtaggcatcagcagtcatagcaccaggccgaggcgagaccctccgagcggagtccggctggttaaagggcctgcacgggtctctcacagaagaaggaaagctggtcctgagggtggagccaggggaatctgggggccacttcagcattctttgttgccattggctttggttcagtaagctttgttgatttattttgttgttgttattgttgttagagtgatggggctgattgcttataagttctgaggttcttatttgcgtttccagctccctgggtattcattcatacctggtttctggctgtggtgaaatgtcttctgaccaagtgggttgataaacagggggcttcgctggagcgggggcagggggcgcggtcactgaacagagaaaaaactcaactcatcctcatctctgaggggactctttcccccagccagtgccttctgcagtttcctgctctatctatattccacccacttaacccacctctaagagttattttaaaacagcattctagaacccatctctcaagcaagagggaagtctccaatggctcatcctgtgccccgcctgcatctgcgggcacctgcagtgccgggacgctcacagcccgcccccaggacctgtggggggagttcagctgcttcggctgcttctgctgctccgcgtgcacatgggcctccttaccaccctggcagtctcctcctcttggaagttttaactattcaagactcaatggccaggcgcggcggctcatgcctgtaatcccagcactttgggaagctgaggcaggaagatcacttgaggtcaggaatcgagaccagcctagccaacctggtgaaaccccgtctctgctaaaaatacaaaaaataataattagccaggcatagtggcagtgcctgtaattccagctactcaagaggctgaggcaggagaatcacttgaacctgggaggtggaggtcggagtgagctgagaccacgccactggactccagcctgggcgacagagcaaaactctatctcacaaacaaaaacaaggccgggcacagtggctcacgcctgtaatcccagcactttgggaggccgaggcgggcagatcacgaggtcaggagttcgagagcagcttggccaacatagtgaaaccccgtctctactaaaaatacaaaaattagccgggtgtgttggcacgtgcttgtagtcccagctacttgggaggccgaggcgggagaatcgcctgaacacaggaggcagaggttgcagtgagttgagaccacgtcactgcactccagcctgggcgacagagtgagactccgtctcaaaaaaaaaaaaaaaaaaaaaaaaaagacaagtatttgaagattaaaaatgtgttccctctctgaattctttttttttttttttttttttttttcttccagacagagtgtcactctgtcgcccaggctggagtgctgtggtgcgatctcagctcactgcaacctccgcctcccaggttcaagtgattctcctgtgatctcagctcactgcaagctccgcctcccgggctcaagcgattctcctgcctcagcctcccaagtatctgggattacaggcgcccaccaccacacccggcctcctccctaaattcttgcttctccaagttaagctgccccagttattttcaggtgttctagaacaagacaggaagacttctcatcaatcatttgttcatgtgttcattcattgtagccatattttgagggttaaggtaggagaagcacctctgtgctgacccctggagatacaaaaataaacaaggtaaaacctcctggcctcgactacctcatcgcacagggaggcgaggggcactggtgtgatactaggatgggctgatgctgcgttcaggaaggccagggccctggccgaagggagtcaggcctgggtacaggggaggcacgtagaggtggcggtgcaccgagtccgctcagtgggagagagaggagtggcacgtgcagaggcaggcgccaggggcctggctcatctccaactcaggcgtgggggcagcggctgggccgccaactcctgggcaggctctttcttgtcactagcccaacatgttatgtctcagactctgagacactgcacttctgtgaaggggccttcattccccagtacttcattagggagtgacctagcaggctttgggcagggttgtgctgctgccagaccaaagcagactaatgctgcaccagacagccagagcctggcgaacccagagagcctggcatgagactgcctgtgctggcgcctaccaaagcaaggcctgctctgactcgcctcagcctcctctcaggaggaagctgccagcaggcgtgggtaggcgtgagcacattctcaaagcagttatgttttgcatggaagtcagctgggaagtaggagcatatgtagtcatgttcattaatgtggcaccagaagtccctgggtggagcatgcctcagagagcatttccaacccgccaccaccctccactccaccccttcccaaacgcacctgtgcactccgcgagttctgctctgccagtcactcccctgctacaggctggcctccgctgctctttagtacacagctcggctgtctctgggacatgtggttctcgtgctctccaccctaatccactggccactcctctgctacctccattctgtgggctctagagggctccaacaagcttgtcccatgctgctcggacatctcctcagcctgtcgctgtgggtgggagttgctgctccccagaatggtgatgctgtgtgtccttttgtgttgatatcactaagtacatagggcacattttgctggcttgcatttcctggtttgggaatactttatctgaaatgcttgggaccacccacaggtgtttcgggtttggggttttttcagattttggaatatttgcattatacctactggttaagcatcccaaatttgaacatctgaactctgaaatgcatgagtga

SEQ ID NO: 1287 - DNA, 21270 bp, Homo sapiens
tttcttttgttgttgttgttattcagtgttaatttcataatcataaacttaatgctgcaatccagctaggcatggaagggaacaaggaaaacatgaaacccaaagggaactgcagtgagagcacaaagattctagatactgcgagcagatggatggagggtgttctcctgagctacagaagcaatggtctagtggttaagataaaacacaagtcaggccgggcgcggtggctcacacctgtaattccagcactttgggaggctgacgcaggtgggatcacctgaggtcaggagttcaagaccagcctgaccaacacggagaaaccccgtctctactaaaaatacagaattagccaggtgtggtggcgcatgcctgtaatcccagctactcgggaggctgaggcagaagaatcgcctgaactcaggaagcagaggttgcagtgagccgagatggcgccattgcactccagcctggcaacaagagcgaaactcagtctcaaaaaaaaacacaagtcaaacttagtcaagttgtgtacagtcagcgatggtgatcttcttgatggtcttgccattcccagacccaaagtgctccatggcctccacaatattcatgccatctttcaccttgccaaagaccatgggcttgccatccaaccactcagtcttggcagtgcagatgaaaaactgggaattgcccgggctaggtggctcatgccgtaatcccagcactttgggaggccgagatgggcagatcacctgaggtcaggagttcaagaccagcctgaccaacatggtgaaaccctgtctctaataaaaatacaaatattagccaggcatggtggtgcatgcctgtaatcccagctactcaggaggctgaggcaggagaattgcttgaacctgggaggcggaagttgcagtgagccaagatcgcgccactgcactccagcctgggcgacagagttaagactccatctcaaaaaaaagagaaaaaagaaaaaccgggaatcatttgtgttgggtccagcatttgccatggacaagatgccaggacctgtatgctttaggatgaagttctcatcatcaaatttctccccgtagatggacttgccaccagtgccattatggcgtgtgaagtcaccaccctgacacataaaccctggaataattctgtgaaaggaggaacatttataatcaaatcctttctctccagtgctcagagcacgaaagttttctgctgtctttggaaacttgtctgcaaacagcttgaaggagacacagcccaagggctcaccattgacagcgatgttgaaggacacggtggggttgaccatggctgatagtatggggctcctgatggtggcgtctgcaaagccaagacagacactttctatctcatttcatgaggccaggattccatgagggaatactttctaactaattccatgaggccagcattagccaaataccaaaatcagatgaagacttcacaaaaaaagaaaaccacagaccaatatctctcatgaacataggtgcaaaaatcctcagcaaaatgctagcaaatcaaatccacaatgtatgagaagaacaatacaccatgcctaagtaagatttatcccaggtatgcaaagttacttcaacattggaaaatcagttaatgtaatccattaaatcaactggctaaagaagaaaatcacatgatcatatcaatagaggcagaaaaagcaattgacaacatccaacacccattcatgatgattaaaaaaaaaaatctcttagcaagctaggaatagagaagaccttactcaacttgataaacaacatccacaaaacatccacagctaacatcacacttaatggtgagaaactaaaagcttgcctgctaagatcagaacaaggcaggaatgaccctctcaacacagcttttcaacgttgtactggaagtcctagctaaagtagtaagacaagaaaaggaactaaaaggtatacaaatttggaacaagaaataaaactgtctttgtttacagatgatatgattgtctatgtagaaaatcaaaaagaatccacacataaaaaactcctggaactaacaagcaattatagcaaggttgcaggatataaagttaatatgtaaaagccaatcacttttctatgtatcagcaatgagcacgtagaattcgccatttaatttttttttttcaagacggagtcttgttctgtcgcccaggctagagtgcagtggcgcgatctcaactcactgcaacctcctcctcccaggttcaagcaattctcctgcctcagcctcctgagtagctgggattacaggtgtgccccaccatgcccagctaatttttgtatttttagtagagacggggttttaccatgttggccaggctgatctcgaacttctgacctcatgttctgcctgcctcagcctcccaaagtgctgggattacaggcgtgagccaccgtgcctggtccagaatttgccatttaaaacacaataccacttacattagcacccccaaaaatgaaacacttaggtacaaatctaagaaaatatgtacaagatctatatgaacaaaactacaaaactgacaaaagaaatcaaagaactaaacaaatggagagatattccatgttcatagtcaggaaggctcaatactgttaatatatctgttctttccaacttgatctgtggaatgaatgcaatctcaataaaaaacctcagtaagttattttgtggatattaacaaactgattcaaactttatatggtgaggcaaaagacctagccagcacaatataggagaaaaataaagtcaaagaccaccactacctgacttagactttctataaagccatagtaatcaagacagagtggtgattagcatagccattgtgggaaacagtatggaggttctgcaaaaattttaaaaatagaaataccacatgatccagcaatcccactaatgggtatatatccaaaggatatgaaatcagtacgttgagatatttgcactcccatattcattgcatcattattctttttttttttttttcctttagagatagagtctatgttgcccagggcaactcctggcctcaagcgatcctgctgtctcagcttcccaattatctgggattataagcacgagacactgcacctggctgcagcattattctcaatagccaagatatagaatccacctaagtgtccatcaatggatgaatggataaagaaaatgtggtatatataaaaaatggaatactattcagccttaaaaaacaaaatcctgtcatttgtgacaacatggatgaacctggaagacattatgttaagtgaaataagccaggcacagaaagacaaatacaatctcacttatatgtggagtatagaaaaagccagactcataaatagagagtaaactggtggttatcagaggctgggaggtcggggaattggggagatgttagtcaaagaacacaagatttcagttaggaagaataagttcaagagatctattgtaccttatggtgactaaacttaataacaacatattgtgtatttcaaaatagtatgagaatagctttaagcattctcatcacatacacacaaaatatgtatgtgaggtaatgtacatattattaaattgtttggtttatccattccacaatgtgtgtgtatgtatgtgcatatatatataaacatgatgtacaccacaaatgtataaaattagtcaatcgaaaaattaattttagaaagacagagtggcattggcaaagaatagacaaattgatccacttgagcagaatagagagccaagaaatagtcccacataaatacaaggagcaaagacaatacaataaagatagtcttttcagcaaatgctgctggaacaactggacagccatgtacaagaaaaatgaaaagagctctcttaaaaggttactgtgaaagccacctgtgacagtaacagaaagtgcccagcagggtctctgacacttagtaatgtaatctctctcactgtaatgtaatggctaaacttcaacatccctcagcccccatctccataagactttcccatagaggcaacaatgattcctgtcagtcacccagtcctgccaatccactgggtaggatacaatattgaggggcccatcagcacactggccttagggggctctgcagccccttgaccttgtggatgatgctggccttaatctcctcttgtccgtggctaaagacaggccccttctgcggagaccaggccagaatgctcatctgattaagactctatattaagagtcaggaataacaaaaacaacaataaataaataaacacagtaacataatctatgtgtcttagtccgtttcctgccgctataacagaatactacagactgggtaatttattttgttgttttttcagacagggtctctctctgtcgctcagactggagtgcagtggcatgatctcgactcactgcaacctccacctcccagactcaagtgatcctcccacctcagcctcctaaataactgggaccacagacccgcacgaccacaccagctaatttttgtgtttttttgtagagatgggttttgccatgttgcccaggctggtctcaaactcctgggctcaagccttccacccaccttggcctcccaaagtgctgggattacaggcttgagccaccacacccagcacagactgggtaatttataaagacaataaatgtttttcccacagagctggaggctgagaagtccaagagcatgacactggcatcttatgagggcctggctgcagtatcatcccatagtgagaggtggaagggcaaagaggctgaactgatttctatcatgccatacaatggcattaatctattcaatctaatcaaccctgaaaggtcccacatcggctgggcacggtggctcatgcctgtaatcccagcactttgggaggccaaggcaggtggatcacctgaggtcaggagttcaagaccagcctgaccaatatgatgaaaccccgtctctactaaaaatacaaaaattagctgggcgtggtggcatgtgcctgtaattccaactactcaggaggctgagacaggagaatcacttgaacatgggaggcggaggttgcagtgagctgagattgtgccattgcactccagcctgggcaacaagagcgaaactccatctcaaaaaaagaaaaaaaaaaagtcttgcatcttaataccattaggatagcaattaaatgtcaacatgagttttggtggggacattccactttagcactaggtattctggtttatgtatttttttagcttaattccttcatttctacaattatgagatccacgattatccactatatttggttttctttctttttggttttgttttttgttttttgagacaagagtctcgctctgtcgccaggctggagtgcagtggcatgatctcagctcactgtaacctctggctcccgggttcaagtgattctcctgcctcagcctcccgagtggctgggactacaggcgtgcaccaccatgcccggctaatttttgtatttttagtagagacggggtttcaccatgttggccaggatggtctcgatctcttgacctcatgatccgcccgcctcggcctcccaaagtgctgagattacaggtgtgagccactgcgcctggcctcatccactatatttgaaccgacccaaaggccagtgctttcttaattaagttcccacaggtgaacaaagccaaaattcagattctattttatttatggtttagaattacctactgtgaaaaaaaaaaaaaactagctactataaattattgggggttagtccatttagtccattttggagttcataacctaaagcagaaactcacatggttgaaatgtcactttcccaaaggattgttattagtgtatcatttagattgtcttgcaaaagtctcatttgttgttttttctaaatggctgctaatcttttaaattaacagatagagggccaggcacggtggttcacacctgtaatcccagcactctgggaggctgaggcagtcggatcacttgaggccaggtgttcaagaccagcctggccaacatggtgaaaccctgtctgtactaaaaatacaaaaattagctcggcatagtggcacacgtctgtaatcccagcttcttgggaggcagaggcataagaattgcttgaacccggcaagcggaggttccagcaagcagagattgtgccattgcactccagcctgggtgacagagcattgctctgtccacctcccaaaaatgtagttaattttttttcttttctttttttttttttttttttttttttttttttttttttgagagacggagtcttgctctgtcgcccaggctggagtgcagtggcacaatctcagctcactgcaacctccgcctcccaggttcaagcaattctcctgcctcagcctcacaagtagctgggattacaggtggctaccaccacgcttagctaattttttgtatttttagtagagacggggtttcatcatgttcgccaggctagtcttgaactcctgaccttaagcgatccccctgcctcggcctcccaaagtgccgggattacaagcatgagccactgcgcccggccaactttcaatgttaattagttgtggtttgtttaaccatatactgcatagtttcgcttatctataataacagtagtttggggctcttatattctaataattaagactttagctgtgtacacattgcaattaaagtatgagtcatgcataaccttatcaccaagatacaagagggaaagcccttctccccttaaacttttacaaaggttctgggttctttttccacttaagtgggaaaaagtcagctaatgaggaacgtaaagtctttggcctcatctaaaggtgctttggcccgcaagtgtgagaagcactgaccgctgggaagtcctcactgcctggttcctggactcttacaccatggcagaggccatcttccctcccaatgcagagtgatatccagatagcgagctggctagcagctgtccactctccagcaatcctgccttctggggcatggttttctaaggaccttcctgttcctagatgatcaaaattgggaccagccactcccttctgagccactcctgcctctgggcctgtggctatgtcacagtccagtcacaacaggacatcccttcagaacaccctgcaggaagctgacatctctatgcagactcacacatgcacggtgtgtgcacaggcctttggttctacttcaggaggtgttgggggaggctcactagtccaacagaacttgaggccagttgtaccagtgtcatatcccaggagccaaggttacaagggatacaaagtgcccagacctaccagagaaggcaaacccctacagcatgcagggctagacaggggcaagaaacaaggtcattctgggccagcaagaagagggaaagggaaatgacaggcatacctcggagatactgaagatttgtttccagaccatagcaacaaagtgagtcacacaaactttttagtttcctattgtgcataaaagttatgtttgtactatattgtagtctgttaagtgtacagtagcattgtgtacaaaaaactgtgtatatacttaatggagtctcgctctgtcacccaggctggagtgcagtgccacgattttggctcactgcaacctccgcctcctgagttcaagccattctcctgctcagcctcccaagtagctgggactacaggtgcccatcaccatgcccagctaatttttgtatttttagtagagatgaggtttcaccatgttggccaggctaatcttgaactcctgacctcaagtgatccacccacctcggcctcccaaagtgctgggattacaggcgtgagccactgtatctggccatatactttaattttaaaatacttaattgctaaacaaatgctaaccatcatatgaggcttcagctaatcctgatctttttgctgggggagggtcttgcctccatggatcaggggcatggctgctgaaggctgctttgacaacttcttaaaataagacaatgatgtttgccatttgccgcatggattattcctttcaatattgttgtgcctcagggaatagggaggcctggaaagcagagtcgggagaatggccagttggtgaagcagtcacaacacacacatttttccattaagtttgctgtcttatatgagcatcgctcatggtgtcccaaaacaatcacaatagttaacttcagtaactgattacaggtcactgtaacaagtataataatgaaaacgcttgaaacattttgagaattccacagcgtgacatggagacatgatgtctgcctgctgttgggaaaatagcaccaatagacctgtttgatgtgcttgacacagggttgccacaagcctccaatctctaaataaaaaacagcatctgcaaagagcaataaagggaagcacaataaaaggtacatctgcaaaggggaatcagcacttaagcaaggtcaggatgagctttcaagtcaggtggacctagacatgaaccctccaggccctaccaacaaccagctatggaccttcgagcacatccagcctagagctgcccccaacagacacttccccagtgaatgctgaatgaaaccatctgagccagtttcctcaggtgcaaaccagtgaggtaattcctaccttgcagagtgaagtgagaaaagacagtgttaagaaatgccgggtgcggtggctcacgcctgtaatcccagcactttgggaggccaagacgggcggatcatgaggtcaggagatcgagaccaccctggctaacacggtgaaaccccgtctccactaaaaatacaaaaaattagccgggcgtagtggcgagcacctgtagtcccagctcctcgggagggtgaggcaggagaatggcgtgaacccgggaggcagagcttgcagtgagcccagattgcgccactgcactccagcctgggcaacagagcgagactccgtctcaaaaaaaaaaaaaaaaaaaaaaagacacaagacctgtggtagcctttcctttctgtctggcagcagccactgggtaaaccaagatggtgcatacaagtacatccagaagctatggaagaagcagtctgatgtcatgagctttcttctgagggtccgctgctggcagtaccaccagctctctgctctccacagggatccccgccccacccagcccaataaagcacgctactgggctacagccaagcaaggttatgttacatataagcgccacggtggctgaaaatctagttcctaagaaggcaacttaacagcaagcctgtctatcatggtgttaaccagctagtttgcttaaagccttcagtctgttacagaagagcaagctggatgccactgtggggctctgagtcctgaattctcactgggctggttaaagattccacatacaaagtttttgaggctatcctagttgatccattccataacactatcagaaggaaacctgacacccagtggtccacaacaagcatagggagatgcgtaggctatctgcaggccaagagagccacggccttggaaagggctgtaagttctaccacactattggtggttctcgccatgcagcttggagaaggtgcaatactctccagctccacagctaccgctaatgtttgtaaaattcatacctaataaacactagatcaaaaaaaaaaaatcacagacctgtggtaggctgggcaccagtgctctaaagcaagttctgcctaaactggcagggacatttttcacatcaggaacaggagttgttcctggactctgtctggggccaggctgggagagacgtggggcagagtggggcaggggcaggggcagggctgggggctggggcctgggcagggccaggcactcaagtgaggccaagtcctggagcgaaccagttcctggtggccgttggacagctcacacagctccctgccaggtcacccgccatggtcctccctctgccctggctctctcggtaccatttccttcgcctccttctgccctcctggtccttggcaccccagggctcccatgggtgctgctcccaaaaccccaaagcaagcatggaagagcagaccagctccagaggaaatgggaagatgacgtcccctcccagggtaagtggcaccacaggtaggaacagagggtgtgagaatttacactggggtgtgggaaaaaaaaaccctcaatcccaccctgcaccaccccacaccatgcctacccctgcagctcttttcttagttcagctaccaactcctctccccacctcccccagcccagacctcagggttcccttccctcaccccacccccacccacaacagcacagtccacaaagtccttgaacaggatctattccccctcacctaacagttaattatttcttagcggggaggagcagctgatcctctttccagtgaccccatatccttgttcaaggaagccagttacagcccctgggccagggaactctatttgctccccctactaccacccagaggcctatgcccaagacaggaagctacctggccttctcagtacaggtgtccttaaacgaccggttcaaaaacgaatagggaaggtggaatttctcacttccagccacagcctgcaacaaagcttcccagggcctcagccccctgccctggctgatgctccctcccttaattccctgaccagggccctgggacccaccgcacagctgagctggcccgagctgaagagttgttggagcagcagctggagctgtaccaggccctccttgaagggcaggagggagcctgggaggcccaagccctggtgctcaagatccagaagctgaaggaacagatgaggaggcaccaagagagccttggaggaggcgcctaagtttcccccagtgcccacagcaccctccggcgctgaaaatacacgcaccacccaccaggagccttgggatcataaacaccccagcgtcttcccaggccagagaaagtggaagagaccacaaagcgcaggcaattggcaggcagtgggggagccagggctctgcagtcttagtcccattcccctttgatctcacagcaggcagggcacccaggccttataggaattcaccctggaccatgccctaaaataacctcaccccaaatacaataaagggacgaagcacttatagataccacagacacatgtgtttcatttttagttttgttaaaaaaaaattctgacaaatcagaaatgggggttcaggagtggtggtgatgcaaaagatggaagccatggggtgggggctgtcaggggtgggggcagtagtgtctccttcacccccaccctggtgtcctctcctgaaggacagacggtcacattccaaaatgggcgagtcttctaccgtgtctgttcaactgagaagaaaacgtagcatggtcagaataaggcatgaaaaggggaaagtgaggcaggaacacacggcacacatgcagacactggtgtactgcctgggttcagaggacggacgtgggggtgagggaagggatgtaatatgatgagagaagacaagacaccccacataaaggtcagaaaaacatcccaacacagcatcaaagaccagggggcatgaaccagtcaagtgtccattatgcatcagatgcccatgacctatgtgatgggatttcggacaaacacactaaggaacagggaggacctaaagggtttcatgagatcagtactcactgtaggaggagatgtctatctcatcaggcagctcactaatattgacctcaaagcgatcctgcacatcattgaggatcttggcatcattctcatcggacacaaatgtgatagccaagcccttggtgccaaaccggcctgctctggccacctggagggagacagagggtagcactggaagaccgaagaggaaagagacccagaggcaggaatgaagatgtacaaacagaaaacaagggaatgggagagtgggattttttcagcctgtgaggtttacccgatgcaggtaggtgtcagaatcctcaggcatgtcataattaaaagcaatgttcacccgctcgatgtccatgcctcggccaaataggttggtagccacaagaattcgtcgttgaaaatctttaaactgctgataccgagaaagcctttgtgagaaaggaaatttaaaacatgttgagattcccttctctcaactgtctttttctcccaaggacacaaaatatctttcccatcttcagctcacctctcctcctggggcatcccacggtggatggcaatggctgggaagttctgctccactagtagctgggccaaggcaatgcaccgctgcacagacttcacaaagatcaccacctgttgtggggtggggtggggggtcgcaaattgggggaataggggtccatggtgtgtgagagacattacgtgggagaggggagtttctagtaattacgttctcaggaattcctcttcatttctcttattcccccactatatatttagagcagaaaaggaaatataactttacttcagcactgatttttccctaaggaagctggcctctgaggtagcacagagttcagaaatcaaaattgccagacatgctaggagatgaggatgagatcacctcatgaaaaagtgataaaaaactagaattaagatctggaggggtaactgatattcctgctcaccaaaacattaaacctaagggagctatcctaattctagaaagcagttttaaatgcaaatagaccactcacaagtatattaattaaacacttttttgagatggggtctcactctgtcccccagactggagtgcagtggtgcaatcgcaagtcactgcagcctccaccctcctgggtttaagagatccttccacctcagcatcccaagcagctgggaccacaggtgcacaccaccacgcccagctactttttttattttttatttttactatttgtagagacgggcgtctccctatgttacccaggctggtcttgaagtcctgggctcaagcaatgctcctgcctcagcctcccaaagtactgggattatgggcatgagccactgccctgcacccagtcagaaatgcttctcttgaataagcagttattagaggaattaaacattcaagaaccctaacatgcccccaaacatcgtttcaagacttttaacaacttcctaaaatccttcaaggacttttggagacaagatctcactctgttgcccaagctggagcacagtagtgcaatcatagttcactgcagcctcaatttcctgggctcaagctatcctctcacctcagccaccagagtatctgggactacaggcatacaccaccacacctggctaatttttttcttctttggtagtgatgaagtttcgccatgttgccccgactggtctcaaactcctggactcaagtgatccacctccctcagcctccccaagtgctgggattacacacataagccaccgtgcctggccaaggatcttaatttttgaagtttattttccttgaggttattgaggacatacccgtgccagccatagaatagaaaagcagctcccaccttactcatgctcagcccctaagatatttataccctcattattctctcccacatcacacatgtgatttcctcaataaaagtgtacttaatatccaggtttctgctacagctggagtgctccaatgctcatccccctactggacgtctaactgacctggttgaactcaaggacatccagaaggtcaaagagcttccggttcttctcgttgtccttcagtttcacgtagtactgctgcaacccatgcagcgtcaacttcgtctcatcatccacgaagatctccattggctgggggggaggaagggggtggggaacgggaggagggcagagtgggggggttaaacctgggggggtggaggaagttgatctccaatacaccccatggggggatggggaggaaagagaagattgaaaaccccaccccactcccaaaaatacccacattttactgtggtctctctcacattacatctaatttccttcctatcagatgagttttaagactgcccaactaaaaactatcatgggaaagaaactgcaaatgaagtcaaggagcagtgaaaccacccaatggcacagatgccattacctcaaatagaggtgggagaggaaagaaaatgggagatgattctcaaagggagagcaaggaccaaacatctgggaaatgatgggaggcagtgactcaaggtcagaataactccatcagaggtgcttctaagaacatggggtggggggaggacaactgctccatttgattctcctacttcaactaagagaatctcgtgtgcattagcaaagtggatgtcttttaagatcagaatgctgcaatggacagtcaaaatgccacttaaggagaaacaaaaattactcaagatgagttacttgccgtcagaccacaacaggatagttttagatgagactggtctcttgactaagaattaaaccatctacaggtttacaggaaaggtatcagtaagtggtgttaaaataccaaattcagagcagcagatacacttttaagggacaggatctcaccatgttgcccaggctggagtgcagtggctattcactggcacaatcatagcacactatagcctcaaattcctgggctcaagtgatcctcctgcttcagtctcctgaatagctgggactacaggcacacaccattatacctcactgcattcatctttaaaattaaaaaaccccctgaaggggaggaaagtaacaaagacagaaattaccacaactccaaagcccaactttcctaacactttttatactatcctgggggaagatagttaatatgaagacccagaggacaaaataggaaaggatgcgtgtgtcatgggaaaaaaaccagaagcccaatcccagaaggcaggttttgttttttgttttgttttgatacagggtctctctctatcacccaggctggagtacagtggcacaattacagcttactgccacctccacgtcccgggctcaagcaaaccctcctgcctcagcttcccaagtagctgggactacaggcatgcgccaccacgcccggtttttctggtagagacaaagtctcactacactgccccagctagtctcaaattcctgggctcaagcaatcctcccaccttggcctcccaaagtgctgggattagaggtgagccaccaggcccagccaaggcaggctttctaaagagaagttccatggcctccttcaaatctcattctagccccaaatacagctaaagagtgatcatcccacgggaaggaacactgcagggaggggaagaacacactccactgcttatgcaattggccccacctagccccaaaccctaacaaccacccgattacatccactttacctttcctatgtccctctcctctgagtattaaaaaaaacaaaaaaatttttttaagaaaaaaaatctaccaccccattcaggacacccctccccaacacatattgggggaaacggggcacggcacgcgttgggttcaggaaaaaaaccgggaacggaaaaagaggctggtttggtcctcagcttcctggtcaggtttccccgcggcctccgctgccgccatccaccgctgggtgccgtctgcattccctcgccgcgccacggtgcttctctgttgccggctcacatcaaccgaggttccagatgggtgcaaggagatgtgggtgggaaggagtagggtatcggggattgaggtgccaaaggcccccacccctggaggtggggaaggggaggattcatttgtgctgatgctcttcttttggacatgccctgccatctgtctgtccctctcttgctctcctgccaccgggaagtaggagttttggtgagcagaaggctccagctgtacgctcgatgccaccttgagggtgcgtggctgtagggtgcatgtaagagacgatggatgggtgggtggtagggcagaaaaatcctgccctcccccaaagggagaagaggttcaaaaatgttgtgatttatgaaaaagtcgaacactacccgctctcacattaacccgaccaagtcttccggagtttccctggcacccgcgcaggccctaacactagctgtctctgcttctgtatgtctcttcaaggagtcattactcccagttgggcacaagccgccttcttggcacttgaatgacaagggagtctgaggaagagggcgaggaaggggaggaggcagcgggcggggagtggagggagagaaggtagaagggtatttacatcttgcatgaacttgcggcagactggacggatctctttgctcaaggtagcactgaacatcatgacctgcttctcgtggggggtcatgcgaaaaatttcctggacatcccgacgcatgtctacaagaacaaggaaaaaaattgtaggagaaaataagcaggtatgataaacaaagattagaggtagacttcccagtgaggtgaagattgctggaaatagtaacaacacaatggaaagagcaatggacttggaatcaagaagtgggatcagattccagctgtttgttttaaccaagcaagaaataaggtaaaaccccaaagttcccaactatgaaatggggataaagcccagtgcagaggctctcaaggccttcaaaacatgctttatgggaccttctcccaaccctttcctgcccaagccccagccagccttcagcagactacaaatatcaagcacatattatattccagatatcagagtccatctatgactctctggattacttttctatcaagtcaggcaaatatgacatccctacctggagcccacctttatagctcaccatatagaattgccaaagatcatttgtaatgacttatggggcctatgtccaaccccactctcattcaccaagattcaattcttacagaaaaatcttccattaaccccacctggcacactagaataccacatcacacaaactgctacaaacactctctacattaatcccagacctgagtctagacacttattcagctataaattctgactgtaaatgctgtgctggagatgccagaagggtactgtcttctctttcagtttagaatctccgctatgactcccagtatatgaatctataatgaaaacggtggtggtggtgatgacttatgcctaaaattatcaaagtcccctattctcaaaggttaaaaacaaaaatcatagaaagatgatagatgacaccctttactgtgcttaaaagcataataaagaccaaccagggaacccagagccatcagtcatgggtgatagataagagtcgtccttgcactgaggtgctcctgtttcaaataaacatcatttggctccaaagaacaactccccagcattagccaagccccagcactgccactcaccgagctgttcaagcatcttatcacattcatccaaaataaagtgtttaatgtgtttgaggttgaggctcttatttcgagccagggctaggatacggcctggagtccccacgacgatatgcgggcagttcttcttcagcacctcttcatccttcttgatagacagaccaccaaaaaaaacagcaacctgccgagccagaagcaaagagtctcaaaacagaggaaggaaagagtccaatccccccagggttcccactctgtttgagctaaaccaatttttagcatgtttccaaactaaaactaactttagagggcacctaatttaaaaattttatgtcccccccaccaaacactgagggtgattgcctaaagttacatggctagtcggagcagtcaggacaataattcagttctactgacttaatctaaccaacttccttcatttatgaggccaggcttcatttaaaaaataaaggagccaggtgtggtggcacacgcctataattccagctactcaggaggctgaggcacgagaacctgggaggcagaggttgtggtgagccaagatcccaccgttgtactccagcctgggcaacaagagtgatactccatctcaaaaagaaataaaataaataaaaataaaataaagccaggcccagtggctcacgcctgtaatcccagcagtttgggaggtcaaggaaagtggatcacttgaagccaggagttcaagaccagcctggccaacacggtgaaaccccatctctactaaaatacaaaatttacaaatttactactaaaaaacaaaaaatacaaaatttagccgggaggctgaggcaggagaatcgcttgaacccgggaggtggagattgcagtgaggcgagattgagccactgtactccagcctggatgacagagcgagactccatctcaaaaaataaaaaataaataaataaaggacagcaagaaatcaccagattagtgtaaagtaccacaaaaaacacatggaacattaaggtttcctaaataaacccagaatctcaaactcttttcacacaaaccccatgaaattactgcttcgggctaaatattatcatttcatgttaaaaccattaggtgaatagttgtttggggatctgggccttggtacagtatcaaataacaccagaaactactttctggtttcaagggggaaaagaacaactgtggaatcagactgtcacgacgctaatcctatggtaaatctaaaatcattaatgaggccaggtgcagtggctcactcctgtaatcccagcactttgggaggccgaggtgggtggatcacttgaggtcaggagttcgagaccagcctggccaacatggcgaaaccctgtcactactaaaaaaaaacaaaaattagccaggcatgatggcacactgtagtcccagctactcggggggttgaggcgggagaatcgcttgaacgtgggaggcgcaggttgcagtgagctgagatcgcgccactacactcacagcctgagggacacagcgagactccatctcaaaacaaataaataaaaataaaataaaataactaacataagtcgaccagatttgtggcataacaggagatacagtatcacctatgaaggattcttgccaaaaatgcttaacttcaatcagattttttctttttttttgagatgggagtctcactctgccacccaggctggagtgtaatggcacaatcccagctcactacaacctctgcttcctgggttcaagcgattcccctgcctcagcctcccaagcaggtgggactataggtgtgtgccaccatgcacggctaatttttgcatttttagtagagagagggtttcatcctgttggccacattggtcttaaactcctgacctcaaataatccacacgccttggcctcccaaactgctgagattacaggtgtaagccattgtgcacttggccagaatcctcaatattcacacaccactggagctgttttaaagtttccggctttctctgccacataccccaaaattattaaactgatatgattcaaagtcagtataaagtagtaagaaaagggtggtcttgtgttaagcatcatccatagcccaattacgaatcctcctgttacataggaactcaacactctgttacaccacagcaaactaaagcttctccaaaattaaagagactattggcctacaagtttcttatccctccaacttgccacaccctcactctcaggtctctttaccttggcttaccttgacattgggcatgtatttagagaagcgctcatattccttgctgatctgaaaagccaactcccgagtgtgacacatcaccagtacagacaccttaggcaggaagtagacggagacatatggtaaatgtagctcttcattatcccctctagggaagtgactgtcacaaaaacacacctgggccgataataaatgacttcaattatgtgatctaaatcatgaaccccacgcttgcgacagaacatcccccacagctgtcaggttgtcaagggtaacagaggtcatgtgctcatggctctgcaagcatcatgtagctaggacaaaaacacccttcccttatagtcctaaccaaaatcccctccccagcactctccccaaatatacctgcccagtaactggctccagctgttgcagtgtggccaagacaaacactgctgtctttcccatgcccgacttggcctggcacaggacatccattcccagaatggcctgagggatgcactcatgctggactaaaagttggggggggaggaagataaattagacttcagtctccagataactctacctttttcaccatgccaagcccatttcttaccactcaattctcaaagtctagtatttacctggttcttgccaacttccagacccattttacctctctctgctcaattacattcacctcaaaatcagactctcctaattcctcctagctttagcctcctccagatctaggccttcccagtcctagtaacaaaccccttgcatctaccaaccgctcaccttcaatgatcctagctctgtccttatttttcttaatctgtaacaattcatgacatttgaatacctgccacagaccacttctcctgcttaggttgctatacttcgggtcacgtaactactacaaccctggacaaaatgaaggacttggtacctgacccagaagccagtcatctctaaaccagtcatagaggtttccagagaccacagttggcctggcccaacagagggagactacaggtccaagcaggacctttctggaaatttaaaattagaagtcaagtgacaaaattaaaaataagcagacaagaaaagccagtcacaagaatgaatggcagacctggaagtcacttttggatcattagcactttggtgctatcacgaaagaaagaataagcctgtataagcctcctctatccaaaattgtttttgatacttatcccctgattttttcttcctcactgtcgccccggctggtgcacagtggtgcaatcacggctcactgaagcctcaaccttcacctgcttaatttctgaacgttttgtagagacaggagtctcgctgtgttgcccaggcttctcttgcacttttgagctcaagtggccaccctcctgcctcggcctcccaaagtgctgggattacaggcgtgagccactgcacctggccctgatctagccttaagtataaac

SEQ ID NO: 1288 - DNA, 31720 bp, Homo sapiens
ttggatttctagatgctggaaatccaagtggtgactagacaaggtccctgcctcgaagaacatgacaaccaatgaaacaaatgaaaacaattctaataccggtgataattgttatggagaaaatatgcttgagctagaaggttgatggtggtgaggatggtaggagatatagtctgttgatcaagatgttcctgggaatttgaacactggacgtctgagcagagacctgaatggtgtgaggggcctttggatccctttggatccctggggagcaggtgcacttggggagttccagtgggaggtgcctgagacaggattgagcagtgttagtggagatgaatgagctgggccgagaggggtgggatgaggccagagtggccagaaggatcctgtgatgagggatgaggggctgtaaaacatagtgagagactggggtttcactgtgctaagaagggaagaggctggcatgtctgtgggacgcggaggcgaggatgagctctaattcccatttgaaatgctcactctgactattgtgtgggtgatggacagcgggtgtgagagtcagcaggcagcccagctggaaggccttctggtttactatcttggagaggatggccctggggaggaggcagtagaggagtgagaagtgattggatttggggttaatacatttttaagatggtgttagcaataactccttggagaaccacacatttatttgcttactttaattctacagcaacattcgaggtggcttactgcaacaaacccagtgtaataaatacatacgaattactttaaaatcaacgctaaggaaaatatacattttaaaagattaaggctggggtaaagctggaacattactaggcaggaaggaacatctgaaacatttgctgaaatggagttgaccctttacctagccatagatttgttgcctcacgatttcattgcatctgagcaccagggagggtggtggcagttcaggtcaccagtcccttgtttcctgattcaggaacagcgtcctgttctacacttacagtcaaagcaaattacatcattataagatgtttaatgatgaagtcaaagtccacagagtcagcaagcaagtgtaaaaacctcaggagtctaaggacagtctacatttctccccagaaatggcctccctatgtactgttgaagggagagggtcctttcaaggggctccaagacgcagaagcaactgggctgcagctcgaaataaagatgtcctttctacctgcaggttccacgaagcctcacaggcaactttggtgatctcacctgagctaggaattcggttttttgatgtgggttctctttgagccattgtgtgagctttaaaatgtgatgtggagattttgctatactggtgtttccttgccggaatttgacatccatggtggctctggcttccctgtctggtcccaggaggaaatggagtgtcctgcactttttttcagcttcgctttgtgtaggaaggatcaggagacctggagtcagggcttcctccaatctcactctcctccataaaacagtgtctcctaagctttctgggggtgagggccttgacaccgtgctgttctgatgaatataactgtcccagctcctgaaataaaagcacaggtgcacaaaataccgactgttgcaagcaatgcctaggtggggatgtttcctaggcgccaggtttagcactttgactttgtatgtacacacacaggggccaggcattgtggtttatgcctgtaatctcagcactttgggaggctgaggcatgagaattgtttgaagccagaagttcaagaccagcatgggtaacaaagcaagacccagtctctacaaaaaaaaaaaaaaaaaaaaagggtatatatatacacaaacacacacacacacacacacacacacacactgggtgtggtggctccagtctgtagtcccagctactcgagaagctgaggtgggaggattgcctgagtccaggagttggagcctgcagtaagctgtgatcaggacactgcagactgtcagagtgagaccctgtctcaaaaacaaacaaacaaaacaaaaatacatacacacacacacagccagagccagcgctgagggagaggctggactcaggggcggggtcacaggcgtttctcaggtccttctcgtggtctttgtctctttttcctggaggtgggggactctgtacttcatgaggagaagttgtctgaagaaggtgggagatactcaggagcagggtccagagagggaaaaggatgaggaagtggagacaaagcagagggggcaggacaagaggagagcacgcaaggaatggggatggggaggaccttccagctgtcagaaaggtcacccgcagaatttggctcttggtttttctgctttatcaggatggatttgggaaaccagccggagtgggagataaggagtctactttgcaaaggacacatgtgagcctcctcctagtttgaactcatgagtagcagctaacagccaggacccttgtgtcgggcacgtgaggcccctttgcaaccagggcgttttctgcaccccaccagccacccctcctgggaccacgctggttccctccaaccctaacagggagagaaggaaggagaggtctggagggtttgggtcctcccttgtgctccttcttcctctgccatttattccctgagtgtcctcgcctttcctccgctacctggaccccactacagtaatgcacactggcctggactccctttgtaaccaccaagtgggttcatcttgccggctacctagacgaagccgatttatcaagacaggagaattgcaacagagaaagagtaattcatgcagagccagctgtgcgggagaccagagttttattactcaaatcagtctccccaaaaactctcatcagtttttaaggataatttggtggataggggggccagtgaatcgggagtgctgactggttggctccggtatgaaatcatagtgagtggaggccattctcttaggctgagtcagttcctgaacgtgggggccacaggactggttggcaggtccagatggggccctccagctgttaaaaatacaaaaacctgaaaagacatctcaaaaggccactctgaggttcacaatagtgatgttaccttcaagagtaactggagaagttgcaaatcttatgacctctggaataatggctggtaatattcagaattccagcccctctcatcctaacttaatggccggtggcctttcttcgttttacaagaacagtttccctttaaactataaactaaattccttcccaaggctagttcagcctacgcctagaaatgaagaagggcagtttagcggttggaagcaagatggggtcagttaggtttgatgtctttcactgtcatcatttccttagttataattttgcaaaggcggtttcaccttggcttcagccccacccatgcagtaacactgtgccctgtccttccaatcactgccactaggtggaagcagagcgtgcatcgcccagatgggctagattctcacaggctcactgctagaacgaatattcttgagactttagatctgaaagtcagcctgatttctgaaagccttggaccgtttccaaaatcaaatcaatactccaggaacaagatctgcctcgactttgcctctacccaaggacgctatggcaacgcagttttcaaacgtgctttgagaataaatggaacagggtcccctgtgtccccactcatttgcgttttcctttttattacagccaaccgcttttgtaaatattgttacacatctctctattccactgaaaacatctctttcaaatgcactttaagaaagattcaatgccatgaaaatatgaaggatcctcttgaaagagagtttctggtggtgggttttaatgaacattttcttttttaaaactctgtaactatttcgttgtggggcttagcttcatattttcaaactgaaatattctcttccttaacctccacataaatccaagtttataatttttattattttaaaattttatttatttttctgttttggggacagggtctcctcctgtcactcaggctggagtgcaatggcacaatcatagctcactgcagcctggaactcctgggcttaagcaatcttcctgccttcgattcccaaagagctgggattatagtcatgaaccactgcaatccacccaaatccaagtttacactaaaagataaaattccaacattgtaggggattggtcaggtggtgggaataattataaagataaagttataggaaatagacacaaaccttcttggaaggtggaaagttttgcaaaagcctcaggatagggttatagctgaaagcagcctaatccccttaccttgagttaatagcttcgagtaagtacaaagacatgtaagagagtttatctaaagagcatgtttacctttgatcatttgtaggactgctctctccgggggactgcgaccagattaattacccacaggtgtgttgactcaaagcctttgtcattaaatctgtgctgaataaaggcccacagggccagatagtcagggcacgcagctgccacaaccctttctgtgagtggcctggccctctggtgcactctttcactgaatatcggtgtctgagtacattattcatccatcgtgcagcctgggtctgccggtcagaccctggcacaacatttaagaggaaatgaaagtcacaaagttatcccagtctctggagtcactgtcaaaactttggtgaggaatcttccaggttttcccctacttcaaatatatattaatattatgtaagtgatattagtggcattttcgcccaggctggaatgcagtggcatgatctcggctcactctaacctctacctcccagattcaagcgattctcctgcctcagcctcccaaacagctggaactacaggcacccaccaccacgcccggctaatttttgcattttcagtagagacagggtttcaccatgttggccaggctgatcttgaacttctgacctcaggttatctgcctgccatagcctcccaaagttctgggattacaggtatgagccactgtgcccagcctccttaaccttttaaaaaaggttaaaagtatgctgggcacatcttttcatagcaatacttaaaattgctcttactctttttaatgacaacatagaattttatcgtgtagctgttctttgggagacgattaaaatcttctttatcttcactgtggtagtggagatgtgggtgtgtacaacagctaaaattcaacaagttgaacattttaaatagatgcagtttattgcatgcaaagtatgtcccaataagatgatttaaaaatattatcctctttgagacttgtactttgcttatgtgaaacaaaacaaaacaaaaaccctgttcttgtgcccaggagacacaccctgacacatctggaggtagagggtcatgctgtctgcaacttaccctcacaggctctgaaataacaataatagcagcatatttacagatttagagagagagaaatttgtggtaaaaatgttcataagtaaaactagataaagggcaaaaataaaagaaataatgaaactacgtcttttaaattttctctctccggccgggtgcggtggctcacgcctgtaatcccagcactttgagaggccaaggcaggcagatcacgaggtcaggagatcgagaccatcctggctaacacagtgaaaccccgtctctactaaaaatacaaaaaattagtcgggcgtggtggcaggagcctgtagtcccagctactccagaggctgaggcagcagaatgccctgaacccgggaggcggagcttgcagtgagccaagatcgcgccactgcactccagcctgggcgacagagcaagactccgtctcaaaaaaaaaaaacaaaaaacaaaaaaactctcctttactttttctctccccttttcttcctatctcttccctcatttcttcaacacgtccccccatccttccctcttttctccattctctgcatttgatccccggtatattccagcctccaggccaacaaacttctccgcgtccgccgggagcaggtcagggaagggacgcgaggcggcgctgtcaccgcattctgagcgccgcagctccctgggccccttgtatcatttcagtgaaggtcactccagtctttcatggaggccaaactaagggtgtaaattaggatcctcactgaagtggcgggaccctaagaggctttttcctggccccttagttgtgggttttcctgcgggcggcgcagccggtttccatcagaaccgcccagaggcggacgctgccttcctggggtgacggagcagcaggaagcgttttcggatcctggaatacgtgggcggcccgtgggaggggctgaggcgcagtttcctactcacccggatccgaatcctccgcggtgctgtttcaagagagccggattccagatcacgctccagcccggactcggaattcctgccctgcgggtctgcattttcataacgggcaggtgtgagtgccctgcagctggagaccagaagcctgaaggcagctcggccctccccagcccacagcgccgttattccgtttctatatcagtaaacacatttcattttccgtagaccagggcggggtgacgggtgatcccagtcctcgcagtgaattccgggcagcaaaattcaaaacacatgcggccaaggccgggcacggtggttcacgcctgtaatcccagcactttgggaggtcgaggcgggcgatcacctgaggtcgggagctcgagaccaacctgaccaacatggggaaatcccgtctctactaaaaatataaaattagacgggcttggtggtgaatgcctgtaatcccagctagtcgggaggctgaggcaggagaatcgcttaaaccttggaggcggaggttgcggtgagccgagatcgcgccattgcacttcagcctgggcaacaagagggaaaactccgtcgcaaaaactttcgggggcggagcggagccccgccctgggttatgtaagcgaccgcgctgggccgtttctctttcttttccggaccctgcagtggcgcctaaagtctgagagagggaagtcgcctctgtgctcgtgagtgcatggggtataaggcaagtgctgagggagaaaacgtagttgatggggtagagcagacggggttggaggtggggtggagggggagggctttggacagaagacctgggaggcttggtgggggaggggcgcccaggcctgggcactaagaaacaagtcccctggagctcaagaccatctcggcctcccctagcccaagagaggactggcttcatgactccctgaaaccatttctaaatgccttagaacaaaccttgcatattcattattgttattgaactattaaaagtcttttttgggggcgagctgaatcagatcctttgctggagctggcacacggaggaagtcctggagggagggtagacaccgtggaggtaagggcttgggacctgtgtcaggagagctaggtccatctccctcccagtctctcactaggcttatgatctttagcagtgaaaataatctctctaaggtggggaaaggaccccggtccctgctgtgctcaataaattatgaggatcaaaataaattatcagtgaatgtgaatgggaaaactaagaaattgttaaaattctcgaatacattacattttcatccacagaaaagtgtaggctagggatcatgggggaatagttagtaatgacagggatagttgaacttaaaaaaaaagtttgtgaggctgacaaagaagaaacggacacatttcctgatcttggagggttcatagggtagaagatggtagatgacagctgggtgtggtggcactcgcctgtagtcccagctactcaagaggctgtggtgggaggattgcttgagcccaggcattcaaggctgcagtgagctataatcatgccactgcattccaactgagtgacacagcaagactcctctcttaaaaaaaaaaaaaaaattcatggcagggcacaatgagtactatcaggaaggttcaaaccacgggctaaatcagtagttctaaaacttgactacacatcggaatcacctagggaactttaaaagatactaagatttaggtccaacctgggtttactgatttaacaacctaggttgtggctgtggcctgggaacatggatattaaaaactctccaggtggttctacgcagtggctaggtttgatgacctctgcctagatgtcccaacgactaagagatgtgcgttggggacaaggcaattctcttagtagaaagaggctttcgggacagcattcttattattgagaattgagaattcatatgccacacaatttatccttttaaagtgtgcagctcagtggcttctagcgtaatcacaaggttgtgccaccgtcaccactgtctaccctggaagattttttttcctttttttcttttttcttttctttttattttaaaggctagtcaagtgaaacagtgggagtgaagaagaaacaaagacatctataactggttgtgatcaattagttgtaaacactgcactcagaccagcctgggaagattttaaggatatggtgtggtctgatgggttccaaggcagaggttacaatagcctggaagagggagactgcttaggcagtggcatcctggtgggatagggtgaggagatcccagagcccacgtttactgcaaccctggggagatgtcaccagagaaatgggggtggtgccagacagcagattgtggcagctgaggttttccacggtagagtagaagcatccatcatgtgtgacattcagcagatggggcgctgtgggtggcttggagcactctggttgtaactgaggcaggcaccgtgtttaggaaggctgtgcagtaatctaggctgaagggaggggaaagcctagactaagattgtggctgtgggattgaaatagcgttgaaggagctgactttgactcccggagatgatggggaaagaggaaatcagaagggaccaaggatggtgatgttcttaagagaaactgaggaggaagagaggatgatatggtggcagacgtatagagagtctttgtagatctctcacattggaggggactatggtcggaggtacagatgtcctaaggcaggctggaaaagggagtctggagagagcttggtgttgtagtgaaccacagggagccgcctccttggccctgtgatcacccagggactgaatagagaggcggccctgggagacttcagacacttagaggatataagggggtgaaaggggggcctggctttgagtcaaagggaggagaaggagattataaagctgaaacgtctaagagagtttgtggtctgagcggttctactgcggcaggtgcttctgagaggcagaggtggctgagatctggaaacaggtctgcaaatctggtcactggtctcattgccagtaacgctgtgcgcggttgagggagtgtgttgggagaatagccacgcgttgtctgtcctggaaggaacaagccagtgagagccggtttaatggggcggccggcgaaaggggcttggtgaggcccgcgctcctcggggtgggggcgcggggatgggtggtcgcgatgccgggagggcaggcagggccctggccgtgcttatgaagttggagctgtactctcagctactcgaagctggtccctgctttaggctgcgctcccgcgtgctccccattttctgggccccaggtcccgccttctaaatctccccaggtctccagcccactggaattttctcttccaagcgtggccccgccctctccgctcgtgattggccctaagttccgggccccagtttcattggatgagcggtcgggggaccgggccaggtgactaagtttccgcggcgccttctccccggccactgcttgagccgctgagagggtggcgacgtcggggccatggggctgggcccggtctttctgcttctggctggcatcttcccttttgcacctccgggagctgctgctggtgagtggcgttcctggcggtcctcggcggagcgggagcagtgggacgtttccgggggtcgggtgggtagcggcgagcgctgtgcggtcagggcggggctcctgtgccctgtcggtggcgcagggagctggacgcggcccgttaccgccacacttcagccctgcttccccgtcacttttcagtcctcctcgggatcgcgcatcacctgcactttctggtctcctcctgctctttctctcctcgcgtctcctccgcttcctctcacttttcggacaaaccagtccttctgaggcccatgggttcccgggctgcctccggggctgctcctgtgaatggcattcgagtgcccttccagcgcggccactgaagcagccacaacccccggtgctcggggcggctctcaggtccctgaagtcctgtcctctcccggagccgacgtgttctcagctcctgggccgcagctcctggagtaggggccctcctttctcgggacccggagctggtgcttcctgctgctgtggggactgtggggggtcctgactctcaagctgaggggttggagtctgcaggctccgggcagaggattcttcctgcgacttctctcatccccagctcattctcccctcgcctctggctccgagggtcctctcctctctctcatcccacccctactaatgaccagtgatctaaggacaccagattccctctcacctcctccctgcccatctcagggcccgctgagtccttttgccctcccagctccctgctaccccttcctgtgtgctgttctctgatccatttctagggtgtcctctgccctcatcccctgtccccgccaccgaaggtccctcctgcaccccttatgggcctttcctacaagcagccttcacccagtgctgcccctatgcctccccgttcccaaatgtccctgactctaactttctggtgctgccttttatccgggggggtcttccctccatcccactcccctccagacccccaaggggaaccctgatgctaatggcagttgggccttaggcagggcgcagggcagcgcagatgccccctcccctccagtgcagatgcctgctctggaccctgcctcatggtggccccttccccactccttcatcctcagcctcaccctcttgaggaccccaccctccagcccacaggtgctggaccatccctccctggtccctccgcccctctccaccttgggaccttgtgctgctcctgtctcttgcccagctgccttgggccctcagcacgttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccaccccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttgactgtactcaccctgctgtgctatctactagatcttattcattctaattatatttttgtacccattattaaccatccctgctcccccactccccactacccttctcagcctctggtaatcatcattctattgtctctccccatgaggtccattgttttaaattttggctgccacaaataagtgagaacatgcaaagtttgtctgtctgggcctggggcttatttcacttcacaggatgacctccagttctttgcaaatgacacgatggctgaatagttctccacatacacatgtacaccacattttctttatccatgcgtctgttgatggacacttagattgcttgcagatcttggctactttgaatagtgctgcaataaacatggaaaagtagatagctctttaatataccgatttcctttctttggagtatatgcctaacagtgggagtgctggagcatatgacagctctattgtatttttagtttttggaagaacctccacattgtttcccatagtggttgtactagtttacgttcccaccaacagtgtacatcctcaccagcattccttatttctacatcctcgccagcattccttattgcctgtcttctggataaaagccagtttatctggggtgggatgttatctcgtaggagttttgatttgccttcatctgttgacgaatgatgttgagcaccttttcatatacctgtttgccatttatatgtcttcttttgagaaatgactattcagatcttttctcatttttaaattggattattatattttttttcctatagttgttcgagctccttatatgtttcagttactgatcctttgtcagatgaatagtttgaaaatattttctcccattcttggatggtctcttcattttgtttattgtttcctttgctgtgcagaagcctttttacttgatatgatcccatttatgcaattttactttggttacctgtgcttgtggggtattactttaaaaatctttgcccagtccaatatcctagagagtttccccaatgttttcttgtatagtttcatagtttgaggtcatagatttacatctttaatccactttgatttgatttttgtatatggtgaaagacagggtctagtttcattcttctgcataaggatatctagtttccccagcaccatttttgaagagactctcctttgccaatgtgtgttcttggtacctttgttggaaatgagtttactgtagatgtatggaattgtttctgggttctctattctgtttcattggtctgtgtgtctgtttttatgccagtatcatgctgttttggttactgtagctctgtagtataatttgaagtcagataatgtgattcctctagttttgttcattttgctcaggatagctttatctattctggtttttttgtggttccatatgcattttaggattatttttattatttctgtgaagaatgtcattagtgttttgatagggattgcattgaatctgtagattactttgggtagtatggatatttcaacaaaactgattcttccaatccatgaacgtggactatcttttccattttttgtgtccttcaattttttgcatcagtgttttttgtttttggtttttgagatggagtttcactcttgttgcccaggctagaatgcaagggtgtgatcttggctcaccgcaacctccgcctcccaggttcaagctattcttctgcctcagcctcccaagtagctgggattacaggcatgtgccactgtgcctggctaattttctatttttattagagatggggtttctctatgttggccaggctagtcttgaactcctgacctcaggtgatccacctgcctcggcctcccaaagtgctgggattacaggcatgagccaccacgcccagccacatcactgttttatagtttttattggagaggtctttcacttcttcagttaggtttattcctcagtattttattttatttgtagctattgtaaatgggattcgtttcttgatttctttttcagattatttgctgttagcactgatttttgcatgttgattttgtatcctgcaactttactgaatttgttcttcagttctaatggttttttggtggagtctttaggtttttccaaatatcagaccacatgatctgcaaacaaggataatttgacttcttcttttccagttttaatgccctttctttctttctcctgtctgattgctctagttaggatctgcagtactgtgttgcataactgtggtaaaattagtcatccttgtcttattccagatcttagagaaaaggctttcagttttcccccattcagtatgttactagctgtgagtttgtcatatatggcttttattatattgaggtctgttccttgtatacttagttttttgagagtttttatcatgaagggatgttgaatttatcaaatgctttttcagtatcaattgaatgatactggcttttgtcctttattctgttgatatgacgtattacattgattgatttgtgtatgttaaatcatccttgcatacctggaatacattccacttgctcataaagaatgatcttttttaatgtattgttgaatgtggtttgctagtatttccttgacgatttttgcatcggtgttcatcagggatataggcctgtagttttcttttttatgatgtgtctttgcctggtttttgtatcaggatattcctggctttgtaaaatgagtttggaagtattccctcctcctctatttttcagaacagtttgaataggactgacatatgttgttctttaaaagtttaattgtggtaaattatacattacataaattttactgttttaaccacttttaagtgtatactcggtggcattagatacattcacatttttgtgcaacccaaaactctgtgcccattaatcggtaactccccattcctccctacctctggcccctggtaaccaccattctactttttgtttctatgaatttgaccactctaggtacctcatttaagcagaatcatgtaatgtttgtctttttgtttctggcttatttcacttataatatttttgaggttcggtgggcacagtggctcacgcctggatttccagcactttgggaggctgaagcaggtggatcacctgagtttcggagttcgaaaccagcctggccaacatggtgaaaccccatctctactaaaaataataaaagttagccgggcgtgatggcgggtgcctgtaatcccaactacttgggaggctgaggcaggagaatcgcttgaatccgggaagtggaggttgcagtgagctgagatcaggccactgcactccagcctgggcaacaagagtgaaattccatctccaaaaaaaaaaataaaacaataataataataatatttttgaggttcatccaagttgtagtatgggtcagaatttcattccttttaaggatggataatactcattatatgtatgtaccacatcttggttatccatccctcagacaatggacacttgggttacttctaccttttggatattggcaaatatttcatttcctttgggtatatatttatttcctttgggtatttcttttgggtatatatccagaaatagaagcagtacacaggggcttcattttctctgtctctttgccaaccttgctctgtgtgtgtgtgtatgtgtgtgtgtaggtgtgtgataacagccatcctgattggtttcaggtggcatctcattgtggtttggatttgcattttcctaatgagtgctgatattgagcatcttttcatgtgtttgttgatcatttgtaattttctttgaagaattggccatttaagtcttttgcccattttttcccccacatagcttctcttatcagatatatgacttgcaatatttatttcatttcggggttgattgctttttcactctgattgtgccctttgatgcatagatgttttgaattttcatcagtctactttgtcagttctttctattctatctgtgctttggtgtcatatccatgaaagcactgtcaaatcctatgtcatgaacattatccccaatgtttgcttctaagaaatttttaggttttagttcttgagtgtagagtttaggtctttgattcattttgagttaatttttgtatatagtgcaaattaagggtccaattttattttaacaccccctgcccccagaactatttgctgaaaagatcaactgactctttgtcacctgctcaccccagtggacactagctgttccatccaattgctgtcctggggccttgtcatgctactcttccactttgaacccaagcccacaccgttcgttgctcccctctgggatactgaccccactataaacttctctggggctacaaccttcctaccctttgtgcctcatgaccaccccctcccttgtccccgccatgcccatgatgagtctcttctcgaggcagctccccttgcctccatctcaccctcagcctatgcaccacagccacactggacatgggtccctctgagcctgagtcccttcccattcccaccatcccctctggcaagaccttccttccaccaccttcatgctcctcccttgcccctgcagggcagcctctccccttggcccctattcccttagggggcttgtggccacccagtccttgcacctggcctacaagtttgccatcttcattcccccttcttctgttcatcagccccctcctctatcctcccaccctcacagttttctttgtatatgaaatcctcgttcttgtccctttgcccgtgtgcatttcctgccccaggaaggttgggacagcagacctgtgtgttaaacatcaatgtgaagttacttccaggaagaagtttcacctgtgatttcctcttccccagagccccacagtcttcgttataacctcacggtgctgtcctgggatggatctgtgcagtcagggtttcttgctgaggtacatctggatggtcagcccttcctgcgctatgacaggcagaaatgcagggcaaagccccagggacagtgggcagaagatgtcctgggaaataagacatgggacagagagaccagggacttgacagggaacggaaaggacctcaggatgaccctggctcatatcaaggaccagaaagaaggtgagagtcggcaggggcaagagtgactggagaggccttttccagaaaagttaggggcagagagcagggacctgtctcttcccactggatctggctcaggctgggggtgaggaatgggggtcagtggaactcagcagggaggtgagccggcactcagcccacacagggaggcatggaggagggccagggaggcataccccctgggctgagttcctcacttgggtggaaaggtgatgggttcgggaatggagaagtcactgctgggtgggggcaggcttgcattccctccaggagattagggtctgtgagatccatgaagacaacagcaccaggagctcccagcatttctactacgatggggagctcttcctctcccaaaacctggagactgaggaatggacagtgccccagtcctccagagctcagaccttggccatgaacgtcaggaatttcttgaaggaagatgccatgaagaccaagacacactatcacgctatgcatgcagactgcctgcaggaactacggcgatatctagaatccggcgtagtcctgaggagaacaggtaccgacgctggccaggggctctcctctccctccaattctgctagagttgcctcacctcccagatgtgtccagggaaaccctccctgtgctatggatgaaggcatttcctgttggcacatcgtgtcctgattttcctctattgttagagccactggataaagacagagggtcagggactggaccatccagtgttgtaatcagggcaagtagaggaccctccgacagaatcctgagcctgtggtgggtgtcaggcaggagaggaagccttcagggccagggctgccccctctgcctcccagcctgcccatcctggagagttccctcctggccccacaacccaggagtccacccctgacatccccctcctcagcatcaatgtggggatcccagagcctgaggccacagtcccaaggcccatcctcctgccagcctggaagaactgggccccagagtgaggacagacttgcaggtcaggggtcccggagggcttcagccagagtgagaacagtgaagagaaacagccctgttcctctcccctccttagaggggagcagggcttcactggctctgccctttcttctccagtgccccccatggtgaatgtcacccgcagcgaggcctcagagggcaacatcaccgtgacatgcagggcttccagcttctatccccggaatatcatactgacctggcgtcaggatggggtatctttgagccacgacacccagcagtggggggatgtcctgcctgatgggaatggaacctaccagacctgggtggccaccaggatttgccgaggagaggagcagaggttcacctgctacatggaacacagcgggaatcacagcactcaccctgtgccctctggtgagcctagggtgaccctggagagggtcaggccagggtagggacagcagggatggctgtggctctctgcccagtgtataacaagtccctttttttcagggaaagtgctggtgcttcagagtcattggcagacattccatgtttctgctgttgctgctggctgctgctatttttgttattattattttctatgtccgttgttgtaagaagaaaacatcagctgcagagggtccaggtgagaaaagcgggcagtttctggagatggtaaggcccctgtctgggcagtagggtcccctcattgctcctgcaaagataggcatgttggtgacaaggcttccataacaggggatgaaagttggggaatttgggaagggaatgggggcagcatctccatctacacccataagtgctgcccaagcaagggtcaaacgcccagctgtggcatcctcctgctgcaggtgaggagtgggcagcagggagggctgcggcgcctgctctgtccccatcccggtctctgtgtctcttgaactcactagggcgcatccaggtggggtgagctgggaatcacgtgctgaatgctaagggcctggatgatcacggcctcagagggagcaaatagtaaaggcagctgtgatctggggagggccagaaactggagaggaatctgaggagaggcggtgcccctattcccttcctctctgcatccccctcccctgtttctccagccatcggggcggacaccgagaaaaagacctatgaggcccagcctgggggccctgcctgtgtagccctttggagaccccttgtaacagggagggtcctgagcacacatggccatctctgtccactttgcagctccccatgcacctcctccaggagctttcttggggttgtcgtgtcctctgcaccattcgaggccctactctttccaggttcccacggcctggcctccctgagtttcttgcagatgacatggatgagtagataagcagatgtccctgggccatttgaggagtggggcccagcccctcatcagggcagctgtggtccctgttttcatcctacctccgagtgttttcttctccagtccctgagggacacagtcctcagggcccatgtttttggggatttaatctgtgctctgtggcctcaccttgccctccctgagccaatttccctttctaaaggtggtcactgcctggtaagtttggagtaagggacggtcagaatcatttcccctacagtcaggttgtttgatgggggatgaaaagagacagcaggaagttttgtgtttctgcaaagacagaagcagttcaggcgacagtaagaggctggggtgtccaggaggatgtgtctggcagtagggtcgctggtttctcatccttgaacctaattgcactgtcaatcggcccctcaggcctgagcagatgggaaggtttgtcccctgccctgcagcaagagggccctgtccaggaggcacccacaacaggggcagtgcaggtctgtggtcactcctgctctcacctgtggcgtctcccgtagagggattgtcagttctggttccctgtgggcaggaatggtttcctcataggtcactggagttttggccaggaaaagagtatgaagttcatgtgccagtttctcaaaattcctgctttcaatgttgatgtccagtaaagatattcgtaatttcagctctataatcttaataggatttcctctaatattgtgaagcatattatatgaaacaggaacacaaatttctcaaaattcctgcgatgtccaataaagattttcataatttcagctctgcaatcttaataggatttcctaatactgtaaagcatattaaatgaaacaggaactcaaatttggagccccctctccaggaggttctgtgtggagatggtggctgtggcagtggcagttcccaggtgcagagggtgggcagaggcagcctcaggctaaggggtctcccctactccacatggagaaaatcccttgtaggttgcaagggcagtggccgggtggaatccctgctagggacagagcaggaaggcctcgcagcctcaccaagcagcagccctggggtggagctgcgtttccagggttaagcggaccaggcaggagtagcggttactcaagagcaggtcacaggcttgggttgtgagggtcaggagaggccaggcctcctcgagcaaggtgggggtcccagggtcaggtcaggtgcagatcctgtggcagccacgtctttccatgctgggcctgctgggccccccaggcttcctgatggggtccccagttaggagctgcctgctcagggctgggaggggaggagcactgagctgcagatagagggcagagcccacagtgggcagggcctgccctggtgtgtaggtgcctctgaaggagaggagggcctggggactgagagcaagggtcagggcctctctttggggaggcctctcactgtaacaggactggtcaggcctgagaggagggcactgggttccctcttgggtcttgtcctttagtcttggggccctttccctccctgcacgatgagtggtgggcacagggcacgggctgatgttgatggagtgatgggagggaactggcaggggctgggaaaagcaaggagggaggaagaaaaaagtgggggcctcatcttccctcagagaaagggcaaatctggttttggagcaactgaagagagaaaagtccccagggaataaacacaacactgcacccagtggagcatttacccatttccctcttttctccagagctcgtgagcctgcaggtcctggatcaacacccagttgggacgagtgaccacagggatgccacacagctcggatttcagcctctgatgtcagctcttgggtccactggctccactgagggcacctagactctacagccaggcggctggaattgaattccctgcctggatctcacaagcactttccctcttggtgcctcagtttcctgacctatgaaacagagaaaataaaagcacttatttattgttgttggaggctgcaaaatgttagtagatatgaggcatttgcagctgtgccatattaattggtgtcattgtttttgttgttttcgtattattattttttttttttaagacagagtctcaggccaggcacggtggctcacgcctgtaatcccaacactttgggaggccgaggcgggcggatcacaaggtcaagagatcgagaccatcctgatcaacatggtgaaaccctgtctctactaaaaatacaaaaaattagctgggcctggtggcgtgtgcctgtagtcccagctactcaggagctgaggcaggaaaatcacttgaacctgggaggtggaggttgcagtgagctgagatcacaccactgcactccagcctggcgacagagcgagactctgtctcaaaaaaaaaaaaaaaaaaagacagagtctcactctgtcacccaggctgcagttcagtgacatgatctcagctcgttgcagcctccgcctcccgggttcaagcacttctcttgcctcagcctcccgagtagctggggttacagacatgcaccaccatacccggctaatttttgcatttttcatagagacaggattttgccatgttggccaggctggtctcaaactcctgacctcaggtgatctgcctgcctcagcctcccaaagtgctgggattacaagcatgagccaccatacccggcctattttattacattttaatttattttattttattatatcatccaccatgtctggcctattttattatattttaagatattttaatatattacgtgtgttgtaattggattatcatcggtgagctttgtgagtgagtgtcttggagatgactcctcctgaccagcccaggaccagctttcttgtcaccttgaggtcccctcgccccatcacactcttacgcattactctatgtctactgttatgggtgtgtaattttataccatagatgtttactctttaaacagacacttctagtctgttttatttcatgtgtctgggagcggataaagtgtgaggttcagggagaaagagaggtctgtctcaatgccttggcacggcatgaagacaatctcccctccttgtcccctttccctgctagctcctgatgactgacagattcacagcagaacagaaaggactgggaagggatggaggtgggacatctggcactgaccttcaggggctgaccctgtgggggaacatctgccctgaagagttggagccttcatgtgatgacacagagctgaagtgtgatattcgggaggggatagagagtgcttggaggttttctgattttgaagaatcccagtcagtcaggttctggcgtaaagtgactgctggggaggtgtggactgaatgaatgaagaataaatgaaccaggaaagtggacatgcaagaggtgggttattcctcaccctatttcttgatgcctcctgactgctggtgttggggcacacagatgggtgatgcacttcttggtcaaggcaacctcagccccacccacgtaaggtggtcatggcagagagtgtaagggtgacacctgtgaaaaagacccaaggcagggatgggagcccttcttgcagcaggagtggatgcaggacctgcctggaagcaagagaaggacgagggaccctggctgggccctgtttcctcccactgcctggttcacaaagcaaccagtaagggagctggagtagggaattcactcatgtgctacttactgatccagagatgtgttcgttgacattttcttttatgttttcaggttgatgtcatttacacattcatgcatttatgttgtgtatttattagtcttgtttattttagttagcaagtgtcacttgttgaattctgttctcattaggtataaattttcatattcattgaagtttttataatcaaaatttaattgtccatgattttaaaagtcaaatatttgcataggatttctctagagaaatgagtcctctctgcatcttctcaatttctgccttcctagaggcaaccattttcaacatttttagctaagtctttcaacttttacttccatatgtctaaatacaattccttcattaatactgcttgatttttccgttgcagtcattatctgttgcacagcacagtggtgaatgcaatagttaattgtacctgttccctttcactcttcccattctttcatcttcccgatgtatttctgtagtaattatgtttggttcagtcgttccttgtttccttttccatgactaattttctcatatgtcagcttgaccacttttcacttcctgaacatttgttcttcctgtagttaatacttgcctttgtttttgtttattttataaatagcactcattaacgttgatatttcttctatttgtattactcctttttttgggatggagtctcactctgttgtccaggctggagtgcagtggtgtgatcttggctcaccacaacctccgcctcccaggttcaagcaattctcctgcctcagcttcccgagtagctgggattacaggcactcaccaccatgcccagctaatttttgtatttttagtagagacggcgtttcaccatgttgtccacaatgatgtcgatctcttgacctcgtgatccacccacctcagcctctgaaagtgctgggattacaggcgtgagacatcgcgcctggcctttttttttttttttgagatggagtctcgctcttgttgcccaggctggaatgcaatggcacaatcttggctcaccacaacctccacctcccaggttcaagggattctcctgcctcagcctcccgaatagctgggattacaggcatgcaccaccacacccggctaattttgtatttttagtagagacagtttctccgtattggtcaggctggtctcgaactcctgacctcaggtgattcacccgcctcggcttcccaaagtgctgggattacagaggtaagccactgcacccagccgtattactcttttaagaaattacagactttggatattccactttaccttcttggaaatgtccctcctgggcccttctcgctgctcccatctggactggaggcttctccctgtggagcagagtcactgtcctaggatctccctccaccgccatctggggcagtgctttacatgcagtggagccacctggggtccagccaaaatgcagactgattcaagatgtcaaggctgaggcatatgagcctttctgtctagtttcatgagatgctgattctcctggttcgtgtgtgtgtgtgtgtgtagagagagagagagagaaagggaattttgctctgtcagccaggctggagtgcagtggtgccatcatggcttactacaggctcaacctcataggctcaagtgaccctcctacctcatcttcctaggtagtcaggaccacaggccacatcctaatatatttttaattaactgatgcagtttctttctaaattagtaagagggctgagcattttttcattgtggcaaaaaatacacataaaatttactatcataactatttttaagaatacagtaccattggccaggtgtggtggctcatgcctgtaatcccagcaatttgggaggctaaggcaggaggatcactggaggcctacagttcaagtcaggcttggggaaagtagtgagaccctgtctccagccaaaaaaaaaaaattaaattaaaatatactgtactataatagtgttaattgtaagcacagtgtagtgcaaccgatctttagaatatttcaccttgaaagctgaaactctgtgcccctttcacaaaaatccttattacctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaataatattccattgtctgtatataatcatattttcttgatctattcatctgttggtaaacatataggttgcttccatatcttgcctgttgtgaataacaccattatgaatacggatatgcaatctttcttttcacttttgtatcccccctcattttggtgcaactaatcttctagtagcttttcctgaaagcacgtgcttaaagtacatttgtgtgtttcaacatatctactatcattttgcctctctccaggaagaggaaagaaatgtattaaggtgctctttggcacagcatttaatggtaaagaaagaaacagtataactggccggtgctgggtttcagcatcctgcaatttcagaactactgtgaatacaaaagaaagaaaggtcctgcccaggatgggagtcactcctatatatggtggccctgggacagcagacctttcctgtcacacctcttccatgagggcccttacttcagtgactgtggtgctttccttctctctatggtccatctatctatctatccagttggttgggtttctctggagaaccctaatataccaatggacagtaagcaaataaaacctagtattaccactaattgccattgagaaaaatatgcctaggccagaagattggtgatggtgggaatagcagggacatagtttagacaaggtcattgagcaagacgtttctgagaacttgaccactggttatctgagaagagacctgaatcgtgtgaggagtgagtcatgtgaatccctggggagcaggtacatgtgggagtcagagcatgggtaggtggcagaaatagggcagagcagtgacaagaggctggtgtgagtggagacaagtgagctgggctgagaggagtgggatgagcccagagttgacagaggggccctgtgttgaggggcttgtaggaaatggtgagacattggggtttcattgcactaagaggggaagaagctagagtggctttgggatgtggtggtgatgatgtgccctaattcccgtttgaaaggtttactctacctgttgtgtgggtgatggacagcggcgtgaatgtctcttcatgtccattacccatttttgaatggcgttgtttttttaatggatgagttgtagtttttttatgtattttgaatattaattcttcatcagatgtatgattggcaaatagctcctcccattctgtgcattttctttccactcttttaataatgtcacttgttgcaaaaaagtttttaaatctgataaagtctaatttatcatttttctttaattgctcatgctttgggtcatccagccaagaaactactaccaaatccaatgttcacaagactttcctcaatgttttcttctaagggttttacaggtttgactcttaagcttcgttgtttgatacattctgagttaattgttgagtatggtgtagggaaggctatgaattgtgtccaacatcattcttttgcatgcggatatccagtttctcagcaccacttgttgcagcaccatctgtggaagtgaggctgacacatttgcaaaatgcattgagcactagtacaccatgcatttatttacttttctttactccacagttgttttgaggaggcttccagtgacaaacacaacagaaatgaaaatacatgaattcttataaaatcaatatcaagtagaattataaactttaaaatgttaagagtgaggcaaggctagatcattactagacaagctgaaacatagactgaaatggagggtttacggttttccttgctacaaattttgttggcccacaatctgtcatgcttactgcataagggagccagccacagggtgggttgatagctcacataaccagtccctggtttcctgcttcagaaacaagttcagattctctccacttacagtaaaaaagtgaattgcaggatgttcaaagtgaagttgacatctacaaagtcaacaaataagtagtaagtgtagacctcagaaatttaacaagattctactttttcccccaaaaaaatgtcctcacaatttcctgctgaaaggagagggttcattcaggggaccacatgatgccgttcttctgctgcagttctaaattaagttgtccttccctctaactacaggtctcacaaacccttgcagccagcttcaatgattttagcttgactaaggttttgggtttttgatattgtttgtatttgagctgcagcctggggcttagaaatgtgacttgggtattttgccaaaatggtatgtttttctatagaatttgacgttgtggagaccctgcttttctgccaggtccccagaggggatacagtgctttgtacctctttttagtacttcattagcagtgatagaagatttggagtgagggcctccctcaatctctaccctctgcctagtgcagaggatcatggactgttgcagttatggcaacaaaaaatttctccagacatagctcctgtcctctggtgggaaaatctcccctggatgagaacactagtttgagaggtagagacactcaggagctgggcttggacaggggaagggaagaggagacagacacaaaacggagtggggctgggaaacaggcaaagggagttcaggcctggagggacctggcctgatgaggcacatgaggaatggggagagtggcaggatctcctattgccagaaaatcgtacttgtacccactgcattcccagccctggtgtatgcatctctaggaaatcagaatgaatttggctattatggtgtcagaaagagccctgaagagcctcgtgtgcctgtcaatgtaatgaaagtgcaggtgacagcccctcctggaaatattgttgccaaatgtttaacccagatctgcctcggtctttaggaaacacagcagagagaagagcaaagtaaaaggcatcaggggaaataatatgataaattcggtgtggagagcatgctaaagttatttggcctgcaataagtaatgctgttctaaaagaaaaaaggattagtggattgttgtagattacaggtaactaaaggacacataatcaaaggcaatgagtggatattttatggaaccaagttataaaaatgtacaaagaatagattgaagaagtgaagatacttgaatatgaaaggactttagataatatggaattattgtttattttctttggtgtgataatgtaggtttttactcttaggagatgcacgatgaggtgtttagtggtgaaatatcatgggtctagcaagttactttagaatggttcagtcaaaaatcttagtctcttcattctgtctctcttcatacatacacacacacatacactcacatatacacactatacaaacacatatagctgaagcagcataaaacctagtttctagtagagggatgcaaaaagggaggagaattggtaagttagagttttttggcaaaggactgacaatgcgccacatggataggacttctattccgctagctggtgctgttgaccttgaaactccatgtgcactccagaccaagggcagagagagatgctcactgtggcgggtaggggggatgtgttcctagaaaatcacaatgacattcccctgagctatatccctggttactacagcatttcctgatcttgcctaacaggattacttccctgaactgtaaaattcctgcagcattgtatacagagaaagaataggagacatggcaatcatggacaagaaaggaggaaatcgtgataggaaagttagagatcctgttgccaacacccagtcaggcattcggaggctggggtcagtctagaagcctttcataatgccacgtggtagctccatccagaaatcctcagttgctccctgacttcttccagccccaggtgatggctagatcctccatgaaaggaaactggttcaaacacggccaatatgcccagcaacccatgggtaatgggggattctccatgttctccccaggaagcctgtctcccgtcttgtaatgctgggagccacactaatcatttttaaatggctgaaggggacccagtatttggtttgatttgattctaaaaatggaggccaagagcctcaaaataaaaaaacagagtggaggtctgctcctgtactcaccattctgatgaatgtaccttgggatcctgaatgagcaccaaaaataaagcagcacctttgtctggggtgatacctgagatgcattgcctcatgccaagaaaattaaggacacagacacacacaaggagtgagtttaggagtagaggtttaataggcaaaagaaaagaaagagaaagaagaatagctctctctcctgtgagagaaggggcacgcaagtgggaattccagcccatggcagagtgcactggattttatacacaggctgaaagaggtgtctgatttgcacagggcccacagattggttggaccaggtgtgatgtttacatagtgcatggggaagctgaccaccccaccctaatcttcttatgcaaataggctttccacttggctgacaccatgttgtctgctccctgctgcacacgtggttggaaaggaaaagagaagatggagccgccatttgaacatgcctagtcccaggtagccttttcctattggcacaactgctggcattcactcaggcaagcttccagcttgcttgtctatgtctgcagctcaattttacaggctgctctttgttagaaaagaaaatgatttgggggctgcttttcattaaaaggaaaaccttaccaaggacttctttactctcactatctgcctaaataatttctttttaactcctctatcagttacaaaatcagttttaaagcacatactgttctgtgatattgggatatctggacattttgttgtcataggagtttatccttgcaggtattaccaaactgcttccttagctatcaacatcctaggaccatgggtcatgacaagcaaggaatgtaccctgctagtttaaagataaacttgatttgcggggagggggtggtttttagttacatgggtaagttcttttgtggtggtttctgagattttggtgcatccatcatctgaggagtgtacatgtacccaatgtgtagtcttttctcccgcaccatcctatgaccctaccctctgagtccccaacgttcattatatcattcttttgcctttgcatgcccatataagtgagaacacatgacatttagatttcaattcctgaattacttctcttagaataatggcctccaacgtcattcaggctgctgcaattgccgttatttcacttctttttgtggctgagtagcattctacggtatatatatatatacaccacattttcttttttttaattacactttttattttgaggtaatcatagatccacatgtaactgtaagaaatagtaaagagggcaggcatggtggctcaggtctgtaatcccagcactttgggaggtggagagagcaggatcacttgagaccaggagctcaagaccaacctgggcaacacagcaagaccctgtgtcttaccaataaaataataataataatatagagaaatgtcatacattctttacccattattcttcaatgacatgttacaaactacagcataatatcacaagggacactgacattgatatggtcaagacacagaacagttctaccaccacaaggagccctcatgttacccttttataatcacactgacctttccccgcttccatgcctaacccctggcaaccactaatatattctctacttctattaaacttgtcatttcaagaaagtgatatgaatggaatcatgcagtatgtgttcttttgatattggctttttttttcactcagcatgattccctaaagattcaaggattcatttacattcttggatgtatctatcaatagattgttggtttttttgtttttttgttgttgttttttttaattatactttaggctctagggtacatgtgcacaacgtgcaggtttgttacatatgtatacatgtgccatgttggtgttctgcacccatta

SEQ ID NO: 1289 - DNA, 57769 bp, Homo sapiens
gaaggttgttcattagcagagatgggagattagctgtcttctggttctcagaggtttgtcctccttcctgattaggaaatgttgcaacaggtgacaggaccaaagtaatcctctctacttttccttacagaccaacccttgatagactacagatctgtggagtggaacagactctattaggacagagttttattttcattgtaaagaaacaaaatgaactccctagagagccaaggtcgatagacctccttcactatctgaatttttatacacacgtacacgtataccatttctatcccccttgtcattgcggtccaagtgacttgcagatattcattgtaatcagaggatgaagaagctgcttccaaattgctcccccattttttcttctctggccagtctctctcatgtagaagtgttgtggccaccttttggaggaagacttcttttaggccgaagctctctttaccctattctcagcactttaggatttcccagattgccattccttggctgaatctactgtcttcaaaatcagttgtaaggagctctgtagtgacagaggtggttcataggtaggggtacttctggaagagggcaggcagaaaatcccagaggagtggggcttttaagaaattgtgacatagctgggcatggtggctcacacctgtaatcccacaactttgggaggccaaggtgagtggattgcttgagaccaggagttcaaaaccagcctgggcaacatagtgggaccctgtctctattaaaaaaaaagaaattgtgacatttcactttaagcacattaaccctgtggtaccagggtctgctaggtgggcagtgcatgtgaagggcagacatctttttccgtatacgcgtaatgtgtgtttgtgatatagcaatttcatatatatatatatatatatatatttttttttttttttttttttttttttttgcaaaaccgttcttacagaagggacaatggagaacattgcagcccaggctctggagcacattcactccaatgaggtgatcatgaccattggcttctcccgaacagtagaggccttcctcaaagaggctgcccgaaagaggaaattccatgtcattgtagcagagtgtgctcctttctgccaggtaaggagactgctggagttgctactaagaaaaatgaaaaatgaagaagaaataaacgagagatgggtagggccattccaaccttgaattgataagcaagactttgagacactgagaagatcaagtaaaacattaagtgaattttcaaggtgttcgtcctgtgaacattcataaatagtggtttaagaaagttggggccgggagcgatggctcatgcctgtaatcccagcactttgggaggctgggcgggtggattacctgaggtcaggagttcgagagcagcctggccaacatgacaaaaccccgtctccactaaaaatacaaaaattagctgggcgtggtggcacatgcctgtaatcccagctactctggagggtgaggcaggagaattgcttgaacctggaaggcagaggttgcaatgagccaagatagcgccactgcactccagcctggacgacagagcaagactctgtctcaaaaaaaaaaaaaaagatggcgagctgctgggttcaaggaaagataacttgattcttttaggaatcaaagcagggtaaattaccttggggatgactaatgcttggtctgacctcacttgatcctaagtaaataataggtctcaaaaaggaaatatgtaaggatgcaggttgttttaaaataatgagccaggagctatcttgtcagcaatcgtgattatattatacatgcatgttgtatttccagttttatggctgctctggtgctgctgtggagcattagacatttattagcttcccctgggcttccctacagcttaccagagctatgagagtctgaaaaatcagttgtccgaaaaatgagttatctattggaaattatgtgctggatatgcccatatcacacaattccccagatccagttacatttgagagcacttttcactatttctcactctttctcttagaatcagcctttccctcccattgcagggtcatgaaatggctgtgaatttgtccaaagcaggtattgagacaactgtcatgactgatgctgccatttttgccgttatgtcaagagtcaacaaggtgggtatatctggagttatgttgaattcatgaagattatgtttctaaaatattgatttttatctcctcctgtaatatccacggtgagagaataaagtttctagcacctttcaaagtacatacttaggcctttttaatctgttaactgaatttcttttcccttttttctgcatcattgttcctctcttggagtagcctctaaatttggttgaagcattgaaaagaatgaagtattaaatagaactaaggcaagagtgtcagtttctagggattggctacagggctcctgccttatgctcaaagagcttggcagttgtggatagtgaatgaaaaagattcctggcttctcagaaggtatggcatctcaatttccagaaaatatgggactgagagcagtaggttttgcagtttcttgtcccattttacattcattctttccttggaaacctacttttaagctagaacttgtattgagccagggatcccttcacctctaccagtctgtgacccctcacgataccaattctgaggtctaagcatttagctttttgtggccagtggcccttttagggctccacccccaggatggctcacattttttgtcttgtcccaaaggtgatcattggcacgaagaccatcctggccaatggggccctgagagctgtgacaggaactcacactctggcactggcagcaaaacaccattccaccccactcatcgtctgtgcacctatgttcaaactttctccacaggtaagtgtgtctgtctctagctagaagccagcagaaaagaaggaagccaaagggtaggcttgaactctgggacttcaaccacctcactccagggcctccatttatctgcatttactcaatggattacacccagtggaggctggaaagaaccacagaagtcttgattcagtaaaacagttgagagttctcagctgtcaactttaggaagtcaagattgtaaggacaatatgtagttgggaaaggtcctttgcttacgattgccaccactccctgtcgcctgaccatttctgaaaatgccaagcaggttgaaagtaggatcatagaatcagttttgttattgttgcagggcctgtcctttgtaacctgaatacaagcaaggactaagtgaagagccatttcatcagtgatagaagctatttgctttgaaaacatcaacctatttataggtctctattttttaaattgaggtgaaattcacataacatacaattaaccattttaaagtatacaatttagtgatatctagtacattcacagcattgtacaaccaccactctctagtttcaaaactttttctccactgtagaaaaacaccctgtacccattaagtaatctctccctatttgtccttctccccatctcctccaatctgctcctgtctctatggatttgcccattttgtataaaaggaatcatataatatgtgacatgttgtgcctgacttttttcacttagcatgatgttttcaaagttcatccatgttgtaatgtcagaatttcctttcgaggctgaataatattccattatatgaacataccacaatttattaatccattcatctgtttatgggcatttgggttggttccagcttttggcttttgtgaataatgctgctataagcatctgtgtataagttttctgtgtggacatatgttttcatctctagggtacatacctaggagtggaattgctgggtctctagtttttataaattttttcctttttagttccccaatgaagaagactcatttcataagtttgtggctcctgaagaagtcctgccattcacagaaggtacagaagctgtgtgtgcatgcgtgcatgtgttgtgtgtattcggggtttgtgtgtgcatgtgttttggtctttttgttgttttgttggtcagtagaactgaatgctgtcaagttgtgttttttatcatacttcttgtggggactgttttctttagaagctcaaagtgcttgaggacctgaccaagtccatgttaatttgttctgagacaaatatattttagatttgttggggctattgtgggttggatcatttagcattgtctgggtttggctttgcatgctgtttgagatatagacaacaaccagttgggaaaatgtacctgttttcctgctataaggagtcattttggtgaattgactcccaaaggaagcaggttgtgaaatgttcctccttagaaaactcacctgtagcctggatagtctcatgtcttggggttcttttctctggcttcttctgaaggcagcagctcagctcattacgcgtgcagcctcatcagcaagggtggccttacacaccatctgagagcaacgcatagtagttggttggggtcctagttcctcttggaagttgattgacttcatccctttatttaaataaacattcaatcttcaagaaatagttattgagcacctacaatgtatccagcactcttctaggcactgaagataaaacaatgaatgaaaaagataaggccctgttcccacacattctattgtggaagacagatgagaaagtatcaggtcatgggatgcctgaggacaagcaaggctgatgtggtagaaagtggctaggggcctgagattgaggaagggtcttaatgagatgacatttcagctgagtcctgaatgaacagagtccaccatatgaagatcatagttttctatgagctggtgcaggggcttagccagttagaaaaggatggccatacatggctagacagtaatgagcaagggggagagtggtccaaattgtaattcatgtggtgtgtcagggagggcccagatcttaaacttcaatcctgagtttgaattttattctgagggctgtgcagaggcatgggagagttgtaagcagggattgtcatgatctgaagtcatctcttctggtttgcatttttccatagcttcccgtccttggggagctaatatgcctgcattctcgagcctggaatctatatgctacttaattatgagagagggagcctcagttttacctttagcatgtgtgcttgcctttcaggggacattctggagaaggtcagcgtgcattgccctgtgtttgactacgttcccccagagctcattaccctctttatctccaacattggtgggaatgcaccttcctacatctaccgcctgatgagtgaactctaccatcctgatgatcatgttttatgaccgaccacacgtgtcctaagcagattgcttaggcagatacagaatgaagaggagacttgagtgttgctgctgaagcacatccttgcaatgtgggagtgcacaggagtccacctaaaaaaaaaatccttgatactgttgcctgcctttttagtcaccccgtaacaagggcacacatccaggactgtgtcttgcctttcagatcttaacagagcagcagggcttaacttgttgattttggagcctcttagtgacctggttgcgtctgtgtcaggaacttaaactttctggttcagtagtgtgttaaacataacactgaataccttactgggatacagatttttgctcagaaatggctatgacactttttctaggctctaccaataaaagccacttgaaggttccatagttggtttatttattgtcctactctgacagaactgcttgaaacagcagcagcagagccttttttgtgtttgcatagagggctgtagttagcgggaaaagtgtacaacatggtagtactggccagatgcagtggctcccacttgtaatcctggactttgggaggctgaggtgggaggcttgtttgaggcttgtttgaggcctggagtttgagattagcctggcaacatagcaagatcctgtctctacaaaaaaatattttaaaaaattagccagacatggtggcacatgcctgtggcctcgctatgctggaggctgaggtgggaggatcacttgagcccatgagttcaaggcttcagtgagctatcattgtaccactgcactcctgcctggatgatagagcaagactctgtctctaaaaaaataacaagtacaaatgaaagtatagtttcctttacaattcactgctcctggccccaaagtttgttcatagtctaaaacagtagttccaaaacctcgctgatcatcagaatcacctgagagtgattccgatcactcactcacacagtcttgggtttcatctcagtcctactgcatctgatctcagggttactacctgggaatctgtttaaagcttcccagaaaaggatagtctcatgtagtgtttataggactataaattggtacagccttttagagggcaatttggaagctgtatttctagaattatttgtacaagcaaaaagatttatacagagtgttcagtgtagtagttgtaatgtcatagcctaagtgtccagcaataggagaaaggttaagtattgacagttacaccgtggaacattatacatggcaatagaagtttcaaaaggatggctggaggggcagtgtctggattgaaggcatttgggctggttcactgcatttaatgtgaatttgttaccaatatttaaaaatctggagattgcacatttcaaaaattcagatttcttgcttttcttgaaaactcaaatttggcaactctgggccaacatttccaaatggcagtagttagtttgtggttgggtaacatctgatgccattggatggaacatctccagttttctgcagttcctactggatccatttaactcatttatgttatctgcctaacccctgtaggcatttgagttgtgatcctggtgttaaaagaatgggacagatttgcaaggaagtccatttgatactctgttagttaaaaacaagctggggaaaaaaaacacaacaagctgcagagcaatatgcataatacggactcatttccataaaacaacactggctgggcgcaatggctcacgcctataatcccagcactttgggaggctgaggagggcagatcacttgaggtcaggagtttgagaccagcctggtcaaaatggcgaaactaaaatactataataaaatttttagttccactaaaaatacaaaaattagccaggtgtggttgtgggtacctgtagtcccagctactcgggaggctgaacttgggaagtagaggttgcagtgagcagtgccattgggccactgcactttagcctgggcaacagtgggtgagactctgtctcacaaaaacaaaacaaaattatatgtacacgcatagggaaacagtatagaagtataataccaagcacagcaagcagagggacatcctctaattttgttgacatgtttatgcttacatattgtttccggtttttaacctaaaaagtctcccaggtgatccagattttctgccatgtttaggaactagtggtccaaagcagggcctcttgtgcagtgtctgtgtgggtggagggagcactaagaatctgcatgtttaacaaatagcctgtgggctttgaacaggtgatttgaaaccacattttggttaacactgggcagaggtaggttctgagggaaaggtctctattctttgatatctctttgagagcgatctttgccttaggtcttccagagaggggaaaaaagtaagacctcagaaagtcggcattttacactgacctaaaagctgtatgactcagaagagcctgactcactcaggctcagtctttctattatttcttaaagcatctaagaccccacgctttctcagtgaagtggcttgtagctaccaattacgagcaattgtctcctccaaaggcaccaattctaacagcaattcacttgggtacaattgtgtggtttggagtaagagcagcagtgaggcaaggaacttaaatctgttcctggctccaaaaatgctttatgatacttgtcctttgtccatcttagtctctgtgtctaaaattagcaccaacatccttcccaggcatgactgagttggatgaaggttataagggtagaagctctctttctggtcagctcttacagtgcctagaacagaactgcaggaatgcatactttttagaatctttatgaccccaattaagtaaaccctattaaggctcatcttcttatttcccctctctccgtttccctatttgaggaggggtaagtatcagaaagagagaacctgaactgaacaggaggaaacagaagttccacatcaactcactacctgtcagccttggtatcaggggtgcccacctcccacccctgccttgctggcggaaccgagaaactcggaaaaaaacaaacaaaaaaacaactgttgtagcttggagagaattaatagaactaggattccatggatgtgaaagtcttcctcaatatgctaaataaaccaagttagataacagtgcagtttgtaaagacacttttttcccacggtttctatcttccagtttgggcagagggcaggaaaggcacaattcttggaacttgaataaggaacagaaattcctaatttagcctcagaagagacatctctgaaaaatactctaccaggaaaaactgaagtgtaaaatgatacctcaaagaaatcaatgctggaacccataggatcatatgtttcatggatgtgcttcaaaactatttctcaaagcaatctgttgcatcagtctttgggctaatgaaggctgccagtcacagttccatcatggaatgactggcatactctgtaatgatctataatactacaactacatcagaactgctctgccatacagatagtaccagatggtgatgtgattattgtaaaggcctcacactatccacctgtccttgcaaaaactcccttagcagacatgcacctagttgacatgaaagaacaattttgaaatgtgatttggaagtgttttatatctggcctactttgctttgaattattctttcatttgccaaagagctcttgcaaggtactgcacaatggctaggcaattattattattaatagtaaaaactgcaattgcttttgcaccaacttaaagagctaaagtctaagcttccagtctcccagcatccctcacacgatggagggcagcacttgagtctaatcatgcttgagatggtgattgcctgatatgtatattaaatactatgctgaagagacggatcctttcaatagtgtttttttcaagcatgttacatttagaattaagacctgcctagaaaataagctacttagtgctgaagaaacaaaaacttgacaagattcctaagttatcatttatatgtaatattcttcctacaacactgggtttggaaggataataaatacataaaaataaaattctgcagttaatatgaaaaagaggtaatgcagtgttgaataatgagaaactgctaattgcggtagctaactccaagccactttttttggactgctcggcccatcatggggcattccttactttggaagtagataagagcaagttggaaggccagagtcaggcaaggctggccaaatcccacttctgcaggctgctgcttgaatcatcctggcctgatagattcccacatgcagcacactgcgattcccacacgcttggatccggttgcctggactatatccgatgcttctgggtaagactgagtgctctgtaactaatgggcctggggtgaaaatgatccaagggttggaaacatcctaagccatgtgataacctcttttttttctttatatcccccacaagttctgatacaatacatttagaaaggaactcactgaagatttgctgaatgaagagagggatggaaggaaaaaggaaggaaggaagggtttatttgatgcagattcttcagcattttgttttcacagactcccttcttttcccctcttctggacccacctttttgccatctcaccgttgatgagcagcttcagcttagagggtaaagacaggcatgatcgcgactggccagcatactggccggttctctctgttagcagacttttgccaagggtttggatggaatgggtggctcttcaggtggaaaacaggtcgtgggggtcaggttttgggtgcctgaaactgctcttccttcactccactgtgccatgactggctcccacccgaagcttcagctgagctggcttgtcagggctcgctaggaactgctgagctgcatctgtccttacttggcgtggcttcctcagccccctccacatctcaagaacgtggccttgggcccctttctgctctgaccattttgcttgcctgggttttttcactgtctgccatgcgcagatcccagctgttcatttgtacctgacctctgactgctagaacctctccattcttacatctcatgtagttccaggtccccagccaggttctggatgttacccaagccccctccccattctccagcttcattctagcctacactttatgctttgccttaagcttttctgatactagctcctattaccatctctagtcttaattctgatagtgggactgctagctcctcttctttcaataataaagggctagctgtaactagctgtgactctgtgatacctaacgccagaagaagctactatattctatcattagtttccttgtctttctcagtgactaaagctaagcctcttgaaggtagagacagccataggaaccttcacttctcaatgaagtgttgatgaatgttacagaaaaaggaactctcaagaatggctgcattttacatctcatctctcaagttttactctgaagttactaaagccttcagcgaccagaatctaataaaggtgaatcaccaagtttataaatgaatgaattcctaataaattaaaaatataagggatagcatatgggtaataatgggaaggactgtgcagtttgaagtcactcagacctgggtctgaattctggctcttacagctaagccttcagcaaaccagttaacagctccgagcttcgaagttttattatacaaaggtgacaactaggttcctaagaggaaccttcgtttcccactttgtaaaatggtgataaagctaccaccttacctcatggactgtcaagaaactaaactaagataaagtatgagaaaaattattttgtaaaccttaaagcacaatataggtattaatgattactattataaattacatgtatctttgttcttatggcatctgagttaaaaacaacataaaaccctaacaggcgataaaggtaatctattagatatttttccctaataggttgtttttatgctgaggcatgcccccacacttataaattatgaaaacagaataattatctcttacattgcttgagtcaggctagtcaggaaggccggttacataatttatggaggactttttctaatcctctgctactctcaagaaaacagtagttgggattacatatagcaaaaccttctgaaatcataagaggcactgagacactttttaaaatccctcaaattggtctggccttaaaagatttttacaactcccaggacagttggcctccatgcagccctcaagcagggaggcggaggccctgaggccacactgccacactgggcctggaggcagagcccctgacagcctggcaaatcctctgaaaactctctcctttctaaggtcatgtcttcccatctataaaacatccgtttatatgtatttagaagaataaaagccattttttagacagtagggcctgttcttcaggattccaattacgtaaatctacaaggatccccttgaaaacaagtgaaggttttctctgaaccttctctggggcagacgctaatgaatgcaatactttcattgctcctgtaagattcacttcaaggctgctggcaaaggaacttttcttccatgagcacgaattggtttcctgtattaaaaaatgaggaaaatcattcaattgatataaaagccactttgagcaggctggtcaggaaatacaaaagtagaaattctcattgcatcatcttactaattgtatagcaccccagttgcaataaacattaccagctggctttttgcattttttttctactatgcaattttagtctgttgagtcctattaaccacaaatcatgtgaaaaggtgcgggaaaaatagattgagaatggcataacaagcatttgcagaacgatcagtcctggtcccaagtgatattataagggcaatagataggcataatgtaataacaccaagataccgtttgaaagggacccaaagaacccttgtctcctgaaagaaaaagtgtaaagatatttggttaggttgaacgtatgtatgctgtgttttgatatgacaattgctttcacataaagagatactttataaagtaccaaaaaaaatcatattttaaaaaacaagctcatagtattttcaccattttactggtttgggatattgaacatcagtctctgagtttttaaagaaaacataacaaaaaacccggaacaggactttaaattttctctgttctatccttgtcctttttatcaatagtttttatccctaaaataactaaaggcctgatgaaagaccctagagaatgttttcactgtagtagagaaactctttaagtctgagatgtagcacatgaagcagcagcatagggaagtgaagaagactgaagggaaaagaggggaccagtgcagaaaccctgggggcagcctgggaaggcagactaccccttggacttgagcatcagctgaattagatacacgcaaatgtgaagcttgaaaaaaaactgtacaaaaacaaaaatcacacccttcaaataacaaaccaagcaaccaatcaaactgtcattaaattttatcattaaataagtagcaaaaggtagatactatatagcaaccttctgtgcccatggatgcaaatgaatgaattgtctttaggcttgaatttcatctggctactcaactaggggaatcatctgctcaagaaagactgatacagagagccctgctgtctaagctgctcagggacactgggctgattcagtcagggccgtgctggtacctgctgctgctgctctctgctcagaggcatacagtgaacatccctttgttccttttagaccagtgattctgttctcatggtggctcacagggaggcatggattgctgcaggctctgccttgtatcacactctgcttttccaaagagacgccaggcctgggccattttgcgaagtttagtgaggttgggtttaatctatgggaagaaagaataacttcaattagcaatatgaaaaggtaggtagcatacaggctgggcgaggtgactcacacctgtaatcccagcactctgggaggccaaggcaggcggatcacaaggtcaggagtttgagaccagcctggccaatatggtgaaaccctgtctctactaaaaatacaaaaaaaaattagccgggtgtggtggcgcatgcctataatcccagctactcaggaggctgaggcaggagaattgattgaacctgggaggcggaggttgtggtgagccaagatcatgccactgcactccagcctgggcgacagagtgagactccgtctcaaaaaaaaaaaattgaaaatgtaggtagcatacaaatatttccaaagtctggctgttataatctgtttagatttctaacttctggattcaatagagattacagattgttttaaggatccaaggggactcagaactttaagtctagattcccagctctcagcaatggagaaaaactttcttcatatttttctttgtgaaacaaagaggttttaatgaagtaaaatcagctagttgagtcagacaacattagtacctgaaaactccatgcaagaaaagattttatatcccttagcagggaaaggttagcaaaagaaaagattttgggcagggcgcagtggctcatgcctataatcccagcactttgggaggccaaggtggacagttcacctgaggtcgggagttcgagaccagcctgaccaacatggagaaacgctgtctctactaaaaatacagaattagccgggcgtggtggcgcatgcctgtaatcccagctactcgggaggctgaggcaggagaattgcttgaacccgggaggcagaggttgcggtgagccaagatcgcaccattgcactccagcctgcgcaacaacagcaaaactccgtctcaaaaaacaaaaaaaaaggaaagattttggaaagcagcaacagggacattcctgttatgttctccatgttctccttcactgaagattataacaaggacagaagttcttcatttaagccattctgtgccttttctgcattatccacattgtagtttgcaggttgctgggtaattagggccaaagcataatgtagagatccccaagcttgggtccctgtctgatgatcctcaaaccataactcaagatccttggggatggccagctacagtcacagatcaccgtttccagcaggtactatcaagaaactggaagttgaggctctatattgccaacagtgaatttgctgtgcttctaccaactttcagtagcttcagaaagaactgcatattatgaaacctagagccagcaggcaatagatattcagggtacataagtctgtacatgtgttaagttttaaaatacaaagccattatgtaggtgacctgacagttcagtctaagttccattttggatttgagctggaaaatgaaatgggtgaggctttatgtgaaacttccagtgcagattttgcaaaactctcctattttggaaaggttaagacagattacagttgcatagtaaaagccagaaaagaaagagaaaataaactttgctccctcctgctcctgttagtcattaatgtacctgtttttcctgttccaagtggtctatgtcagctaacggcagcatagaaggtctcccgtgagcacactggaatggcagctggcatgaggacagagcttcaataaggcggcaactttcctgtaagctcaggccatcattaaacttaatggcccctaaatgaaagacagaaacaagaaggttatagtgtatatagtgggaaaccaatgctgaccttgggtcactgccaaatatctggaaaaagtaacatgtttcttaggcttctttaatgaagctttaatcctgcttgaaattggtgcttataggccgggcatggtgtctcacacctgtaatcccagcactttgggaggctgaggcgggcagatcatgaggtcaggagttcaagaccagcctggccaatatggtgaaatcccgcctctactaaaaatacaaaaattagccgggtgtggtggcacgcgcctatagtcccagctacttgggaggctgaggcagaagaatcacttgaacccaggaggcgggggttgcagtgagccgagatcacgccactgcactccagcctgggcaacaaagcgagactccgttctcaaaaaaaaaaaaaaaaaaaaaaaaagagggaaataaattagtgcttatgaccatggatgaaactaaggcttcaggactgaccttctgtctctcagctttttcttacggagtatttgtatttctaatctctgtaggaggcattccttaacttgttaggatctggctttcagagtttttctccaagaggcaagagcagtatttttgcctactctttatgggtttgtgaagttggggttatctttctccatggatcgtccaatagcaatctctgattgtttccttacaatgttcattttatttgcttctttttttctaatttccataataatcttcctaatctaaactctcatattgttataacctgcctttatgcacaatttacccagtcaacaaatatttattaagtatatactttgtattgggagctttgtcaggcagttagtgagacagataatttccatcctcatggcgcttatggtctaataggggagacaaacatgaagcagataattatacaataatttaaatgataaatataggtgctataaaatacaggatatgaatatataataggaagaccaaacccagtttaggagcttaaggaaggctttcctggcaaagtagtattcaagctgagactttaggttaagaaagacgtggctaattgaagaaggagagaaaagtgtttcaggtagaggagaaggccagtgcagaggccccgacgctgacaaatgtttagcacacaggaagcagaagaccaaaaaagcaggctgggatgtaaagaacaaggtggagagtgatatgacgtgacactggagaggcaggcaggggccaaatcacgaagacccttgtgggccacagtaaaaaatcacatttctatcccaagagcaatgggtcatcattgacacattttagttagaagaacaacatgcttggagggatgtttcaaaaagattcctctgggtgctgagagaagagcagcttgaaagggagccagagtggatgtgaagaactaagtaagagagctcaacagtggcaaaaatgagggaggagccagacagactgaatcagacggaccgaagatacattttgaaggtggcaatgatgacatttggtgatagaggagtatgagtctgttctcacactgccatgaagaaatgaccaagactcggtcatttataaaggaaagaccatttaaatgactcacagttctgcatggctggggaggcctcagaaaacttacaattatggcggaaggtgaaggagaagcaggcaccttcctcacagggcctcacccagctccccattttctatattgtatcatattaccctgctcaagaaccctcaatggtgttcgctttggcagcacatataataaaattggagtgatacggagaagattagcatggtccgtgcacaaggatgacatgcaaattcatgaagcattccatcttcattattattattattattattattattttgagatggagtctcactctgtcacccaggctggagtgcagtggcgtgatattggctcactgcaacctctacctcctggtttcaagtgattctcctgcctcagcctcctgagtagctgggattacaggtgcccgccaccacgcctggctaatttttatgtttttagtagagatggggtttcaccatgttggccaggctggtctcgaactcctgacctcaggtgatccatccgccttggtctcccaaagtgctgggattacaggcgtaagcaaccgcgcctgggcgcattccatctttttacaaaaaccctagaagaaaacctcagaaataccattctggacgtaggccttggcaaagatttcctggtaaagactctaaaagcaactgcaataaaacgaaaattgacaagtgagacttaattaaactaaagagcttctccacagcaaaagaaactatcaacagaatagacggacaacttacagaatgggagaaaatatttgcaaactgcatccaacagaggtctaatatccagaatctatataaggaactaatatccagaatctataaggaacttaaataaattaacaagcaaaaaccaaaaaaccctattaaaaaatgggcaaaggacatgaacacacacttctcaaaagaagacatacacatggccaacaagcatataaaaaatgttcaatgtcactaatcattagagaaatgcaaatcaaaatcacagtgacataccatctcacaccagtcagaatggctggtattaaaaagttaaaaaataacagatgctggtgaggctgcaaagaaaacagaacacttatacactgctggtgggaaatataaattagttcagccactgtggaaaacagtttagagatttcttaaagaacttaaagcaaaactaccattcaacccagtaatcctattactgggaatatgcccaaagaaacagaaatcattctaccataaagacacatgcatgtgttatgctcactgcagcactatttacaatagcaaagacatggaatcaacctcaatgctcatcaatggtggattggataaagaaaatgtggtacatatacatcatggaatactatgtcgccataaaaaagaacgagatcacatcctttgcaaaaacatagagctagaggccatcatcctaagtgaattagaaaaccaaatactgcatgttcttacttaaaagtgggagccaaacattgaatacacatagaaacaaagaaggggtaacagacacctgggcctacttgagggtggagggtgggaggtgggtgaggatcagaactacctattgggtactatgctcattacctgggtgacaaaataatctgtacaccaaacccctgcgacatgcaactcacccatgttacaaagtgcacatgtaccccctgaacctaaaatgaaagttggaaagataaaaaaagaacgcttgctaattctaatgccttctgtatcaaatccaaaggttttgctgtgaccttctaggtttctgttctcttacctgcctagtttcttgatactctttgctgcttctcatataactaacttgtttctgttctgcctctctgcacaggctgtttactctccctatagtgaattcccctttccatgctatgaacccatgttccccagctcattcaaaattcatctcaaaatgcatctcctctaggagttattcctccactcatataggtcaggcagcactatagtcaaatttttgtgttgggattttgtttttgtaaaagtgatttttaaaagggtatattcagtttcttgatctaaattgtattctccaagagtcaagtagtaaatgtaccctctgcctcttttgtaatcccggcagccctgccagggctctgcatgcagaggtgtttgatcactgctatgttgaagggcttaccatggcaggcttgggatgccaacaccttctggacagtcagtggcaatgtcccttggatgcctccggtggtctggagtagctaatgcataaacacgttattaacaggaaaagaaaacggaacaacgaagccttttatgtgtggtgcttctgtgtgaaaccccaaaataaaggaaaagcttacctccagttgttctcggataaattcctgcaaagcaaaaggaaaatcggctttaatctacggttatgttttacttgccctttgatagtttacaaaatatctcaattttcttctttaaatcatgcctcctgaaagaaagagttccagcaatacagcacttgggtacaaatttatttgttgtaaggcactttgaatatgaaaaaaccaagcaactgaatagaactcttattgaacacagaatatatttagctactgagacttcctccagagatagcttctcaactaatgaggttatgtagctggtgagagtagccttgatgattcaaccaattcaaaacatcaggaaggcttctcactaaaaggctgtctgtttgtgtgtgtaatcttagccagaacaagcgtaatattacacacaaactgagaataaatacacaacaaccatcaacacaaccactgctcagtataacacttgcttaaatatcataaacataagtaaacagtcactttagttcccacgggctttttggggacaattcccttcaggtcagaaagtttattttctgaggccctttgttgagaaatttctcctcccttgcatgtctctgtccctggggtaaccttttcaatagttatatccctgtggatattaatatttacaaaagaagcttaaagaaatttaaagcagacactatttcatgctaccaatttgtttaacctctggaggtaaaaagaaaaaaacctgttgcacatttaatgatttctttataagaaaatcatttctttactcctggaaaaggctatgtgtaaatctgctcctaagattacaacatggtaccttttcttttaaaaccagactcaggaaattctcttccctccttcatctatactctagtctgccatgcctataaatgggcacagttatcaagagctaggtagtagatactatattacatataatttaaaaatcacatgttttcccaaacaaacctaaacagaaagatggtctcataagactcaatccactgacaaagcttagtgtggatggagagcaaacattcttgtgtttgtacatctgggatggtaaaacatctgtttgtaagcttagtgaaggggtgatgggtctcatctcagtccattttatattccaatggtctgtttaatgctggataatttaatatttttattttattttttatttatttatttagttagttagttacttattttgagatggagtttcactcttgttgcccaggctggagtgcaatggcacgatcttggctcaccgcaacctctgccttctgggttcaagcgattctcctgcctcagcctcctgagtagctgggattacaatcatgcaccaccacgcctggctaattttgtatctttagtagagacagggtttctccatgttggtcaggctggtctcgaactcccgacctcagatgatccgcctgcctcggcctcccaaagtgctgggattacagttgtgagccactgcacctggccgtatttatttattatttttaattttttgagacgtagtctcgttgttgcccaggctggagtgccatggcgcgatctcagctcactgcagcctccacctcctcaccaggctagaagatagagctttatagaaggatgtattaatgatctttcaactgctaggattcaaatagctacctcctcaaaacaccaaaactgttccagcttcttccagaatcacacaaagtctctcctgatcagcctgacataggataatcaagattttatgaaaccagaggtttgtttccatttgaagcaaactccttaacagtagtcttttaagttccttcaggaaaagtttttcttataattttctggttacatattagggattgaattacaataaaagactctaacagatcctatcttttggatttaggacaatttggagcaggggtcttagagaaagcatgtctgtggggaggaaagagctttgctggaagcagagcaaatctttggatctgtctgatccaaaggcgattctggaaagggcaaagccaagatgacccaagagctgactgacagctgctcttcctcttgaatgtttcccccttggcctgcaaacctgcttacgtcttttttgtcttaaagcaaacaaacacctttcctcagccttgaatcccaccccacacttcccaaccacttctaacctttagctctcaccccatctctcttcttctgtgtgtagccaaagttcctgaaagagttgtctacttagcttcacttcctcctgcttcacgcactcctgactcactgcactcttatcttctgccccacctcatccccaggaaatgattccacaagacaactaatgtcctcatgacagtcaagtccagcgtttcaggctctacttcatagccgttattgaccattccctccttgcttaaaactttccttagttttggcaatattgctttttcctggttttcctcctccctctctaaccaagtattttcagccatccttagaatttcctcttttcagcagagctttccagaccttttccaaagcatacgcaccctggatgctgatgttccacaggctccactcttttgtctcttccttttcactctccatattctccctggacaacctcacttcctcaaggcccttctccagcttctgatactatcaatatatatatactgttaactctcagatagatatgtacagcccagatttattttccaagtaccagatcttttaagtgtgcctatccactgggcattccacctgcaggcacattcactgtgtctaaacccaccttcacgatggaactcctaggcaggtttgttcctcctcatctgtgtcccttctctgtcaatggcaccaccatccttccagccatccatgctacaaccctcagaatcactgttgcttttgttttctcctttattcctttcacgtttgattgctcaccaagtcctcttgcttctgcctcccaaattctgtctcagatatgtcactcctctctactccctctgctactgactcagtccaatcctcatcttctcttaccttaaccactgcaataacccgtcagctgctctccctgactcaaatcttcccacataaatccatcccccaatttatctactacatctatcctctaattttagattttactattttagatattactaaagcacttcagacttctagatgaggtgggtgtggatttgcctgtgctccaaatcaagaaagctactgataaaggagaaggaacaatcatgaaaaaagcaggacaccataaaaaaggaagagtgagatttggggaaaaaaacacaacttctggaaataaaaaatatagccattgaaataaaaaatttagtcactgaaataaaaaactcagtggataagctaaacacataattaaacagaagatgaagagatactttagttcactggaagataagtgaggagatttcacagaatgtatcacagagagaaagcaatgggaaatatggaagagagttgaagaggcatgcagagtagaaagataaggcccagtagatatctgacaaaatttccaagagacaagagagagaatgggaaagaaacgtttgaggtgataatgactgcatactttccaaactgaagaagcatagtgaatctccagaaggaaatgaaaataaatccatacaaagatacatcatagggaaattgcagaacaccaaagacaaagtgaaccatcgtaaaagcaaccagagggaaaatcagattacctacagagtaataattggattgactaaggacttcaatggctaaaacagaaagtcaggctgggtgcagtggctcacacctgtaatcccagcactttgggaggccacggcaggcagatcacctgaggtcaggagtttgagaccagcctggccaacatggtgaaaccccatctctgctaaagatacaaaaattagctgggtgtggtggtgggcacctgtaatcccagctactttgtaggcttaggcaggagaatcgcttgaacctgggaggcggaggttgcagtgagctgagatcatcccattgcactccagcctgggtaacagagtgagactctgtctcaaaaaatgaaataaaataaaataaaatagaaagtcaaaagtagtgaaatattttcaaaatgcgggggggataactggcaatgtgaaattctgtttttagctagataatcatgcaagtatgaagacaaaataaagatactttaaaagacagcttatcattcacggacttttttttttttgagacagagtttcactcttgtcacccaggctggggtgcaatggcgtgatctcagctcattgcaacttccgcctcccgggttcaagtgattctcctgcctcagcctcccgagtagctggaattacaagtacctgccaccatgcccagctaatttttgtatttttggtagagacagggtttcaccacgttggccaggctggtctcaaaactcctgacctcaggtgatctgcccgccttggcctcccaaagtgctgggattacaggcatgagccaccatgcctggcccacggactcttactaaaataacttctatttatttttatatttttgtattttttgtctcaagatctgtttgtggataaaagatcttgtaagagatttacttcagtaaaaaaaaaaaaaaaaaaaaaaaaaaaaaacccaaaagaacacagaataagtaggatgcaagaggcaatggtgaacaaagactctggtgaacactttttttaatctaaataaagattgactataaaataaatgaccaccagggaattaaaaacaaggtggaattaaagtactagacagcaacatggaagatgggaggagggtgatgggagatgaacagtttgtaagattttggtacagttaggaagaggatagagaagtgaattacttttaaactttgataagtatgcatgctaaaagttaaggctaatctctaaaaggatataaatggaatatataacttctaaacgagtagagcaaaaaaaaaaagagaaatacagaaaactataatagaaaacaggaaaggagaggaaaaagacaataaagacaaaataaatgatatttgctataaaaaaagaaacatataagtaatcaaaataaaaagtaatagttctctctaatacctccaatgccacagcccagcagtagctttccaaacctttaccaaaacatatatgtaaagtaatcatatttggaatgcaatctaaaatggaccttactctcctgcttaaaagttttcactggctgcctataggataaaatgcaaactacttagtagaatatgctaaattattttatgatttgaccttgacaacccatctagccaactcccatccagtcaaagatccaagtataacttctgatttccccccaatttttttttttttttttttgagacggagtcttactgtgtcactcaggctggagtgcagtgcagtgatcttggatcactgcaacctccaccttccgggttcaagcaattctcatgcctcagcctcccaagtagctgggattacaggcacataccatcatgcctggctaattttttaatttttagtagagacggggtctcatcatgttggccaggctggtcttgaactccagacctcaaatgatccgcccgccttggcctcccaaaatgctgggattacaggcgtgagccactgcacctggcctgatttccccaaatcttaactaccaatagcctaacgttgatcagaagcattaccaataatataaacagttgattaacacatattttgtgtgttgtatatattacacactgtattcttacaattaagtaagctagagaaaagaaaatgttggccaggcgtagtggctcatgcctgtaatcccagcactttgggaggccaaggcaggtggatcatttgaggtcaggagttcaataccagcttggccaacatggtgagaccccatctctactaaaaatacaaaaattagccggggcatggtggtgtgcgcctgtaatcccagctacttgggaggctgaggtaggagaatcgctttaacccgggaggtggaggttgcagtgagctgagattgtgccattgcactccagcctgggcatcgcaaaaaaaaaaaaaaaagaaagaaagaaagaaagaaagaaaaagaaaatgttaagaaaatcataagaaacagaaaatatatttattattcattaagtggaaatgaatcatcataaaggtcttcaccctcatcattttcacattgaataggctaaggaggaggaagaagaggaaaggttggtcttgctgtctcaggaatggcagaggtgaaagaaaatctgcatttaagtgtacctgcgcagttcagacccaagttatccaaggatcaactgtagatcttaatttgagccatatctattgatagttccctaaacataggatgtatctcaagtctctgatatgtattcctctgtctagaatgcccttctcccctcttctgtactcagcactttcccactattctttttttctttttttttttgagacagagtttcactcttgttgcccaggctggagtacaatggtgcaatcttggctcaatgcaacctccgcctcccaggttcaagccattctcctgcctcagcctcctgagtagctgggattataggcatgcaccaccacgcccggctaattttctatttttagtagagatggggtttttccatgcttgtcaggctggtctcgaactcccgacctcaggtgaaccacccaccacggcctcccaaagtgctggcattacaggtgtgagccaccttgcccagcctagtttcccactattctgtaagacttttctggctgtgtgcagtggctcatgcctgtagtgccgggggtttgggaagccaatgcaaggggattgcttgaggccagaagttcaggaccagcctgggcaacatagtgaggcccccatctctacaaaaaaaaaaaaggaaaaaattagccaggcatggtggtgcgtgtctgtagtccgagttacttgggaggctgaggcaggaagattgcttgtgcccaggagatcaaggctacagtgagctatgattgcaccactgcactccagcttgggcaacagagtgagacctggtctctcaaaagtaaaaacttttcttaagaaaacagcttttctgtgacattttcattgacttcacctccccaggcacacaagtcattctgtgtttccataacacttctgaaaaactatcttggtgcattctagactcttagttttcattacctttatcactgggaagaaagcaaaacacatacctctactagccaaagttcactgactataattctttaaatgcccttcttccttattttgagctaactcatctctgaatttctagctcctggcacaccgcaggtaaataccatgaatacttgttgaagaaaagatgaattcagagaatctacagacaaaatatgaggttaccatcactcagcaatttccttaacatctgcagctgtgtcttacctccacaatactcttggtcacagtagatcttcctctccgaagttcattggcttctctttccacaaaacatagtggtacttttcccacaaggaccagagaatcactagtgtctggaaatacaaattcaaggcccagatcttccagatttttgtggtaacacctaaagagataacctcaaatgttaaaaaaaaaaagagtgctacttcatttgcacttcactactggttccaaatactacttaatagtttttcaaaagctgccacagggcttaacaaccgtattgtttttctcacacttatgtgtgggtgtttgggattttttattatcaaatttcctttttgaattacagtaacctttattgtttttctcttttccattgggaatcaatctgtgtctaagtcttgtttctaagtgtgttttcttcattgaggaactgctaacttctggctgctggcacttaagggagtctggcatgaagaaaaggtctgagagtgatttgaatcagcattaaagcagggaggtaattaacagcccaaggaattgagaagtcctgactaacgggatgtaagtaaatagatctgcctctaatataaattatgtcatagggaaaaaaagatttactggcagtatcatattcccaaacctgaaacatattgggagaaatttctttttcattttcaataatttgtgctgcctagaagaggaaaaatatcctatcttgtgactcactatatgattcgccccttccttacatcccaatgttttactttcttcccattatgattacgataatgaaaactaagagtctagaatgcaccaaagcaaagcagaatgggaccaattactgcagaaactttgctttcacaaagcatggcataaacacagactgttccaagaaatgagaagagtgttctaagccaactgctggaaaaaattatcagggaaactctatcctatactcttcagctgggatacagtggaaagaataggctgggtccagtggctcacgcctgtaatcccagcactttgggaggccaaagtgggaggatcgcttgagcctaggagttcagaccagcctgggtaacatggcgaaaacccatctctaccaaaaaattacaaaaattagtccagcatggtggtgctcacctgtagttccaggtacttgggaggctgaagtgggaggactgcttgagcctggaaggtggaggttgcagtgagcagagattgtgccactgcactccagcctggacaacagagtgagaccatgtctcacaaaataaatattttaatggatgattggatgcagaaaaaaatatattttaaaaaaggaaacaaacagcctgtggagtcagacgacctgcctttgagtgcctgctccactacttaataactgctatgaccttagacaagtcttgtaacctctcttggtctcatctgagaaatggaacaatagttatgcttattcctcacagaattattgtgagaattgataccatcaacatcacattctcatggtggtactgaccataagagtctcctttgttcctctgtcactgttatctctagcggaggaattagagtagaagacagtaattttttccgaccagagccttgtgcctgttgcttctcgtaggaatctattggcagaaagatgaatgggttaagagtaggaagggaagtcttctagattcagataaaaataaagcacggccttgagataatcattctaatgcaaagcagaatgtttaatgttcagttttagattttggatttccatttttaaagtcaaactaataaatattcagcctattaacaattttggtagtatttttcaaaataagaaatataagacttgcatcttacattcagatgaacaagccaatgttcctgtagttaataaatgttgttttgatgacagaggtgaataatgtggattaccaggaacatatgtgggttgaccacacagtcttatggctccagaaggcttccctttccttgagcagggtctcccagtctctggagagaattagtactattctcaaatggtgcagggcctgtagaggtaagtttttctaacactgtttttactatatctttcccaactcttaggccgtcattttataaggaaaagtgaaaacagtagtaatatcattgccattctagtccatgaagcactccttaggtccttgcctaactctttgacattactcattggccacaggagtaaagactttcctggtattttaccacttggtgaacacactgcctcatgatgaggaaaagggtagcaaaaaaaaacatttaaaaagcatatattgctttggaaagatagatttaaaaaccagagatattggttgtctctggggagagaaactaggaggggtggggacaaggatagaaaggagactttattatattcccttttgtgcctttcagaattggatctatttgattatactgcatattcaaaagcaaactaaattttaaaatcaaaacagcatactgggccttctgagctgccactggtctctgcctgatggagtgtgggaaggcatgccaagatcaccgggcatatggaggggcagagctttgtgctggatgtcagagtaagcagcctatccttgcgtacttctgggttgttaataacatctggcaaatatgcctctgaccacataaataagttcacatctttcaattagtgaactaccacattctttcaattataacacaggccaaactgcaggactttagtttaatttttgaacatacagtacaaagtgtgctttctcacaacagttgcagttagaaaagctctttgaggtgtactgattctgctgggagtctcaaattttttctggctgcaaacagatccttaccaatgataagctgctccagacgtatacgctcatgggcagcgtgctgatccaccagcacgagcaggttcccacctagatgagcaaggattgtgaactttgattctcagagcaagacgacaaccatcatgtgtgttgaggacagagaagacttaattcaaactatctaacaacagcataagacaaaacattctgaggagtaacaattgtatcttttatttcctaaaacatgaaattatggggaaaatgatagcaaacttatcccatatgtttgaatcccagatccaattctgaaaggcacaaaagggaatttaataaagtctcctttatactcttgcccccaccccttctagtttctctctccagagattaccagtattactaatttttatcctataagttttattattttccccataatttcattttttaggaaacaaaaggtaaactaagaaactctttagttcaccagcatctcatttagaaaacatagtcagggctgggtgcagtgtctcacacctgtaatcccagcacactgggaggctgaggcgggcggatcatgaggtcaagaaatcgagatcatcctggccaacatggtgaaaccctgtctctactaaaaatacaaaaattagctgggtgtggtggcacgcgcctgtagttccagctacttgggaggctgaggcaggagaatcgcttgaacccaggaggtgtaggttgcagtgagccgagattgcaccactgcactccagcctggtgacagagtgagactccatcttaaaaaaaaaaaaaaaagtcaaagtggcatttcctcaagtttgaagcttgaatatataattcttatgtttaaatactgattttgccttattaattcaactttaatatgataaaggatcgttaaacaacacattgttataatcagctaaccttggtgtacaagctacttggaaacccacaaagaatgtacttccagtgcactttagatcacaagccggagaacgttttctgaagggccagatcataaatattttaggctttttgggccacacgatttctgtcatgcctactcaacaattctttttgagccaaagcagccatagacaatatgtgaatatcgtagctgtgttccaataaaactttatttatggacactgaaatactaatttcatataattttaatgtgtcaagaaatagtcttctttttttttcccaaccattaaaaaatgtaaaaaccattcccatctccctggctgtacagaaagaggtgatgcccagattcccctcgggccatgtttatcctgccttagacttgggcttctcaaacgttcatatcacataccccctggggatcttattaaaacacagattctggctgggcctgtggctcatgcctgtaatcccaacactttgggaggctgaggagggcagatcacttgaggtcaggaattcaagatcagctgaccaacatggtgaaaccctgtctctactaaaaatacaagaattagccgggcgtggtggcaggtgcctgtagtcccagctacttgggaggctgaggcagaagaattccttgaactcgggaaggggagactgcagtgagccgagattgcaccactgcaatcccacctgggcgacagagcaagactccatctcaaaaaaaaaaaaaaaaaaaaaaaagtaaagaaaaaaagagaaatttcaacagatccattttgcttctttcaacatctgcagattttgtagttacacccatcttgagtatcattagtagagattctgatctcaaaaacaacaaagaattccagataatgaaaacttaaaaaaaaaattggccaggcgggttggctcatgcctgtaatcccagcactttgggaggccaaggcgggcggatcacctgagatcaggagttcgagaccagcctggccaacatggagaaaccccgtctctactaaaaatacaaaattagctgggcgtgggtggcgggtgcctgtaattccagctacttggaaggctgaggctggtgaaccgcttgaacccaggaggcggaggttgcagtgagctgagattgcaccattgcactccagcctgggcaacaagagtgaaacttcgtctcaaaaacaacaacaacaaaaaactattacttttctagaaatagtaaaactataggaatttgatcttcacaaattctatattcatgataattctgacagaactttaggttaatttgcctttgatctgctatgacatttactaaacaaggtaaagggaatattttgaaatacatagagaataaatgctctaaaactttagcacttgcctgcaggtactatcaagctggagccagccctccactgctgctcagggctcagccactcaggccttttcagggactttatcccatcaggcatcccttgcaaatgtgctcaagtttctcccattaaaaaaaaaaggtcctctgtcaccctcaccctctgtagtccctcttccgtgtcatgggcacatttctgagtatctccttgcagtctccattagcaccatcagcatctcgtcctgtctattctctgaaacagctctcacttgctaaaatccctaatctctactgtcacaaaatcagatgatcctcatcttacttaatgtcttggcagcgtttggcatgacatcctggttttccaacataacattcttctgttttcttcctatttctctagctgttctttcacagtctcttttgctggttcatcctcttctaccgagctcttaagtgctagaattattctagattcaagacctctcctcactcttcttttttctaggtgataacatttatatccagggtttcagtgatcacttttctgcatctgatggctcaaatttgtatctccatgtcagaacacttgtctaggccagacttgtaatatccaaccacattcttgacatctttttattttatttttttgacagagtttcgctctgtcacccaggctggagtgcagtggtgcgatcttggcgcactgcaacctccgcctcccgggttaaagcaattctctgcctcagcctcccgagtagctgggattacaggcatctgccaccatgtccagctaatttttgtatttttagtagagacagcgtttcagcatgttggccaggctggtctcaactcctgacctcaggtgatccacccacctcggcctcccaaagtgctgggattacaggcgtgagccaccgtgcctggccaccttgacatctcttctggagcatttcaaagactgaactcatgattttcatcctctctgctctgcctgcaacacgggtcctgcaacatcatcaactcagctatggaggccagaacaccagaagtcatcttttacatactttccccatatccaatccatcaccaagccctgctgactctatctcctaaatatctttccaatacattcactgctctctagtccaccctggtcccatctaaccatgtctcagatattgcaatattcttttaacagtcaatctacagttaactgggactccacccctactcctactccattctccacactacaaccagagcaatctttttaaaatgcaaatgtgatgtgacatgtaccaccccaaaaacaacatcaaaatacaaatgataaaaaatgaaaaaaaaaagctttcaatggtttccaacagtattgggacaaagcaaagcttgtagctggcatttaagatctgactcctacctacttctctagcctcatctccagttccccttgccctgtttccactcactgaggagaataaatcacaaattgcatggttgttccctcctttctttacttagttaactcatattcatattcagacctcattttaccaagaagcacttccctgaactccctgatgaaatcaaatctcccaatacaggttcttagagcatcttgtatctctttctccattacaggggctagaactaaaattttatgtttgtgtaattatttttttctcttgcatatatatcttttctcattattgtatccctagggcctggtacagtccctggcatacaatgggcactcaattaatacttgttgaatgagttaatatatttacaaactattattgtttcattagagcaggtcaccaagagattctgtgtaaatattgacaaacctagcagagttcattatatacactttctattattataaagggaaaacatgaaaatattattaaaaagtcaaacaatagaaaatatttaaaagaataaaagatgggctgggcgtggtggcttacacctgtaatcccagctgttagggaggcagaggtggaaggatagcttaagcccaggagttcgagacctacctgggcaatatagcgagaccccgttctccacaaaaaggaaaaaaaaaagacaaaaagagtaaaagttgaaatatctcctttgcacaccctcattttcactcccaaagtaaatactcttgatagtttaatgtgcatcctgagtatatgtatgtgtatgaacataaaactaaatgtctgtcgcccaggctggagtgtaatagcgcaatctcggctcactacatcctctgcctcccaagttcaagcgattcttgtgccttagcctcctgagtagctgggactacaggtgcacaccaccatgcccagctaatttttgtatttttagtagagacggggttttgccatgttgctcaggctggtcctgaactcctggcctcaagccatccacctgcctcacctcccaaagtgttgggattacaggtgtgagccaccgcacccagccttcataatattcttagttttagattggctttccctaatccatccaaatcattgaaactatattatataccaaaaataatcattaaaaaaaggttacaagaagaccagctggttaatcattcaggctaaactccattcttacctgcctcgccattctcttcagtcttagtgctcatcaaacaggcaataaacttgttatctacttgctggagaacctgtcagacattcaaataagtggtacaacactaaataaaaattaacaaaggcttatttgcatagaaagatacagaactgtattttatttagagttgtttgccttatcacactcctttctttgagactgggtaaggttctgatgaaccagaaaaagtcactaggaaggatgaaagaatgggcaggtggagttgatcagaagatgtaaggggagggaggcgacaggggaagacagactcccacgtctcagagtggtgtgctagcaatactttagagaaggcctgagatgttcccaacagagtgactcttgagaataggtaatgtgaccagagattgctaacatacaggctgaaataaatttttaaaatttatatgaaagcaaggaaaacgattatggagaaactagtctatttttatttttatttatttttaatttttttttttttgagacggagtctcactttgtcacccaggctggagtgcaatggtgtgatctcggctcactgcaagctctgcctcctgggttcatgccattctcctgcctccatgccattctcctgcctcagcctcccgagtagctgggagtacaggtgcccgccaccacgcccagctaattttttgtatttttagtagagacggggtttcaccgtgttagccaggatggtctcgaactcctgacctcatgatccacccacctcggcctcccaaagtgctgggattacaggcgtgagccagcgcgcccggctgctagtctattaaagaagtaagttaaaagccactggtggctttagaccttggtggttcctctctgtctaggtacttgaggctctccaatacccccgagcctataccactgccccagggtctatttctggatcaactgcttgcctgctctggtaccaggtcaatgccaggttaggagtttacccaaatttgttagcctcctaatttgtttccgtactgaaaacaaagggaataagacagccatggtggtaaacacaaggcaaaatagaaaagcagatcagacaaagggtcccttttgtgaaatgacttctcaatatgggctttcccaaacctgtgtaggctcacacaatagaaggtaatttctaaaagggcactgttgcacacttaaggacaaggtcactaaaggactttgatttataaattattgccaaatataaagtcaatatataatcttctgcaggagaaccttgagaatccttgaaactgtcagcctgaatccataattcattccctccaaacctacttacactactaaagatatttctttctttgtaattataattaatcccttgctttttcttctgatgataaaagttctagtaagaacacacacacacacacacacacacacacgtgccttgaccaaggtggtctatatcattaaataaatcaaattttagaagagttaggccatatatatatatatatatatatatatatatatatatttatgagattttgaagttaatcttttacctgcattgaatgaatcattcctttggtgaaacgatagggatacaagatgttgtgaattttaactgctaagctctcagcctggccactgcttacatcaacagcaacctagaaagactcagcaaaatataattgaaattttaatttttgtgtcagaattgttttaccaaagatatcagagtgctttaaaagcattcatttttatttagcctactagaggtgggtttaattcagggaatttatagaaattcaaaagaatcggccgggcgtggtggctcacacctgtaatctcagcactttgggaggctgaggcgggcagatcacgaggtcaggagatcgagaccatcctggctaacatggtgaaaccccatctctactaaaaaatacaaaaaattagctgggcgtggcggcaggcgcctttagtcccagctacttgggagactgaggcaggagaatggtgtgaacccgggaggcggagcttgcagtgagctgagatcacgccactgcacttcagcctgggcgacacagcaagactctgtcacaaaaaaaaaaaaaaaaaaaaaaaaaaaaaaaaaaattcaaaagaatttatgaataatgagtcttacataaaaatttttgcttataaacaaaattactgacaaaacaaaaaaaattgtttcacaacaacaatttgtctatgttccatgatcaagtcctcaaatgatatcttgaggaaagaactggtaaacaaatgctcatctattatacaccctgtttataacatgcacagtacattctgtgaaaatacactgaggagagaacatccatgcggggccaatgaggaactgttcctccagtagaagatgtgtggctttatctaatgataacaatttcattatcaccaccctgaatactgtgccaaagctacaagtcagggtttctgagagtggtaaacacattcactgttctcacattgattatacatgtttaatccaaaatgcctgagttcccaaatgctataaattttatttctcccctctacattaaacagtaatttccaaatacataatttggaaatatgcccagtttccaatcataattacaaattaatatagtcttgcatgcccatacccagcttaaataaaattcaaattttatttttaactaatttacttattttttaagagatggagtctcactgtgttgcccaggctatagtgtgcagtggctagtcacaggtgcaatcagcacactatatagccttgaacttctggcctcaagtgatcctcccacctcagcctcctgagtagctgagactataagtgcatgccactgtacccatcttgaaactcaaagtttaaaataacaggcaaagaaaggctgggcgtgatggctcacacctgtaatcccaggactttgggaggctgaggcgggcagatcacctgaggttgggagttagagaccagcctgaccaatatggagaaaccccatctctactaaaaatacaaaattcgctgggcgtggtggcaggtgcctgtaatcccagctgctcgagagactgaggcaggagaattgcttgaacctgggaagcgaaggttacgtgagccgagatcatgccattgcatttcagtctgggcaacaggagcaaaactccatctcaaaatttaaaaaataagaagaagaagaagaaaaaaaaaaggcaaagaaaaactgctacagacccacctctggataacgggcaaatactggattgtcccattctgagaacaaagactgaagcgattcgctactaacagtatcatccacagtatctagggcaaaagggaacaggtaaagttggcatccagaaccacagggaaaggagggaatggcatttcctgtttggtgagccatagcctcaagaccaaaggtcacgtacattgtttctatgttctacaaatgttcagtgtttgctgtatctctaaattattttgatctgttactttttaaactagagttggtgactgtatcttctggcattacagcttttctccaaactgttaaaagagatattgtggaatactgacagagaagctatggctcaaatttatagccttactgcctttaagcaaaatataccttatctatttttaaacatacacacaaaattgatgtctgtagctttttttgaagagttttgcttacataaaactacagcaacttggagtgcaagtccagcctttttaaaaataagaaacatgtcccctaatcacaagacaccacagactatgcataatcagcaaatattgacctcaagtctggaaaagtaatttctgacctaaatgcatgcgctgaattaattagttccgctgttaaacagggccgtggggaattcctgattccagtacagcacagctggcactgatcaagcttaatgcaagcctgctttgttttttgagttaggtggtacgatgtgtactgtgtgccccagcactctctgccacccttacctctgttatcctgtctcatcacagtcctctctgctcgagctctcggaaggaaaggaagaacaaggtcgcttctaaaaggttgacacctgtactgagaccctaaatataagaaagaaaaacctagaaatgtgaacttaaaatacaagtaaactctttaaaaatttaatcacataaaacctctttctgcacaaactgagtcaagacataaagcagactactaaacactagattgagaatcagaaatcctttaatgaaattatgctgtccatataggactctatattaatgcttagttccattatctattcataccagacagaatgaagacctagaataggtcactgtgattctcactggggggcaattttgcacgaggggacattggcaatgtcttgagacccttttttttttttttgagacggcgtctcgctctgtcgcccgggctggagtacagtggcgtgatctcggcttactgcaacttccgcctcccgggttcaagcaattctcctgcctcagcctcccgagtagctgggattacaggcatgcgtcaccacacccggctaatttttttgtatttttagtagacatggggtttcaccatattggccgggctggtctcaaactcttgaccttgtgatccacccgcctcggcctcccaaagtgttgggattacaggcgtgagccactgtgcccggcttgagacacttttcattgtcacaacttgagtaaagggttctacgttctactagcatctagcagataaaggccacggatgctgctaaatattctacaatgcataggacaaaccttacaacaaaaaattacccagagaagccctgtgttagacatacagcagtacttgtcagccataacttggtgcaaccttcacaaatctccaacttatgtctcttatctccaatgtatgtctctatcctaacatttgtctcattataatacaattatatttagatagctatcttccctaatagtactgtgaactcctaaaagcaaagtcagttaacctgcaacgtgacagcacctagcacagtgtggatgatcaacaaatgctgcatgaaaaagtgaacaggtagacaaatgaaaggttctcaattcaaactccagagtctagtaagatctggcccaaatgctgttcttctccatgaaggataatcagatttgagttttagaaacaatgctgaatttgacagctttagaacaggaggaaaacatgagagataaatctgttggactaaacctggagaggttaagaatgataaaattaagataatgaagtgaaataaggtttataactacaatagaaagaactgcataaaatatattttaaagaaaaaattaccaaggcttggggacttgacactactcctcaaaatcacctttatagatcctccttctgtacattaaaatgtatcttttaggctggtggctcacgcctgtaatcccagcactttgggaggccgaggcgggcagatcacctgaggttgggagtttgagaccagcctgaccaacatggagaaatcccgtctctactaaaaatacaaaattagccaggcatggtggcgcatgcctgtaattccagctactcaggaggctgaggcaggagaatcgcttgaactcagaaggcggaggttgcagtgagccgagatcgcaccatttcactttagcctgggcaacaagagcgaaactccgtctcaaaaaaaaaaaattgtcttttaacaatttatttcatgtaacacttttatgtaaagtttgacaatgtcctgatgtcatgatgtatatcagccatttccagaaaggtagcagggtactgaggagccatctgttcatggaacttctttctataccaaaaatatttttcattaggaaactatcagttaacatgaccctcaaaagttcataaaaaagtatgctaatccagaatgttaagtaggttaaagtgttttaaacgtctatattcaaaaggaagaaatatttacgttgaatatggcagctaagatttccccctttcttttagcaacagccatctcacagtataatgtaatccagttattttttggcaccatatcagaagcagttgcatttcaggaagatgaggtgtcagtgctgtagatttacctctgaaaagccttcagtgtaagtcaggacataaaaccacatagattgaaaagcacataaagtggctttaagagcaacttgatagtctcaggaacaacagtgaaagaaatgagttttctcctaatgaatactacaaaatactatgaaatactactgaagttactacagtgatttttttttcacaaggaaaaacagaaaaacactgaaaagtaaaggtttcatttaaccttaaagaaaccacagctttctgctagagatattcatcgtcaggagaaattagaaattgacttataactacatttatacatgttccattcttctgcagcattcaaaattttaaatacggatacagatgtaatgtttatcctcctagtgcaaagccaagattatagccagatggaaatcagctttatcacctcccaacatctggctctcaacacactgccaaagcaatatcactttaaatgtggaccgagaacccagagtcctagtgcaggctctaatgtagccctgtggtacgatctaaaagctatattggttgggtgcagtggctcacgcctataatcccaccactttgggaggccgaggcaggtggatcacctgaggtcaggagatcgagacaagcctggccaacacggtaaaaccctgtctctacaaaaacacaaaaaattagccgggtgtggtagcgggtgcctgtaatcccagctacttgggaggctgaggcaggaggatcccttgaacctgggaggcggaggttatagtgagccgagatcacgccactacactccagcctgggcaacaagagtgaaactctgtctcaaataaataaatgccatattattgtcttcctgaataacagctacttgtaccataaacacatcaaggagattttaccatatgcattataataaagtacatttgaaaagtatagtcatgaaagtatatacttgacctatattttgaaaattcatggacaagtcctactttctagaaagaaaaagctcataaatgtagtactgtactaagccatagagtttactgggaaacctaggatgattacagaatcattctggcccttaacctggaagccacgcagagaaacttccagtaaaataccatgctgacactgcaggtgcctttaaagacacatttctaggaaagctgggcatttaacaggaagggaaaacaaggtaggaaagtactgtggatcttcccaactattaatagtatcatttttattaaaattggacagtctcaccccttttgttgttgctctaggtatatacccatcaccccctttcttacacatacacacacccatagacacatatacacacactgacatcctttcactgtacttctccatttaaatagtgttggacctagaggctgcgtgcgggctcacacctataatcccaacactctgggaggccgaggcaggtggatcacttgaggctaggagtttgagaccagcctggccaacatagtgaaatcctgtctctactgaaaataaaaaaatttagctgggcatggtggcatgctcttgtaatccaagctacactggaggctgaggcaggagaatcgcttgaaccaggggggcagaggttgcagtgagctgagatcgcaccactgcactccagcctgggtgacagagcaagactccgtctcaaaaaaaaaaaaaaaaaaaagtagtgttggacgtagcaaatcttcatatagcatgaaaatacaacatatgttttataagtggtcttcaaaatgttctatctgttgagataatctctttggataatgaggatcttactccttgtccagcattcccatcttcaaaagcatctcatgcacatgaatactacgtacttaccattctcaagtacaacatccacagccacagttgtcaggtctttagtacaagcagcctgaatgtcctcagttggggcaatgaatgtgctgagtccagtcattttgttgacataaaccattcttcccagggctacatcgaaatgccgctgccaatctgaacaacacgtgtttgactcttcagtttcagaacaagctcttgctttagattcctcactctgaaaacaaattccattttggtcacctgtggcatcttctaccggattcattaacattccactgggagagtcaagacttcctatctgttgttctgaggctctgataagaacatctgaatctttaccggtaactttagaattattatagggcaataccaaaggagtttctgatatcacacagttctctgttgtattgctgttagaatgtgttttactatttttattaaaggaattatcctgtgtggcagaatctgatgttgggatgacaccattctctgttttttcatgcttgttgttaaataacatacaaaaatcttgtgttaacacactgcacaacttgctgtctttcctactggaatctgaatttggaagttcattaaaacgactcatcatccccattgtttgagtttctctttcggaacccttcagtctggataatttagaggctagtgattcagatgacttctcaaggtccaaaggttttctattaaagagagataactccttcagggtcataggactttctctcaaactaggcatctgttgttctaaacaatcttcatccttggagaatggaaacttctctgagttaaggatgtggcttgctggttgacaactactatctgaatcactatgctccatagtagtgattttacaaacatcagagttctctaagcggttcttgtccttcagcagaatgtcaggttcaacttgaagactgagattggtagtgactccattactttcctctacttctgtatccagaggattttcaaccttcccatattgcctcttaaacttctctaaagatcctagctgtgaactcaagcttagcttcttacggacgattggtttggagaaaccaattaatttatctgttttcctactatcattggaaacgtgtctataccaggggaaagagggggatgtatcagataatatgcaatctgtttgtgattttttgctaccttcctgaaaagcagaaaacattgtataagttgctgtaggttcattctctagcccataacttatattcgttctgcaattttttttgttgggcaattgaccagattctttacttaaagtgctggctaaatctttgatgtctggagtttcaactgaatgacgtgttctatttccaaatgtttcttgggcacgtgtgggaccaggtctaacataatttttaaatgaatgttctgtttcagttgatttagttttttcattttgtactacatgagttataaagccagtggaacataatttaactcgcccataactaaaaacatttcttcttccacaattgctagattctttttttttctctttctctgtctgagcactatgtactccccataatgttgttgcaaaaggcagaggctggcatcccacttcagtagcatctttaaatctctttggttgattctgaattctattatttttcaagatgttggcagccatgccattaacagtagtactttctttccatatttctagatcctgcccactctcctcaaagtgacatggtgtctgaaaagggcttaaaaacatttctaaactggttccacacggattttctaaagagctatgttccaggaaagattttttatgtttctcattttctccagcttctgatgctacaattgtctcttgttctaacatctttgattctgagcaagagctgtctttgttttgtaaagatggctctgtcattttgctatggcctggaccacctgattcataaatgtacaaaaatgcatcatttgtattttttctggtagcttctgaatccctagaactctgtgtgtttacgttttctgcagtagtttttcttttcacagcttttgactgcaaattaaacatctcataggaatctaaaatattattacatgcttcctggaaattgctcctctcatcggaagtcacacgcttctgaagagtagcatcaaataaactaaaaccattatcttcactaaattccttaatatcctcacctgataattccacaaataatttttcttgctttaaaaacattttcactccttcctgaatgcaaaacaagagagtgtcccagttctgaaattcaatcagagttttggctggctccatgcacacatcatactcacagaattggcactgcacattaattacatatatgccatagagttctggggtagaccggtgccgaagacttgaattcatttgcctactggtgggaccattctttggcttgcatataatactttctttccttaataaaaagtcaatgagtttatgtagctttgtccttaaaactagtcttttgttcacaaacaaaaactgcatattcttgttgtaatgtgcttcagagctgatatagccactaagctcaaactctttatatttaaaacttatttctcttagcttttgggactttcccaatccataaatttgacaaaatcgggaacatacgtctttggttttagggagctgaagaaccatggaaccagaaacatcatttctcaaagagaaagaaatggaagggtgcatgagtgagagagcttctattctctgcctaaccttctcaaactccagtctagggtccatgcatttcctccttacaggaagctggtaaaataggttatacactgttacagtagtcccagcgcttgctctagtcacatcagcttcacaagctttcagggcttttccactctgaaacagtttcacaaaagttttcattgtcctgtttttcttggacgaaatttccacagcactggccatgtcagcaatatttgccaaggcctctcctcggaaaccataaaaccttggattctccaagtcctgtaccgagtggcatttactggtgaaataacgatttcccactttctctacatcatcactccccatcccaaatccattgtctatcacttgaacttggaaggtttccatattcaccctgacagccacacattttgcttcagcatcaatactgttgagggcaagttcctcaacacattggcccaaggagcttatggccaaaccagaacgcaatttggcttgtacttcaactgacaagcacttgatcatggtaggtagaaagatggtgagaatgccaggcactggtttccttctctgactggaaataattgcctattggagaaaaaaaccacacacgcacataatcaaagctttagcattacacagcattatgaagaaatagcacttgaggtaaatgaaatcactcttattaaaccaaattgtgaaacaaagcaaaacaaagttataccgctgatctctaggcacagctcatgcttggtgcaatggattaacatccaaaaaaaattcataatttcataattttcaatgctcctttctaaatcccacatgtcctaaagtgaaatcataattacacttgaagttgaccagtaaacacagtattcgaaattctaaccacttcaccaaaaacagatgcctaaattaaatacagctaaggaacattagctagaaattattcatgacaaaaatgtccaagctagtttcataacatttatacattacacaataaccatgacttttagaaaaatacttataatgaattgctaagacattgtaataaggtgaagcaataggaagaaattttaagaatcaaattgtatcaaagagagattgggggcattaagaggttattattattatggttaagtatagtcacctcagggaaagaggctgggaatgggaaaagataaagcaggaaaattccttttcatataaacctttctttgccatttgattgttaaatcctgttcatgtattactctgatgtttttagaaagtcgttattattcttttttgaaacagtctcactctgtcacccaggctggagtgcaatgacacaatctcggctcactgcagcctgcacctcccgggctcaagcaatcctccagccttagcctcccgagtagctgggattacaggcgctcgccaccatgcctggctaatttttgtctcttatgtagagatggggtttcaccatgttaaccagcctggtctcgaactcctgaactcaagtgatcctcccgccttggcctcccaaagtgctgggattacaggtgtgaaccaccgcgcccggccagaaggtcattattaatattcttttggtctttacagatgggcataaactaccttggtaataataatgatggcatggggctgcctgaacttgattttaagttttcctgcaagtgaaaacacaaaaacaaaaaacaaaacaaaaaaaaccaaaccctaagattccagtgccattaaaggtctccccttcttctccatcagtgagagccacgtgggtgggcccctgcaggcggtggggccggttttccaaactcgggacaaatcagggctcttaactgcagaatttctgctgctttctaagctaatgcactaagcagccggcagcaactgacgggtaaacgtttaacaagtattccgattaatgtaaacccaatgatttcctgatgacgcctcccagcgcctgggactgacgggacgcacgggcctggatccagggcacgggggcctgggagggccgcgcgggccgagtccggggcagcgctgccttcccgccaggcccagcccctccctggccagccccgtccttgtccccaaactgggcccgcccggccgccaggccgccgggcctccggggccctcgcgcatccggctccgaaagctgcgcgcagccatcatcagggcccttctggtgttagaagagaccccggcatcatcttttcgtcgcgtgcttcccccagagtcacctggagtcccgcttaacaaattctccgacaccaaccgcctcggacgccgacgcgcgcaccttggatcttgaggctcgtgcgtgcccacgagcatgcgcttcggagggggcgcgccaggccgcgagacaccagtgcgcatgcgcaccagttgttccagccaaggatccgcatcccagggttcagtgaaccggtacctacagtctcaatccttattcccttttggcatggtgttaaagactatgtcgtagcttttacttttgtttttatttttttttcccgtgttttccctttccttttttttctcattttcacctttgctcttaactaccgtttaattcaatatatattttatgtgtttacttattgtcttctctccctagaatgtaagctatgtgaaggtaaggagtttatatattttgtttactgctgtatcccagttaccaagaacagtgcctggcctatggtaggcaccgaatgaatgaataattccagagcctgccatcttagaattatggcatttggagctggaaaaggctgagaaactgtctaactcaactctttttttttttttttttttttttgagacggagtttagctcttgttgcccaggctggaattcagtggtgcgatctcagcttactgcaacctccgcctccagggttcaagtgattctcctgcctcagcctcccgagtagctaggattacaggcatgcgccaccacactcggctaattttgtatttttagtagagacgggggtttctccatgttggtcaggctggtctcgaactccggacctcaggtgatctgcccgcctcggcctcccaaagtgttgggattacaggcgtgagccaccgcacccggcctttgctcaactcttaatttacagatgacaacaccaagactctcttcactgacttgaatctccccagtgccaccacagcttttagttataaaaataactaaaggagagcagaactctgagaatgctgtgagaataaagtgttttggaattgttaaccagtccttagtttttgctttctatctcattttcattgagaatttaaagtggaatttataacgaatttgtcagacctggtaagcatttgatatatgctagtttagtgactaaccaaacccaaccaaccagtcttctagggctgattaagcaaaatcctgataactgtttatgattattactatacctagggctgccataacaaaatacctcagactgagtagcttaagcagcagaagtctatttcctctcagttctagagactggaagtctgagatcaaggtgttggcagcaacgatttctcctgaggcctctctccttggcttgtagatggccattttcacagggtctttgatttttgcacacgtgtctatagccaatatgttctcttataagaacaccagtcagattggattagggcccaccctcacagcctcatttaatcttaatcacctctttaaaggccctatgtccaaatacagtcactttctgaggtactggggactgagactttaacatatgaatttggtgggacacagttcagcccataacataactttatgtgaattccttacccagagaaaagaaacaacagcagaagtaattcatccaaacataaggtgaacagagctaacaaattgaacttgtggtatttgttcttattaggcatggaatttcttgaagaacatttcatagaaaccatttaaagaaatgactcagactttttttctttcagacctctttaaattacctcaaaatcctcttcctacaaatgtttactgaataaagacctctcatttcgcccaaaaggaagttcactgaagattttttaaaagtactctaagcagaaggttctaacgtttttattgattagatttgtgtacagtggtaatccttccatcatacaggtaatatataataacattcaaaaatctgacattaaaataacttattgactaatgctaatattaacacacaatagttctatctctattaataataaaaaccaaaccactgagtttatcttagaaaacttaaattcaggccattattttacaatttggaagtctgagtaatccaacttcaagatgactttttcattgttgaagtttgctttgtcgatgtgtgatttaggacttcctcttgtttcaagccattcctgcatatgacgcaccttggagatgggaccttgcaattgtccttgcactgtgccccggtcagtgttctggacccagcctaccaatcccagctttttaccctcagcctaaggggggtaaaaagagagagagatccagtgagattgaagaaaacaaggtaagactacaatctgttgccagaatcttggcctagaatcaagccactgaaactaatttgatattgcccagaacagtcaaaagaaagacagcaagaaggatctcattgcttatcttcacatgaagtattggccacttgactgcatgtctttcttctaccctataaaacccaggcactagaatttttcactgtgtagtcaatttggttaagtatcaaagacttaagtccaaaacagatgcttttgaaatgatcccctaaggctgattgtttttagaatactggactgtatcttgctcattttcccttcccctaatcaagaatctattgggtatgttaaatggaaaaaacatgaagttatctgatccttccctttgcctttaaccaggaccacacgtaaacaaatccagatgaattagtgttcattatatctttaaagatcattagaaagtatttcacaatttcctgggcaactcatcccgttgttcttactgtagtgaaactgtctaacccaacatctttatgttgtagccaaagcccactttattatcttcctagaaaaggaaagcagctggtgttcagcctctcaacagcaaaccatgagactacataactatcaggttttcacttcactttcttctcttctgtctaaataatcacaatgcctttaggcttataaaaagcatctaatcattacagtgtcttatcctttttaatgttctttccttttattaaactgtggcaagactgaatgtttaggaaaggtagcaatgttttggaggtaattttatttttgtataaatttatgattagaatattaagtcattgattgttaaagtaattatctaaatagaagatgttggattacaaaagaaaatgggagttaacatgattgcatgtcaaaatgtgggaaattgctggagttggccaaagaaaacgttatgcatagcaacaaaatgtttgatgaggaatttaagtatccatcaaatcaaagacatgttcaaagcaaagacatgtttgcttaatgaacaaaacagactccagccaaataaataaccatttgagggatacaaaggaaattaaggaatgaagaaaaatagaagatgcctacctgatgcgctgctaagtgccaaagaagataccataaaagaagaatgctgagaatgaattttgagtaagactccgcatccaactgacagggcagtataacaactgccctcttctgcttcaaattaacccaggggagctgactatctccagttcttaagagttatcttatatggtaaatagctgtaagaatgtgcagttttaaacaggaggttgtcacagtcaaataaatctttaaaaatttgcaatgtgatttatctgaactctttttttttttttttttttttttttgagacggagtctcgctctgtcgcccagactggagtgcagtggcgtgatctcagctcactgcaagctccgcctcccaggtttatgccattctcctgcctcagcctccccagtagctgggaccacaggcgcccgcaaccactcccggctaatttttttgtatttttagtagagatggggtttcactgtgttagccaggatggtctcgatctcctgacctcatgatccgcctgcctcggcctcccaaagtgctgggattacaggcatgagccactgcacctggccttatctgaactcttgagagttgaacagaacactccaaaatttgaccagtgttgagaatgggcgtttcctactggtttcatttgtgtgctcaactctgttcttatttttttaatgatgacataatgttattgactcatgttcagttttgaatatctattgcaccaacagggtttttctcccctaagaaaattccaaaaagtgaattctacctcataaccatatttttgcttaaacaatcatctgacaacatttcaaggactgtaatcaccacctctagttgcaatctaaaaagaaactctcttcaaatcaataatcaagatttccaccttaggatactagaaaaagaagagcaaactgaattcaaaatgagcagaaagaaggaaataaagattagagcagaaattaatggaaagcagaagaatagagaaaatcaataaaacaaaagttgcttctttgacaggatcaacaaaattgacaacctttagctagactgataaagaaaaacggatgaaagcctcaaattactaaaatcagaaataaaaggagacattaccaccaaccttacaaagataaaaaggataaaagggaattctatgaacaattatatgccaaaaaattagattaaatttttttggatgaaaacaaacctaatacctagaaagacaaacaaccaaaactgaatcaagaagaaatagaaagtctgaatagacctataccaagagatggaatttgtaatcaaaaacttcccacagataaaaagcccaggaccagatggcttcatgggtaaattctaccaaatgtttaaaaaaaaatcctttaccaacccttcacaaactcttccaaaaaatagaagaagatccaaaccaagaattaagggttaaaaaaaagaagaggaaacacttcccaacacattttattaagccagcattatcctcatactaaaactaaagctaaaaaataaaaatgaaaaataagtgtctcattcctgggactgtggtacttaaaattcaaattctaacctggaaggaatctttgaaacatgaatgtgaattgtcaatacctcttttcctttttcttttttttttctgaaggatggtggcacagtcacagcttattgcagccttaacctcccaggctcaaatgatcctccttcctcagcctcccaaaaacaaagctgtcacgagaaaaaacaaccaaaaaaccatagaccaatatctcttatgaacagagatgcaaaaatcatcagcaaaatactagcaaaccaaatcaggcaacacagaaaaagaattgtataccatgacaaactaggatttctttcaaggttggttcaatatacaagaagtaatcaatttaatacaccatattaataaaacaaaagctatatgatcatctcaatagatggcaaaaaagcatttgacaaaaaccaatacctcttttatgatcaaaacactcaacaaactaggaacagaaggaaacttcctcaacctgataaagggaatctgtgaaaaacccactgctaacatcatacttaatggtgaaagattaaaaacgttcccacgaagatcaggaacaagacaaggatgtctgctgttaccactctactcaatattatacttgagggtctatccacagcaggagaaagaaaaggcattcagattggaaaggaaaaagcagaactacctctatttgtagatgacatatcttgtatacaaaaagtcctaagaaacatacacaggcacacactagagctaattaacagtctcacaaggttgtaggatataagattgatatacaaaaatcaattgtatttctatacactagcaatgaaaaactgaaaatgaaattaggaaacaattccatttataatagcatcaaaaagatagagtgtctaggaataaatttaacaaaagaattgcacgacatatatggaaatctacaaaacattcttgaaagaaattaaagagtatctaaataaatggaaagacatcccttactgatgtattgaaatacttaacattgttaagatgatattactacccaattgatctacagattcaactcaatctctatcaaaatcccagtgcttttgcagaaatcgaaaaattgatactaaaatttacatggaaacataagggacccaggatagctagaaataatcttgaaaaggaaaaacaaagttgaaggattcacacttcccaatttcaaaacttactacaaagctgcagtaactgagacagtgtggtactggcataaggatagtggcttagaccatttcgtgttgctataaagaactacctgaggaccaggcgtggtagctcacacctgtaatcccagcactttgggaggccgaggtggggggatcatgaggtcaggagttcgagatcagcctggccaagacggtgaaacgccgtctattaaaaatacaaaaattagccgggcgcagtggtgggtgcctgtaatcccagctactcaggaggctgaggcaggagaattgcttgaacccaggaagtggaggttgcagtgagccgagatcgcactactgcactttagcctaggcaacagagcaagactctgtctcaaaaaaaaaaaaaaaaaaaaaaaagaactacctgctgaggctgggtaatttataaagaaaagaggtttatttgactcatgattctgtagattgtataagcatgagactgtcactggcatcaggtgagggccttaggctgtttccactgtgaggcaggggtgggaagaggtggggtaccaggctctttttaacaaccagttctcaccgggcacggtggctcacacctgtaatcccagcactttgggaggctgaggcgggcggatcacctgaggtcaggagtttgagaccagcctggccaacacggtgaaaccctgtgtctactaaaaatacaaaaattagctgggtgtggtggcgggtgcctgtaatcccagccacttgggagggcgaggcaggagaattgcttgaaccctggaggcagaggttgcagtgagccgagattgtgtcactgcactctagcctgggcgacaagaacaagactccgtttcaaaaaaaataaataaaaataacaaccagttctccagggaactaatagagtaagacttcattgaccctcccaccccccaggaagagcattaatctactcatgagggacctggccccattactcaaacatctcccattatgtcccactttcaacactggggatcaaatttcaacatgagatttgaaggggacaaacatctcaactacagcaggcagacatatagatgaatggaatagtattgagagtccagaaataaatccttacatttatgttgatttttgaaaagggtgctatgacgaatgtgggaaataatactcacttcaacaaatggtgctgggacaactggatattcatatgcaaaagaataaagctggatttcctacctcacatcacataaaaattaactcaaactggatcaaagacctcaatctaagagtgtaaactatgaaattttgaagaaaacataggcggctgggcgcggtggctcacgcctgtaatcccagcactttgggaggctgaggcgggtggatcacgaggtcaggagttcgagaccagtctgaccaacatggtgaaaccccgtcgctactaaaaatgcaaaaattagttgggcgtgatatagcacacctgtaatctcagctactcaggagaatcgcttgaaccctggaggcggaaggttgcagtgagccgagatcgagatcgcgccactgcacagagcgagactctgtcttaaaaaaaaaaaaaaaaaaaaaaggaaaagaaaacataggcatgacagcagctgggtgtggtggctcacacctgtaatcccagcactttgggaggctgaggtgggcagattgcttgaggtcaggatcagccaggcaacatggggaaacccagttgctacaaaaaacaaaaacaaaacaaacaaaaaacataggcatgaaccttcatgaccttggattaggaagatttcttagatataacactaaaagtgcaagcaaaaaaagaacagataaatttgatttgacttcatcaaaagtaaaaacttttgtacttcacagacactatcaagaaattaaaaagacaacccacagaatgggagaaatatttgtatatcatacatctgataagggactagtatccagaataaaaatattcttacaactcaagaataaggaggcaaataactaaaaatgggcaaaaatatttgaatggacatttcttcaaagcagacataaaatatgccaataagcacatgaaaagatgctcaacatcattagtcattaggaaggcaaatcaaaaccacactgaaagtatacacatacaacaggatattattccgtcttacaaagaaaggaaattgtttttactttcatgatataacacagatgaaccctgaggatattatgctaagtgaaataagccagccacaaaaggacaaatactgtaaaattccacttatatgaggtaactagagcagttgaattaatagaatgtagatttatgattgtcaggggcatgggggaaggagaaaatggggagttagtgtttaatgaatacagagtttcagttttgcaagatgaaaagcgttctgtagataaacagaacaatgtgaatgtgcttaagaccactgaattgtacatttaaaaatggttagaacaataatttctatgttatatgtattctaccacaattttagaagtaagtgtgctatatggtttccaaatattttgggattttccagttatcctttttatttttttaatgtggtttagttccactgtagttggagaacattccttgatttaaatccttttaaattcattaatacctgaaaaacaaacaaacaaccacaatgaaatattacctcatacccactaggatggctaacataaaagacagtaaccattgttggcaaggatgtggacaaactggaattctcacacattgccagtgagaacataatatggtatagctactttggaaaagtttggcagttcctcaaaaagctaaacataaagttaccatatgacccagcaatctactcctaggtatgtatatactcaatggaactgaaaacattgtctacataaaaatatgtgcatatgtgttcacagcactactattcataatggccaaaaatcagaaacccaaatttccatcaattgatgaatggataaatgaaatgtggtatatccatacaatggaatattattcagccataaaaaggaataggatactaatacatgctacagtgtagataaaccttgaaaacaatatgttaagtgaaaggagccagtcacaaaaaaaggccacatttgtatgattccatttatattaaatatcaagaataggctgaacacggtggctcatgcgtgtaatcccagcactttgggaggctgaggtaggtggatcacctgaggtgaggagttcaagacccagcctggccaacatggtgaaaccccatctctactaaaaatacaaaagttaactgggcatggtggtgcatgcctgtaatcccggctacctgggatgctgagggagaagaatcacttgaacccaggaggcagaggttgcagtgagccgagatcacgccactgcactccagcctgggtgacagaatgaggcagagttgagactctgtctcaacaacaacaacaacaacaacaacaatctagaataggcaaatccatagagacagaaagtaggttagtggttgccaggggctcaggggatgaggagtgagtgctaacctaggtaggggtttctttttgggatgatgaaaatgttctggaattagtgcaacattttgtgaatatactaaaaatcaccaaattatacactttaggaggatgggttttatgggatgtaaattatattccaagttttcaaaagtccctgaattattatttgtcacttctctagaaatgaaggaatttaaataagaggctagataatatcaacagcaaacattgcagcaaaacaactgttcaaatgaacatatatatttaaatgattataaatagtaaagaataagctacaagcctaattaagaaaaaatagatgtcattttatatgcagttttccaatcaatatttgttt

SEQ ID NO: 1290 - DNA, 31707 bp, Homo sapiens
tctcttcagacactggggcctggaaaatcagaaatagagccaaaggaaatgcagacttcaaattcaaaatgctatgaacttagcataggggagaagtattatagattttttttaaaagctcattttagaaaaacatagtgttcagacaatatgtgaaactctactgaagactgtttttagaaagcagtattaaatatatcaattggaaattcaaatgaacaattttaataaatccattagattcctcttttattggtttcctctgagcaatactaataaataacagaagccaattactaggtgcaaaagtaattgtggtatttgccattaaaagtaaagaaaggctgggcacagtggctcaaacctataatcccagcactttgggaggccgaggcaggcgaatcacctgaggttgggagttcgagaccagcttggccaacatagtgaaaacctgtctctactaaaaatacaaaaattagctgggtgtggtggtgcacgcctggaatcccagctactcaggaggctgaggcaggagaatcgcttgaacctgcgaggcagaggttgcaatgagctgagattgtgccactgcactccagcctgtataacagagagagactctgtctcaaaaaaaaaaaaaaaaaaagtaaagagaaagtacttttaatggcaaagactgcaattacttttgcaccagcttaatattactcagttgtgtctatgaaaaattttttaatctaaacaataatttggataaatttttgaataaggtatgtaacctaaataataacttcacatgttcctaagtatctgttaatttatttgaatgcctggcccacttaaaaatctgatccacaaaatgctatagtcatgggtccatagggatccgtggttccctgggttagaaagctgtggaaaagagagaagtaggcttatgactgccattaagcagtgagctacaagaatttatcatcactttattcataaattgataaagccttacattttagctcttgaagatacaaatgaaaggaaatacagtcaccaaggccagttgcaagtttagcccagcccataaatttatgacaaaaagcagctcatctgccattgcaatttaatgttacatcaagtaaataaaacacatattatcctcttcttttgcttctaaatacagctctttaggaatattttctaaagagaatgcttgagacactttccccaattaattaaatttcccctaattaattaaaaactgaatatacagttttactgttaacactcagggcagccattccattacagcatctcaaagattgccaggaagcagatacaaagaatcctaagtagcctgaaggacaacgttcccactgaaaaggtcaacttgacccttgagatattatttctacttttccaacaatatcaacttggaatgaggtttaagtgaaactagtattttagacacccaatacaaagctgctgtttcatcaccatgaagttgggttaaagagtttcttcgactcccttccccaaagctgtttgctttcacttgatgatgctttcacttgatttgaatgtatgccagaaatggaagtttctatttcataagtaagataagcatctgagattgtcaggcatgatgtagccacaagacactgatgtagttaaagcggagaaactagaaaagttgtattttttagctggttggactttgcaggaagattttctctaaaattattctgacaatgtttgagatacgccatcatgagcaagtcttgtcacctttctagagctgtagaccttcacttacagaattagagaattggactagaccatctccccccttttttgtggtattaaaataactcaactgtgaactgacatttccagattcccctgatgataatgaaacctgatgagaaagccgaagtaccaacaggagttataataggaagtataattgctggaatccttttgctgttagctctggttgcaattttatggaaggtaagaaaagctttatattttaaaatacagggctcctgaaggccagccttgaatttgcttacaaaacatcaacttcaggttttatatggtaccttctctatcacaaggagaaaagaaatgcaaatttgtttataatttcttactcatgtcattaaaaacaaccagtaaggatttttcttcttttaaaccttcctttcatccagagccctgaatgttttgttcagcttcaaataagtagacgctgaaaaatgtagctttatgcaatgcagctgagctctctggatataaatttccttctagcaggtggtagatatcaggtcatcagtctgcacacctcccttcagagcctcagggattcccagaggtgcatcagaggacgtgggcagccaagggggtcagaggcaccttacaaaataagccacgggtggtaacattcttatatcatcacctttacagctcggcttcttcaaaagaaaatatgaaaagatgaccaaaaatccagatgagattgatgagaccacagagctcagtagctgaaccagcagacctacctgcagtgggaaccggcagcatcccagccagggtttgctgtttgcgtgaatggatttctttttaaatcccatattttttttatcatgtcgtaggtaaactaacctggtattttaagagaaaactgcaggtcagtttggaatgaagaaattgtggggggtgggggaggtgcggggggcaggtagggaaataatagggaaaatacctattttatatgatgggggaaaaaaagtaatctttaaactggctggcccagagtttacattctaatttgcattgtgtcagaaacatgaaatgcttccaagcatgacaacttttaaagaaaaatatgatactctcagattttaagggggaaaactgttctctttaaaatatttgtctttaaacagcaactacagaagtggaagtgcttgatatgtaagtacttccacttgtgtatattttaatgaatattgatgttaacaagaggggaaaacaaaacacaggttttttcaatttatgctgctcatccaaagttgccacagatgatacttccaagtgataattttatttataaactaggtaaaatttgttgttggttccttttagaccacggctgccccttccacaccccatcttgctctaatgatcaaaacatgcttgaataactgagcttagagtatacctcctatatgtccatttaagttaggagagggggcgatatagagaataaggcacaaaattttgtttaaaactcagaatataacatgtaaaatcccatctgctagaagcccatcctgtgccagaggaaggaaaaggaggaaatttcctttctcttttaggaggcacaacagttctcttctaggatttgtttggctgactggcagtaacctagtgaatttctgaaagatgagtaatttctttggcaaccttcctcctcccttactgaaccactctcccacctcctggtggtaccattattatagaagccctctacagcctgactttctctccagcggtccaaagttatcccctcctttacccctcatccaaagttcccactccttcaggacagctgctgtgcattagatattaggggggaaagtcatctgtttaatttacacacttgcatgaattactgtatataaactccttaacttcagggagctattttcatttagtgctaaacaagtaagaaaaataagctcgagtgaatttctaaatgttggaatgttatgggatgtaaacaatgtaaagtaagacatctcaggatttcaccagaagttacagatgaggcactggaagccaccaaattagcaggtgcaccttctgtggctgtcttgtttctgaagtacttaaacttccacaagagtgaatttgacctaggcaagtttgttcaaaaggtagatcctgagatgatttggtcagattgggataaggcccagcaatctgcattttaacaagcaccccagtcactaggatgcagatggaccacactttgagaaacaccacccatttctactttttgcaccttattttctctgttcctgagcccccacattctctaggagaaacttagaggaaaagggcacagacactacatatctaaagctttggacaagtccttgacctctataaacttcagagtcctcattataaaatgggaagactgagctggagttcagcagtgatgcttttagttttaaaagtctatgatctggacttcctataatacaaatacacaatcctccaagaatttgacttggaaaaaaatgtcaaaggaaaacaggttatctgcccatgtgcatatggacaaccttgactaccctggcctggcccgtggtggcagtccagggctatctgtactgtttacagaattactttgtagttgacaacacaaaacaaacaaaaaaggcataaaatgccagcggtttatagaaaaaacagcatggtattctccagttaggtatgccagagtccaattcttttaacagctgtgagaatttgctgcttcattccaacaaaattttatttaaaaaaaaaaaaaaaagactggagaaactagtcattagcttgataaagaatatttaacagctagtggtgctggtgtgtacctgaagctccagctacttgagagactgagacaggaagatcgcttgagcccaggagttcaagtccagcctaagcaacatagcaagaccctgtctcaaaaaaatgactatttaaaaagacaatgtggccaggcacggtggctcacacctgtaatcccaacactttgggaggctgaggccggtggatcacgaggtcaggagtttgagactagcctggccaacatggtgaaaccccatctctaataatataaaaattagctgggcgtagtagcaggtgcctgtaatcccagttactcgggaagctgaggcaggagaatcacttgaacccgggaggcagaggtttcagtgagccgagatcgcgccactgcactccagcctgggtgacagggcaagactctgtctcaaacaaacaaacaaaaaaaaagttagtactgtatatgtaaatactagcttttcaatgtgctatacaaacaattatagcacatccttccttttactctgtctcacctcctttaggtgagtacttccttaaataagtgctaaacatacatatacggaacttgaaagctttggttagccttgccttaggtaatcagcctagtttacactgtttccagggagtagttgaattactataaaccattagccacttgtctctgcaccatttatcacaccaggacagggtctctcaacctgggcgctactgtcatttggggccaggtgattcttccttgcaggggctgtcctgtaccttgtaggacagcagccctgtcctagaaggtatgtttagcagcattcctggcctctagctacccgatgccagagcatgctccccccgcagtcatgacaatcaaaaaatgtctccagacattgtcaaatgcctcctggggggcagtatttctcaagcacttttaagcaaaggtaagtattcatacaagaaatttagggggaaaaaacattgtttaaataaaagctatgtgttcctattcaacaatatttttgctttaaaagtaagtagagggcataaaagatgtcatattcaaatttccatttcataaatggtgtacagacaaggtctatagaatgtggtaaaaacttgactgcaacacaaggcttataaaatagtaagatagtaaaatagcttatgaagaaactacagagatttaaaattgtgcatgactcatttcagcagcaaaataagaactcctaactgaacagaaatttttctacctagcaatgttattcttgtaaaatagttacctattaaaactgtgaagagtaaaactaaagccaatttattatagtcacacaagtgattatactaaaaattattataaaggttataattttataatgtatttacctgtcctgatatatagctataacccaatatatgaaaatctcaaaaattaagacatcatcatacagaaggcaggattccttaaactgagatccctgatccatctttaatatttcaatttgcacacataaaacaatgcccttttgtgtacattcaggcatacccattttaatcaatttgaaaggttaatttaaacctctagaggtgaatgagaaacatgggggaaaagtatgaaataggtgaaaatcttaactatttctttgaactctaaagactgaaactgtagccattatgtaaataaagtttcatatgtacctgtttattttggcagattaagtcaaaatatgaatgtatatattgcataactatgttagaattgtatatattttaaagaaattgtcttggatattttcctttatacataatagataagtcttttttcaaatgtggtgtttgatgtttttgattaaatgtgttttgcctctttccacaaaaactgtaaaaataaatgcatgtttgtacaaaaagttgcagaattcatttgatttatgagaaacaaaaattaaattgtagtcaacagttagtagtttttctcatatccaagtataacaaacagaaaagtttcattattgtaacccacttttttcataccacattattgaatattgttacaattgttttgaaaataaagccattttctttgggcttttataagttatatattttactatttttatcttatacattcactttgctcacatccaagactcaatttaagaagactgaggctataattaatttgccataagtgtccagtctatgtttctagcagtgaccacaaggatcttcttttgtaagactcttaaactgccttcgaagttttgagacagtgtaaagcattgctcctcaaagtgtggcccagggacagatggtgctgcatcacctggagcctgttaaaaaacacagatctcaggggccactcaaaactattcaagtcaaattgtaagttctacagcatccccaggtgattcatattgcattgaagttgagaagcactgctctaaagcttaccttttgaaataaaatgtgtgcttggaatagagagggaaaaaaaatcagccaaactgctgcaacatgcaaaagcagagtcatctgcacagtttaaaaaaaatcataataagcaggaaggtttaaatatttttaaagagtaaatatgctgaaataaatatgctgtaagttataaagtaagtacacgttgggctcacagactgccatcgctgtacagatggcagagtaatgcaaagacagggtggaaagtgtgtgtgtgctgccataaatagcgatgcaccagcatctccattcatgtctgcggcgctctctcacatgcctccctgcccatcgcagttgtgctgagccgtctcaggagggcagctcactgcagcacaaccatcaataagtgtgtctgctatatatctcacattaaaatacaatcttggagagctgaatgtgggaattgcagctacttgggaggctgaggcagggaggatcctttgaacccaggagttcaaggccggcaacatgagaccccccccctcccagctcttaaaaaataaaatgttagagaaagagagcactaagttttatttctttgtttttcacagagcaggttaggaaatgctgtacaggttaggaagacctgtattaaagcaatcatttatatcccatagttaactggaaaataattttatacttactttttaaaaagtacttctttttatttattctacatcacttgttaaaaactacaaattgcattttcaaaaactccttcctgatcctatcataatcttttaatatttttaaggtgtcaattaaagattggacatcatcttacataaaatcagggcctaattttcatttcggaaccactacagcctgactttaaagaaaatggctactaaactgaacttttggttctatgcaaaattaaatctaagtaagactcaagttgctaagagcaactttactataacttttactatggctctggctctactgccctctgctggatgatccaccgaactacatcacacaaatcattcttgagagatcttcactgtaccaggtgctcagtaactgtgtaagatgtctaaatcacttatttctcaaaaaaggctgaaaatatattgtgactctatacatcatatccaaaggacaaaaatgtccacaaaataagtcactcattgaatatctgctgttactttcattcaaagatgataaaaatcaatttcattttaccacctgttcaaaaatacttgaaacataaataatttgaatttcctatttcttaagtgaacttacctagcaatcatgcaaagtcacggctttaaagtgaccaagaaacactgcaggcaatctgattaaaggctaattattttttttagattactcttctagttacttgaagctaagttacagagatgatagaaaagctacatatcagagtgacagtagccccttaatatctgaaccaccaattaactctgccactcctaagtaagcaagggtcagtaaagatcctatctaagtcaagtgcaatgcactaaaatctttcaaggccattccatcccagttctggcatgccccaggttaactccttaacctctctgttggagactttaaaagcataacagtctcagttccaaacttagaataaagcctacttaatgaaggcatgattcttttaaaacataaagaatgttctatgttctttaaaaacatcattaccctcaataaggaacttctaaagaaatatctaagtaggaaagtcttgaaatccacatatacctatcaacattgcatatgacataacatccatttaacaacctatgtccaaaatcctagaaatgtccagtgacccagtaaccccatgataatgtgcttttagatataatgcaacagccaacacccaccccttctctccaatggggacaggcggaagctcgatggcaagccagagtgacactgaactgtgaaggtaaggctgagaccaaacaggcaacccgaacccggcagaggaagtaggcggagggtttgtctgcccttccagtatccttctggcccaatctctccagacggactaatgaacaagcatcaactgatgtaaccaggtgattcctaaagtcagtgtggctgtcctatgggtcccagccacagataagatgcagagtgttcctcaaggtattttaggttggcagaaaaagatcactgggtgggtgcctggcacaaaacaggcattcaataaatatttgttgaataaatgggttccttaggtaaaagatgttttcactacatataacaaataggattactacgtttcttatttgtcccagacataagaaaaaaatccttcaatctaagtgtctgaaagtatagcttttgttcttaatatgcataatgcaaattttgtgatgatgccgactgcccaaattttgcctgtattttattattttatgagctatgtgtttacctgaaatttgctgagagtagaccttaaatattctcaccacacagaagaggggactatgtgagctgaggaatatgttaattagttggattatggtaatcacctcacaatgtatatgtgtatcaaaaatcacattgtatactttaaatacatacaatttttgtcaagtatacctaaataaagctggaaaaaaaaatttaagaactatatgggacttatatgtacaagtctatcaaaatactataaagcttaaccagttaaaaattggggcattgtttacctaaacatttcaacacaaaccaccttgttgctagttagctttatgacaattttgtgctgatttgtatattgatacaaaattaacaactaataaaaaacaacaaaaagttttctggtaagattatagattctgaaatcccagaaatctccataatgagaactattttaggcaatttaaaaaaaaagaaaatactctttttaaacttttgaaatcatgggttttagtttattatttttaatatatttctgaaaatgtataatatcaagactgtctgataatgcttttttaatactttccagttctgccaacattcctgtcatgcatccttaataacaatgctctcccagaaccgggatggggggcggtgaggtggggttggtgggggagtacgtttctgagctagttaaagtcactgaggagggcccatacctcaatgtgtgttgagttacaattagaaattagtcatggaaggacatgtctaccacagatatctttcctcacatttaaattattccatttcttcctacagtcctccttctatctttagttccattttaaataacccttcatcctacatacccatttatcttgcttcctttttctcccttttgtcccactagtataagagattgtgcttcagtaaactatcctgatgtggagagaaaaaaatcaaaatgtgatcaataataatagtttaacaaagttaagattgcatgctctaaaaacataagtgattaactgttggatgcccaaaagcactctttgtttcctttccaagttgatgactcttcgtatatttcctaaaaaacaaaatcataacaggtattaaaaatagaccattctactatacgaatataaaatatatttgaataaatcagacaaatgaatatcacatctatttcaatggctcctcttttaacaatcatgacgagagacatcatgggcaaggttacataggggaagacagaaagtctttagttttaaacatttttttttctttccaaacatacctactacttcaacatttctaaatatgcttttccaaaggcagatatcttcattagctgttgaattaagtggtcacctctcagaagttcctaaacaagtttgagctgccctctggtatgagctgttctttgacatatgcactctacctacctgccacccttccctatatcacagatgatctcaaagcacaggccgagactagaaccagactagaagttacatagtttgtggaaaggaggggtaaggagaacatatcactttctcttctcactctctagtcacattccatttctgtagggagaggaattcaaattcaactgtcctctgaactcctgcacttcctcggactctctatggacaaacaaaagcaaaatacgaagcccaactagtcctcaaagcatgaaaacaagaatatgccccaactcctgctcattacctgtatttctggggttgctcccatctactttctgtccactgactgtgcaccctttcctccctggtgaagaaagctacccctgccttccaggcttgcagctgatcttagaatgctcttcctacctctcgctctctgggggcctgcctcctgttgtgtcagccttgttcacagcaagggaacaatatatctgagcttcactaagtttcctttcacacatattctatcctctaatccctacgtattctaacaatgggcttcaattttattctgaaaacatggtcatcaaatttcccaggccctggttatgagtccaacttgcttatttctaccactgactgaggcaggtcccctgggaaggaggggagaagtgccctttaaaagccctggctctctgctctggtcttttcatctactgagctgttcattaactcctcagctttctgtcaaccacaacgctgtaggcaattctagacaattctagacattgaatgtgcaaccacagaacaatcccactgttaatgttactacaccaggggagaaactagggagttgggccttttcatcccatcagaatgctctatttaaccagagaattacttgcccttattgacagaaaacatgccagaagttcctatttctgtttttaaatccactcactgcattttctcagagggagcaatatctcaccatttttttttcttccctaaaaaggacctctaggaaaagcctctttcactttaaagaatttctattttagccattacctaaatagctaatgcattattctcactctccaacagaaagaccctctaattcaagggaattataatccaaggaaaataacttcatgtatgaacccctccaacagtccagactaggaattctcactgttatcactcattgaggcttactgtgtgccatgcattctttggggcacatatttttcatgcttaacaaatcttggaaagaagatatttcacagataaagaaaacaagatactacagtcagtaaaaagtccataaatatggggggatttatctaaaaattcctgagaaaaatcaggtccacatgctaaaatgtgttattttcttaacttacctttttccatatgggcaccttggcttttaaagtatcaatggcatagctcacagcttcaagagatgcagctctgtgggctgaggacacagcaatgattatgcttgcttctgacactggaaccaagctttaacaagatgaagagaaaaaaaaatcaccatcatctctgaatctacgtgttaaagaatctgctagacagatgaaaaaaaatccaggtatgcagtcttagaattatactgtagttctattttacgtaaacatacagttagaaaagagtaattaattgcagtagcattcagcagaggcagtagatgaggctgatgctacagctaatttgttagaatctatccactaaaccctcctgatgggcaccaaggaaaatcctttcattgatagagcaaacatctgactcaacaaggcacagtgccaagtaatgcctagaaatacaaagttatgtcctaacgagtataatacaaaatttaaaataatacatatcaagtaataggagtgataataaccattaataaaactactggttattaataacaaactagtaactaacagagtatgatagatacagtctcaattactggcttctttttaaagccaagaactcttctctttttaggggtacaaaaaggcaaaccactctaatgactttcgaggcatttatatcaaaaagaatctgtcacagattgtcatagggcctgcaagtcttggcacaactgcagtttgttacagcaacagaggcaacaagagctctcccaatatcaaaactcactaggcagtccctaaaggtactaacagccatccctattgtcctccaaaaataatacatgaatattcctctcatggtaatatagaattactaagaaagattcaagaatcagagttagtacaaagatggaaaacaattacacttaacttttagagtgataaaggaaatcatacccaagtctatggaacactgctatgtgtttgactggccatttctgcctaatgtcactacaaatctttctgacttcattttccgccatgggtagatatgcttcatattctaagctaatgacttttttcccttcaaagttatttcttgtagtccctttaaaaatgaaaaaaaagaaaaagaaaacaattaaaataaggtttttccctacaaaagaaatagcacgttaataaaaaaggaatatttttaatagtaaattaatagtaaacaagcagcataccaattcttctaaaactactttgaaatcttctaaaaacaaaatttgattaggaaaataaaacagatcttcacaaagatgagcactgattaagcaagcttactaaaaacactcacctggcaaaccgggcaatattcctcttctgactaatagatacttaaaaggaaaatatttatgttcccaggactatcaagtacatttttaccttcaattttggaaaatctagaattctctctcctaacaatgacttttatcctacttttcaaaatgccttgtaatttaatataggttaatttgaaggttactaaaacaaaacaagaactaaaaaaaagtctacccaccatcatcggtaatcttggtttaaagttcagtatttcaaactcctccgttaacactgaacatggaaagcacatgctaatttctattgtcttatacagtgatagatgcaatgaaaattacaactcacctacaaatagggatattgcaccacagagcggagaaatcaccaactgtgagacttcatctactgaaagtttctcggcagtaaagtttataacatctttagatttctcttcaacttcatccatatctttcctagaaataatacattaacaaaccttaacagaagtcctaggggtaaaacactcaacaacttataggctctttcaatttatatttttttctacattatgtcgatgtaaaaggaagaggctgtggcacaaaatatagtttacatgagtcaaatcaaggacagtggcccaggatgcttctaagataccttggggagttcctttggggagcactccctcggcctttgttgcaagcaggtttgtaaaggcaaagggaacaaaaagtgggctgatacaatgatacaaagtttcaccaagaattctcactggcatacagagataatgttgatcactgattggctgtacactgttgaactatagggtgggtacaagttagagtgtccagcatatggactttatggtttcttagcttcagctagtctgcagccctcataataagtggcttcaagggaccagtggctcacacctgtaatcccaccactttgggaggccgaggcgggtggatcatttggggtcaggagtttgagaccagcctggccaacatggtgaaaccccgtctctactaaaaatacaaaaattagccaggcggtagtggcacacatctataatcccaactacttgggaggctgaggcaggagaattgcttgagcttgggaggtggaggttgcagtgagctgaaactgatcatgccactgcactccagtctgggcgacaaagtgataccccatctcaaaaaaaaaaaaagaaaaaaaaggtaatgatgcagcttaatggggagtgacatgactgccatttcattccagtgcctttctgtgcctcttaatgttttatctgacgggctcacattcctcagataaaaagtttcttttctttttttccccaccattaaatgtgttaggaggcatgatttgatctgaatgataaaaataagcaagtgtaaaaattaacaaaactcaattatgtgtataaatattcataatgaatcaggcatgacataaaaagtaatccattattaacatgatcactaaaatataatctgtctcaatgccaatatattccaaattctgtaactgctattcatatctcccatcaagatacagtggaggtattgccactttcacctacatgcccatcccctctcaccactatggtaccaagcaccacacctaaagctgtctttttctttatccaacaaaaaaggaagaacagaagtgacagtgattctactggaactgggttcccttcacaaactggcaaaaccccaggtaagtaactgaggaaataagggaatgaactgcacacttacttactaggtattgtgcaaagccctttgccatgcatttctcatttaattcctcaaacattactacatactcactaagggccagagactagggccaggcactagatatcaatcaggggagaaagaagctcaagctcctttcctcagcgtgcttacattcaaataggagaaacaaagcattacaggagaaactcagaattacaaatagggataacttatggaagtaaataggcttcagagacagaacctggggtctgggggagatttctctcaagagcctctatgaaaagttgcgacctgaaagataaggaggaagtcttgtaaagaaaccagggcacaggcccccaggcagagagagggagtggccaatgccaaggcactgggacaagaaagggtgtgatgtgctccagaacctagaacgaacggagagaactgggcaggctgaggctggacaggtaggtagaatcttgcaggcaatgaggaatataattattaatcctgtaaggtttcatctgaattgaaagacgagagaaagaaggctcagagaagttaaggaactcactcaaggtgctgaaattccaaccaaggagtactagttaagccaatgttctttttcctatctcctttccaccacggaaacagcacaattctttatataccactggattccaggatttttcatctgctacacaagccgcctaagtgtcttccacctctttttcttgcaataaaatataggtaatataaatatggtctacgagtttcaaaccatactgagttcccacaacttctgattttacgagactactaaaacctagctggcaggttttaaaaatgcataataccagtcctgcgaaacacattcaagtaacacacaatgcttttgagtaatcttcgtaaccttttcaaagaacagctgtaattaccacaaatatccctttaatggtagcctatagttttctgaataaattcgaaattccaaaaaactgcatttttagaacctcctgaaatcatggtggtgatatggtgaccacagtttctaaatagcattgagatacatatctgacaagagattcttctattatttccagatagtaggcctgagaaagaagcctagtgttgacatgagaggcaatctgttttacagattgattcttcatttcttgtggcactgccctccaggagggtggggaaaaaatgggtgaaaaaagataaaaaggcatccttggcttgctcctttctttaatggaaccaagtttttgccattaaatatgatatttactcctgattttgaataaaaatcctatcaaattaagaaagtcttctttcattcctaacttaccaagagtttttattcagggatgactgttaatttctactgtttgttcctcagctgacaataaattaagcctcattctgtctgtacttataagaagcctgatctctccacactatactgaacaatgttcttgtacattatcctacttgaatatggactaagttgtttagaaagatgacaaggtagcatgggtcaaagagccacctgcaacacagccataacaataaagctattcctttagtcctgggcaatgattagctctcttttcaggcattattagctgtgaaatttttctacattttccatggccgggagagctattatctagtattagtaagtgtggttggaaaaaagtacacagacagtccaataatatgagttcaaatgctgtcttttgaaaacctcttgaatcctcagcaaaaagaacaaagctggaggcattacactacccaacttcaaactataccacagggctacagtaaccaaaacagcatgggactggtacaaaacaggacacatagacaaatgaaacagaacccagaacccagaaataaagcttcacacctacaactatctgatcttcaacaaacctacaaaaacaagcaatggggaaaggataccctattcaatacatggtgctgggataactggctagccatgtgcagaagactgaaactgggccctttccttataccatatacaaatattaactcaaaatggattaaagacttaaatgtaaaaccaaaaactagaaaaaccctggaagacaatctaggcaacaccattctggacataagaacaagcaaagatttaatgacaaagaagactcaaaaagcaattgcagcaaaagcaaaaattgacaaatgggatctaattaaactaaagagtttttgcatagcaaaggaaactatcaacagagtgaatagacaacctaccgaatgggagaaaaattttgcaaactatgcatctgacaaatgtctaacatcagcatctctaaggaattttttaaaatttatgagaaaaaacaaccccaataaaagtaggcaaaggacatgaacaggaacttttcaaaagaagacatacatgtggccaacaatcatatgaaaagaaagctcaacatcactgattattagagaaatgcaaatcccaaccacaatgagataccatctcacaccagtcagaagagctattattaaaataacagatgctggcgaggacgtgaagaaaaaggaatgcttatacactgctgcagggagtgtaaattagttcaatcattgtggaagacagggtggcctagagactgaaataccactcaacccagcaatcccattactgaatatatacccagagaaatataatcgttctgtcataaagacacatgcacacgtctgttcactgcagcactattcacaatagcaaagacatggaatcaacctaaatgcccatcagtggtagactggataaagaaaatgtggtacatatacaccatggaatactatgcagccataagaaagaacgagatcaagtcctttgcagggacatggatggagctagaggccattatccttagccaactaatgcgggaacagaaaaccaaataccaaacgttctcacttacaagtgggagataaatattgagtacacatggacacaaagaaggaaaccatagacactggagcctacttgagggtggagggtgggaggagggagaagattgaaaaaataactgatgggcactagacttaatacctgggtgacaaaattatctgtacaagaaaccgccatgatacaagttcccctgaacttaaaagttaaataaattctttttaatttggctctttcacttattagctatgtgattagctatgtgatcaaaggcaagttttttaagtcttctgaatttgtttttttacctgcaaaatatggatattaatatgtcactgtgcctgacacataagatctcaataaaccatgttaaatgaaacatatcaaactgatatgtttattgtaattaaactgcttacaatagacttgatgcagaaatggtgctagatattcataaatctgttggcaccaatgaagagttgctgcatcaataaagatttggtacagacagacttacaaagaatatacattaacagcaaaccacatacactttatcatctgtatgatccttccccacacgactgattaagaaaaacaaatctcacatacctagatggctcaaaagcactatcctccactaatgggggggataacggcaatttcgtctccaggctgaagcacgaggagctgatctccaagctcgacatattcttgacgaacagcaaatattatctgatttctaacatcagccaatctaaaggggaaaaaatatgactcaaagtatcaacgctatgatagacctcaaatcgcttcagctgcaattagagatattacatagatataattatataaagcatcacctgcaaaattaccaattaaatttacacatagtatatggagaaaggacatatccactgaagaacatacttatacaccacaaagatacgttaaactgctgtcaactctttattggatgttgtatgccttggggaattaaacaacaaaaaaatgcacaaaaaacccaccagactggaggcaacactcaaaccaggtcaaaagaaaagtttccaatcagtacatggcctttccagggtccttctatccatgtgttcaagcacaagtataactgcccacaaactatgcctgtacacattatcctactcgaatatggattaagttgcttagaaagatgaaaaagatagcataggtcataaagccacctgcaacacagctttattagctgttcctttatacctgaacaatggtaagctttcttttcaggcacagtgaaaacgtatacaagacctgctgtctccctccaggtaaagcagaatgggagaccccactgtgttttattgattatcaggccactgtaagagcaacttaaaagatacgaaatcatgaagtggtttgcttttaaacacttattatggagtatcttttacacagaactaggacttccaggttaaacacctatacaagctaagtaacaccattaatattcctgaatcaccctcaaataagtcacttttatattttgttccaaaaagaacttgaagtgggaatgacataagtaaaattataggtttttcaagaaccagaaaaaaaattaaatattacaaaaactcaaattcagcagcatctaggatttgttgtaactcatttttctttcaatcttagaaatttctatgttgagctctctaaagagaggggcagaacaaaatgtttaaagcacacatttttaacagaatttgtaacaatttcatttaatgttataaaattgcagaagtgacatgtgcagtgttttgtaaattatcaaagagaatataatcatgtccctctgcggttcactgtgttttggggtaaaatatctttaacctttcttaaaatacggtgcacatttagagtttttcaggtgttccaaaaaaaatacaactaacgattctttttgacattaagcacggaaatcgaaattaacctttttacttttatcatttatgtattttgaaaatatctaagtgttactcatatgcattctacaaatttttaactacccaggatgtcgagtttctatctccttccacagctgcaacgcttttatttcttgaggcacagaaatggtctctgaacgaactcctgttatttcagcactttttgcaaaatacaatacttcaacctgaaagtaaagaaaatgcttttaataacaactcatactcgttttctgactgtcaatgttgagcagttttctcattttccaaatgtattgctttaatcaaagacaaattttataaagaaaattaaataacccgtaaaaaatttcagtatacctacaagttcaaattctgaaaacttgttgttttaaatacaattcagactaatttctggatgccttttagttttacaaacttaagtgtgccatcattaaaatcctaagtatttatcttctaggaaaacatgttaagcctgccttaattgacataaaagtatagcaccttttataaatatgtaagcaaagaacaaatgtttgagtcaagagatgagttacacaaataaaataaatgaataaataagcgaaaaacctgtttctcacggttgtcaaatgaccttagattccggtctgtataacatcgtccccagacgctaaggattaagttatgcaacatagtaaatctgacatttacagaagcaagtaggtttgaaacacacgacagactggaatttgctagaacaaacttgtgccagcagcctggtatgtaagggatccgacgaagtaaaataggcacctgtcactccgtgcaaacaactctttacgaaataattacaggtttgcaaatgatcaagggtgtagaaatccacagatgaagcacagttcttcacaagaattctccatgaggtgcatttctttttagattaaaattttagcttcatcaaaacgaataatctgggaaagaggtggtcataaaaggtggaggcgccttcagaacgagtccgtccttgctgccgtgagctgacaagagttctcggagaggacccgacttctgctggggcagtcgcagtaaagcccggagacaggaagggcccgggggcgggggcgggggcgcccccgaacccaagacgccggccaggttgggggctagtggggaggtccgactgaccaaggctgggtatgtggagggaaagggcgggagagacacgtcgaggagggctccgcacccaggcccgcacgcacacccgccacccttacctggcacagcggcaccatcccgcctaggacagcgggaccgaatcacggccgcaaaggcgcaggcgcgggctcacccggagcgcaggcgtaacccgacggcgctcagcccccgcctgcgcctgcacggagcatgcgcacaaccagctccgccccgcgccgggctctagctgtttccctcaggcggcctgttccacgccaggattagttttgcttcgcagatgggccgtggtggtgagaggaagcaatcagtatggaaatggagaaatggcttaccatgcatgtccttctccccaggagggaggtcgtggtgcaggcgagcagacgccagactcctggacacttgccgcctgcgttatggaggcttagctaataaccttgcaggggtcttcaggcttttccactggctcacctttaggcttctgacacttttacctacggtatgtgaacctcgaaaatttgagacaggtctcagttaacttagaaagtttattttgccaacgttgaggacatgcccgtgacacagcctcaggaagtcctgaggacatgtgcccaaggtggtcagggcacagcttggttttatacattttggggagacaggagacatcaatcaatatgtaaaaagtacattagttccttccagaaaggcggagaccgttaaaagcaagccccgccccccccaactgggggcttccaggtaggtaatagacagtagcattcttttgagtttctgataagtctttctaaaggaggcaatcagaatatgcatctattctttgtcagcaaaagaggtgacttggatagaataggaggcagatttgccctgagtaattcccagtttgaaggggcccaagatttttttctttcccaggtatatgattagtgtttcttaaagacagaatatccgcctggtcagaacattcgaactgtatgacttttcctgtttattggctgctcggtaattgtatactgtccgtccaactttcccaattcttgccaacaagaactcttggctttaaattgcttgcgtcgttaagtggatgtaagttacacgtccctttccttggagctcacagtcctgggtaggagagttttaaatatgaatgataattccctgtaatactaaggatctgtgttacatttcaagggtggaaggggaaagtggttgtgtcacctggggagtgagaagatgctgagaaggtaaatctgctagaatggtggcagtaaatgacaagagtgggagtagagcacgaagaaatttcacttgcctctgacaagccacagggatatgaagaagcataataagttcacagaagggcaagtagttggcaaggcaggtgtgcctccagcaaaggaggtgatgagaagtgaggctggagagtccttggtaggaaaaattgacaaggagcaatgaataccaatgtgtatcctggtaaagttgctaaacataaaggataaagactatattcacacccaggcataaaaacaagggaatgacaatagtggccttagactcctcagtggcatctgatggcaatgtgcagtgtgtaaaaaaggctgagaacaaaagcatgatcccataatattacagccaaactggtggggcaggattctcctaaatcagcaaaaactcaaaaaacacaatacccaagaacccttcttaaaaatctttcttgggcaaaaagtccactcaatcaagagtaatcaaagtaaataactcagcaataaaggtattaatatgggaaaaatgaaaaactaaaaaaactggcattgagattttaacccattcaaacgtaaaactaagatatcaattatgggatatgattataaaataaaatgtaaatgacatcagaatattaaaaaaaaatggaaactgtccaaagtgggaacatatagttacaaaatatcaattcaggtttcttaatatttttcataatcttctttattttagaaaatattttaggagcaactatcttttacaaataaacaataatctgatgatttataatcctatcagtttcaccagttattttgttgataaattcaagtaaatataggtcaataatattgccttgctttcatttttttattttctaattcctaatgaggtgaatcttttcatattttcattgagcacttatacttctctgtgaagtttctgttcacatcgtttattcattatgctgtagatatgacacagttctttttttttttacaaaatacagccccatctataatttgtggatatgcaagcaaaactgataccaaaatattccaggcttattccataggctttgattttacttttcttatgaattcattaattaaatcagtgaatcatcacaatggtatataaattattttagtaatagcaaaatgactttatgaacatttgcatttcacttaagctacaattttttgtgaaaacatagttggagccaccattttcccagttatttttaccataaggaatcctatttggttaagaaaaaaaacaagttgaggcaaaaacatttccattttgttttcagattgaaaaaagacgagattccatgagactagaaatgtaggagcatctcagaccttcacagaacgctctgttagaagatgagaaacataacgttgcttgtgagaggtgaagccagctggacttcctgggtcgagtggggacttggagaacttttctgtctagctaaaggattataagtgcaccaatcagcactctgtaaaaacacaccagtcagcgctctgtgtctagctaaaggattgtaaatgcaccaatcagcactctgtaaaatggaccaatcagtaccctgtaaaatggaccaatcagcaggacgtgggcagggacaaataagggaataacagctggcgcccctagccagcagtggcaacccactcggatcaccttccatgctgtggaagctttgttatttcacttttcacaataaatcttagggttgcttactttttgggtccatgccaccttgaagagctgtaacactcaccacgaaggtctgaggcttcattcttgaagtcagactaagaacccaccggaaggaaccaattccagacacacgtgtagtagcaaattatcaaaaatgttcattgccttttctgaaaaacaattttcccagaaacacctggcagaatcagagttcattgtgtcaaaagaaaaactttggacaaattaaaatgagcaaagaacaatttgtgaaatgtgcccctctcccaaccagaacaggttcaaagagactccagtgctgccacatgatcaaagaattatggacaaaaaaagcaaataaattacaggaaaagaaaatgaggtacagaaacagctggattggttacagcttggtgtttaccttacttgaacaaggttcgaacagttggctgcctttgatgggctgcaacacagtgattggtataagagtaggttacagcctgtttacacatgcagttaggttacaattcactgtgtgttgagaaacctttaggccaaacttaaaatttgtaaggaggcagctttaggcttaacttgatttaaaagttattagatgttccatcagtcgtttcgccaataggtaataggtttttttggttttgttttctgtgctattaaaatagtatataaaacttgtcatcattgattctgatttatcatgttacagttcagtctctaattgaactgagcctatttttttccgtaaaatccaacctattcatccatttatacagattttttaaaatctaaatattttatatcaaattgctaaaaatgtttagtcacattctttttctattgctgcccatatattttctgccatcattttcagctgctaaatagtatctagtcctagatatctggttacccattatcaggaactcttcgtgaaatgctttagtgaccttgtttaagtcagtaataaagttgagatttataatcatattctattaccaaaaaaaatacaggtaatagattttcaaatgtcagcccatgtctactcctttatttcccagtgtggcagaatttttgaacagtgaaaatatttctgtctgaggaagtttggactatgtggtgtgagatccgtagacattggactaatgtcattaacatattttaatatttaaatttcttattaaaaaatagataatgcagtagttactttttgaaggacgaccgaagcaggatatttccctgaccccttcatgggacccacgtcagaggtgtttactcagcctgctgcccacaactcctcacaggagggagcgcacaagtgaacgagggtgaggactggagagcaccagcactggaacaacccggccacttcggcgctactgggatcaaactccatcacttggacacactgtgttccacccctcgtgggagggagcatgcaggtgagaggatgcaggagtcagggtgagcacttttgggctccagcaggagcaaactctgtgcagggccctgcagcagtgactgaggggcggcctgtgactcccaaagccccagaggacatgctacagtgctcttttagctctaccatccgtaggtggcttaagtgtaaacagctcagtgggccctttgcctttttgcgtgaggcagctgccctaggcaagagtaaagggccagtgtcacagccttctgtatctgcactcatgactcctgagctcttgtcctgcattcagggaaaatgaggttacacaaaagaattcacagatggtaaatgcggggtattttattcccagtgaaagtggctctcagcaggaaggagagcagaaaaggggatgggctgggtaggtaaccttcccctgaagtcctgccatctctggctggatttttctccaaagttacaccatcaaaatgtccctctgaaatcaagccacttctctctgacatccagccgtagtccctcacgtccagttgcttctcctctctgctggctgagtctgtggtctttatagcacaggatggcgggcagggtgggccatgggtaatttaggaaaaagcaacatttgagcagacaaaagggagagaagttctctactttgggctgcggtttcaggctttttggcttgagggtggggttttgtcagggaccctcccttttctgcctaaaatttctctgcctcctgcctctatcactgtatcactagtttgaagtaaacccatctggaattactgattttaacaaatcacacagaatttcaagcacctttctatgcaaatgacttgtgaagacatagagtatagtatgccgttaacaaacagcccagcagtgtgccttgcaccttgtaggtgtacaaaatattaagtcaattttataattgaaggaggtaattttaaaatgctacatccatgttgtgtaattttattcattggtcattttaaataaaaacaaaagccagaataaaccatatatattgtacttgttagtttattcaaggaaatttaggtcaaaagaagcacacctccttgtggttagttattccaactgcaaatcattcaccttaaaatgaaagaacatggctataggagctttttgcaaatatgttcttcactgatgattttctaaaatgtatatatcaaatcccccagtttcagatgccagaggaaagccagatcttgtaatttcatttctgcaaaaatctaagatatgcacaacaaatggattttagaaacagaaaaatataccacacagatgttgaacaatgaaaaccaaagctcttttttttttttttttttgagatggagtctcactctgtcacccaggctggagtgcagtggtgtgatctcagctcactgacacggctgcctcccgggcacaagtgattctcctacctcagcctcccgagtagctgcgattacaggcatgtgccaccacgcccggctaatgtttttgtatttttagtagagacggggtttcaccatgttagccaggctggtctcgaactcctgacctcaggtgatccgcccacctcagcctcccaaagtgctgggattacaggcattagccaccgcttttaaggagcatattgtgggctctagaaagctcctaaaactgccttttcagatgtgttaagaaggagagctgtggaaaaaagtctgcaatatctcaccaaagggaagttggtgaagcagaagtcttcattaaaatagaaataagaactgaggcagtgaaggtaagaaagggcctgagcccagagtccttggtggatggcccaggtaaggttcttctagtcttaacagtgctcggtaaggaagccacatctaccttttattagcctttcagctctggccgtagaaatgattgatgcctgagtatagggcaagagtataaactgagctacatctccttaaaagtagcagaattcagaggtccaagttgaactaaggattgaggattatctgaatctcaagtttattcctggactgaaagagaatatacctggtgatgtgatgtgttatgaactgcatgtctgtgtccccccaaaatgcataggttaaaatcctaacccccaagctgatggtatttgaaggtgggcattttgaggtaattaggtcatgagggtggagcccttatgaatgggattaatgcccttataaacgcgactccagagagcctgcttacactctcttctatttgagaatactgcaagaaagttgtccattggcaactcggaagaaccctcactagaacccaaccatactggcaccctcatctcagacttccagtctccagaactgtgagaaataaatttatgttgtttataagccaaccaatctatagtactttgtaatggcagcccaaactaagacactaagtaaacccagactgaagacctttaacaaaactgcaaatgagaaacagcccagtttggctaatggaggatgtcttccaagtctattctcaccctaccccatgcccttgggctacagataactcttcactgcacttcaggggtcagcacaattttttgtaaaaggccagactgtaaatatttagacttcccaagccgtgtgatctctgtcacaactactgagctctgctattgcacatgaaagcagccagaggcaaagagcaaaagagtgagtgtagctctgcttcagtgaaattatttgcaaaaagaggagatgggccaatttgtcccacaggccatatttgctgaccattgcagtgtagttcataaagtaaggaaaagagaaaagaagtaagggagaattcagccacattaccagcaggataactaggtttggacaaataagtttcagtaaaatgagaaacaaacaggaaaaacataaaccagtttaaggagggaaaatatatatttcagcccaaaataaataaagctaatatgaaaaaggtagtgtgcaaataatagaccaaaggatatgttctagtggaaagcaaacctcctcccaaagggaaaattccctagtgtacttcacaccccaagagtttacaaggacactaatttgtataagaagactttgaggataagataaaatcataacatagaaataaaaagttataagaaagtattaaggactaatatgataacaattacagaagaaagcaataaataaatgagaaagaggaaaaaaatgccaccactggtagagactcattattgcttgagaacagcactgtcccgaagaactttctgcagtgatcgtgatgttctgtaactgtgctgttcaatacagtatccacaagtgcctactgaacacttaaagtgtggttagtggagtcaaggaattgaattttaaactttataatttatttaatgaatttaaattcaaatagccacacttggctagcagctattgattcaactgcagttctggaggaaacactggagtcaatttcaatgaacacagaaaaaaagaaaataggttaaacaaatacagataacatgataaagggagaatagatacaaaacccacagaatataaagttaacctgtgtccctgagtaagaataagcaaatggaatatgacatacattttaggttataatagaagacaactttcttaaataaaggaggaatttacattacagattcaaaggacagtgtattccggtaaaatttagaaacctaatgaaatatttcctggtctttattggattttaagaataaaatgtcttcaggtatctgggaagaatataaaaagttacacctgaatgaaaattgagctactttgtgatttcttcacagtcacatttattatcaaaaggcacagaacattgtctgcaaaatgctgagggaaagaaactgagcctaaaatgtcttacattcagacatattatcattaagctataaagacagcaggcaaatatgaaataatttgggaaatacagtacacataggactatcttatgaaaccttccatataataaaatctaatcaaacaggaattgaagtgaaagccattgtaaaaaagaccaatggcaaaccgaactatttaaatatacaaccaagtttaaataaacatggaaattatggttatagaatataaatgcattttaacttaagaggtgaatattacagtatgctgaattaccttaggcctggttccccagaagtaccacctgaaatgcgaaaacaaagtcatttattaaggaaatgctccccagaaatactggcaaggaagcgggaaaggtaagtagggaaaggggagaaagcaaacaaggatacaaaggtgcaatttcaggcaaaactccagcagagcagagatgaggatttctgattaaacacagcaggttgagcacctgtttacctcttctccctctgaaaaatgatgttaaaaggcataaacccacaaggatgaggaggccaggagagaaaacaatagaaaaatgttggaagctagatagtagatgggacaatgccagttctggtcatgatggagtagctggattcatgcttaccttttcacaaaaactgtaagaagtgaaaagatgtattaaacaactgtctttgatgcaggattttggctcctttgctcagctaggtccaggttcttgtttcatgaccaggaagaattaggcacacagacatcaaagagtgaggggagttgaatttatgaagcaaaaggaaagctctcagcaaaaagaggggatgtaggggttggttctcctacctgaagacaggaaatttccccaatatggctgagcttggggctttttatgggctcagaatagggagtgtgcgctgattggtttgtgagtatccaaaaaaggtcaaagtgaagacgccactcaaatatgggcgtgacagtgtagaaaactaattaggaaagggtagatatgtgtaaaataggtgtagaatggggaacaatcagaggaaagtgcgccaaatgggaaggtgggttctcaatccagttggaggatatccctaggacagtttccagcttgaaggtcaggtttcactggggacccaccccaactgcctaggcattatctgccttctgccactatcatcggcaagcacctgatagcaagggttaaagttcctgagagaaggaaaacacacatggcaaatctcatattcattttagcttttttctttaaggacattttctaaacgcttgcacagggaaatcaagctagggaaaacagcaggtagattgaaaacaaattaatggagatacatggtgtaaacactaaccaaaaaagccaatatgactatattcacatggaacaaaatagattttaaggcaagatgtagtattagagagaaagcatgatattattaatacataataataaaaggccccattcaagcaaaagacataacaatcctaaattaactcttttgggatttacttgtatatcttgttaagcaggatcaagccagtgttagtctagggttaattttacccactactgtggcagaattcttctgagtactctacccaacatcttgtgaattatgaggtttttccagtcagctgccagggacaggcactaatcctggacctgtgagttctatggattttttttccttattctctaccttggttctttctctggccttgggtagtttcctcacacat
